US011096956B2

(12) United States Patent
Aznarez et al.

(10) Patent No.: US 11,096,956 B2
(45) Date of Patent: Aug. 24, 2021

(54) ANTISENSE OLIGOMERS AND USES THEREOF

(71) Applicants: Stoke Therapeutics, Inc., Bedford, MA (US); Cold Spring Harbor Laboratory, Cold Spring Harbor, NY (US)

(72) Inventors: Isabel Aznarez, Jamaica Plain, MA (US); Huw M. Nash, Lexington, MA (US); Adrian Krainer, East Northport, NY (US)

(73) Assignees: STOKE THERAPEUTICS, INC., Bedford, MA (US); COLD SPRING HARBOR LABORATORY, Cold Sping Harbor, NY (US)

( * ) Notice: Subject to any disclaimer, the term of this patent is extended or adjusted under 35 U.S.C. 154(b) by 92 days.

(21) Appl. No.: 16/007,435

(22) Filed: Jun. 13, 2018

(65) Prior Publication Data

US 2019/0070213 A1    Mar. 7, 2019

Related U.S. Application Data

(63) Continuation-in-part of application No. PCT/US2016/066705, filed on Dec. 14, 2016, which is a continuation-in-part of application No. PCT/US2016/066564, filed on Dec. 14, 2016, application No. 16/007,435, which is a continuation-in-part of application No. PCT/US2016/066417, filed on Dec. 14, 2016, and a continuation-in-part of application No. PCT/US2016/066721, filed on Dec. 14, 2016, and a continuation-in-part of application No. PCT/US2016/066576, filed on Dec. 14, 2016, and a continuation-in-part of application No. PCT/US2016/066684, filed on Dec. 14, 2016, and a continuation-in-part of application No. PCT/US2016/066414, filed on Dec. 13, 2016.

(60) Provisional application No. 62/319,011, filed on Apr. 6, 2016, provisional application No. 62/319,015, filed on Apr. 6, 2016, provisional application No. 62/318,958, filed on Apr. 6, 2016, provisional application No. 62/267,256, filed on Dec. 14, 2015, provisional application No. 62/267,261, filed on Dec. 14, 2015, provisional application No. 62/267,212, filed on Dec. 14, 2015, provisional application No. 62/267,238, filed on Dec. 14, 2015, provisional application No. 62/267,259, filed on Dec. 14, 2015, provisional application No. 62/267,210, filed on Dec. 14, 2015, provisional application No. 62/267,242, filed on Dec. 14, 2015, provisional application No. 62/267,252, filed on Dec. 14, 2015.

(51) Int. Cl.
*A61K 31/7125* (2006.01)
*A61K 47/68* (2017.01)
*C12N 15/113* (2010.01)
*A61P 43/00* (2006.01)
*A61K 38/00* (2006.01)
*A61K 38/17* (2006.01)
*C12N 15/62* (2006.01)
*C12N 15/11* (2006.01)

(52) U.S. Cl.
CPC ........ *A61K 31/7125* (2013.01); *A61K 38/005* (2013.01); *A61K 38/179* (2013.01); *A61K 47/6807* (2017.08); *A61P 43/00* (2018.01); *C12N 15/111* (2013.01); *C12N 15/1136* (2013.01); *C12N 15/62* (2013.01); *C12N 2310/11* (2013.01); *C12N 2310/315* (2013.01); *C12N 2310/321* (2013.01); *C12N 2320/33* (2013.01)

(58) Field of Classification Search
None
See application file for complete search history.

(56) References Cited

U.S. PATENT DOCUMENTS

| | | | |
|---|---|---|---|
| 4,866,042 | A | 9/1989 | Neuwelt |
| 5,151,510 | A | 9/1992 | Stec et al. |
| 5,656,612 | A | 8/1997 | Monia |
| 5,665,593 | A | 9/1997 | Kole et al. |
| 5,914,396 | A | 6/1999 | Cook et al. |
| 5,916,808 | A | 6/1999 | Kole et al. |
| 5,976,879 | A | 11/1999 | Kole et al. |
| 6,083,482 | A | 7/2000 | Wang |
| 6,166,197 | A | 12/2000 | Cook et al. |
| 6,210,892 | B1 | 4/2001 | Bennett et al. |
| 6,294,520 | B1 | 9/2001 | Naito |
| 6,383,752 | B1 | 5/2002 | Agrawal et al. |
| 6,436,657 | B1 | 8/2002 | Famodu et al. |

(Continued)

FOREIGN PATENT DOCUMENTS

| | | |
|---|---|---|
| CN | 103667438 A | 3/2014 |
| EP | 0549615 A1 | 7/1993 |

(Continued)

OTHER PUBLICATIONS

Cotter et al. Acta Neuropatholigca 139: 613-624 (Year: 2019).*
Mayer et al. Biochimica et Biophysica Acta 1502, 495-507 (Year: 2000).*
Aartsma-Rus, et al. Antisense-mediated exon skipping: a versatile tool with therapeutic and research applications.RNA. Oct. 2007;13(10):1609-24. Epub Aug. 7, 2007.

(Continued)

*Primary Examiner* — Brian Whiteman
(74) *Attorney, Agent, or Firm* — Wilson Sonsini Goodrich & Rosati

(57) ABSTRACT

Provided herein are methods and compositions for increasing the expression of a protein, and for treating a subject in need thereof, e.g., a subject with deficient protein expression or a subject having a disease described herein.

20 Claims, 172 Drawing Sheets

Specification includes a Sequence Listing.

(56) References Cited

U.S. PATENT DOCUMENTS

| | | |
|---|---|---|
| 6,451,991 B1 | 9/2002 | Martin et al. |
| 6,485,960 B1 | 11/2002 | Harris et al. |
| 6,531,591 B1 | 3/2003 | Fensholdt |
| 6,573,073 B2 | 6/2003 | Harris |
| 6,605,611 B2 | 8/2003 | Simmonds et al. |
| 6,632,427 B1 | 10/2003 | Finiels et al. |
| 6,639,059 B1 | 10/2003 | Kochkine et al. |
| 6,670,461 B1 | 12/2003 | Wengel et al. |
| 6,677,445 B1 | 1/2004 | Innis et al. |
| 6,734,291 B2 | 5/2004 | Kochkine et al. |
| 6,756,523 B1 | 6/2004 | Kahn et al. |
| 6,770,748 B2 | 8/2004 | Imanishi et al. |
| 6,794,499 B2 | 9/2004 | Wengel et al. |
| 6,846,921 B2 | 1/2005 | Innis et al. |
| 6,936,589 B2 | 8/2005 | Naito |
| 6,963,589 B1 | 11/2005 | Sugata et al. |
| 6,998,484 B2 | 2/2006 | Koch et al. |
| 7,015,315 B1 | 3/2006 | Cook et al. |
| 7,034,133 B2 | 4/2006 | Wengel et al. |
| 7,053,199 B2 | 5/2006 | Imanishi et al. |
| 7,053,207 B2 | 5/2006 | Wengel |
| 7,060,809 B2 | 6/2006 | Wengel et al. |
| 7,071,324 B2 | 7/2006 | Preparata et al. |
| 7,084,125 B2 | 8/2006 | Wengel |
| 7,101,993 B1 | 9/2006 | Cook et al. |
| 7,169,594 B2 | 1/2007 | Guan |
| 7,214,783 B2 | 5/2007 | Jeon et al. |
| 7,217,805 B2 | 5/2007 | Imanishi et al. |
| 7,314,923 B2 | 1/2008 | Kaneko et al. |
| 7,335,765 B2 | 2/2008 | Kaneko et al. |
| 7,368,549 B2 | 5/2008 | Dempcy et al. |
| 7,399,845 B2 | 7/2008 | Seth et al. |
| 7,432,249 B2 | 10/2008 | Crooke |
| 7,432,250 B2 | 10/2008 | Crooke |
| 7,547,684 B2 | 6/2009 | Seth et al. |
| 7,553,644 B2 | 6/2009 | Germino et al. |
| 7,569,575 B2 | 8/2009 | Soerensen et al. |
| 7,569,686 B1 | 8/2009 | Bhat et al. |
| 7,572,582 B2 | 8/2009 | Wengel et al. |
| 7,595,304 B2 | 9/2009 | Zhao et al. |
| 7,615,619 B2 | 11/2009 | Imanishi et al. |
| 7,662,946 B2 | 2/2010 | Ginsburg et al. |
| 7,662,948 B2 | 2/2010 | Kurreck et al. |
| 7,666,854 B2 | 2/2010 | Seth et al. |
| 7,687,617 B2 | 3/2010 | Thrue et al. |
| 7,696,345 B2 | 4/2010 | Allerson et al. |
| 7,741,457 B2 | 6/2010 | Seth et al. |
| 7,750,131 B2 | 7/2010 | Seth et al. |
| 7,816,333 B2 | 10/2010 | Kaneko et al. |
| 7,846,686 B2 | 12/2010 | Kramer |
| 7,951,934 B2 | 5/2011 | Freier |
| 7,994,145 B2 | 8/2011 | Imanishi et al. |
| 8,022,193 B2 | 9/2011 | Seth et al. |
| 8,030,467 B2 | 10/2011 | Seth et al. |
| 8,067,569 B2 | 11/2011 | Iversen et al. |
| 8,124,745 B2 | 2/2012 | Allerson et al. |
| 8,168,605 B2 | 5/2012 | Zhao et al. |
| 8,258,109 B2 | 9/2012 | Bennett et al. |
| 8,268,980 B2 | 9/2012 | Seth et al. |
| 8,278,036 B2 | 10/2012 | Kariko et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,293,684 B2 | 10/2012 | Mouritzen et al. |
| 8,361,979 B2 | 1/2013 | Aartsma-Rus et al. |
| 8,383,792 B2 | 2/2013 | Okamoto et al. |
| 8,394,947 B2 | 3/2013 | Bhat et al. |
| 8,415,465 B2 | 4/2013 | Freier |
| 8,436,163 B2 | 5/2013 | Iversen et al. |
| 8,450,467 B2 | 5/2013 | Manoharan et al. |
| 8,461,124 B2 | 6/2013 | Chattopadhyaya |
| 8,492,390 B2 | 7/2013 | Detlef et al. |
| 8,501,703 B2 | 8/2013 | Bennett et al. |
| 8,501,805 B2 | 8/2013 | Seth et al. |
| 8,518,908 B2 | 8/2013 | Hrdlicka et al. |
| 8,530,640 B2 | 9/2013 | Seth et al. |
| 8,541,562 B2 | 9/2013 | Obika et al. |
| 8,546,556 B2 | 10/2013 | Seth et al. |
| 8,592,156 B2 | 11/2013 | Liu et al. |
| 8,637,478 B2 | 1/2014 | Bennett |
| RE44,779 E | 2/2014 | Imanishi et al. |
| 8,653,252 B2 | 2/2014 | Elmen et al. |
| 8,673,560 B2 | 3/2014 | Leamon et al. |
| 8,680,254 B2 | 3/2014 | Lutz et al. |
| 8,691,783 B2 | 4/2014 | Thum et al. |
| 8,703,728 B2 | 4/2014 | Swayze et al. |
| 8,710,021 B2 | 4/2014 | Anro et al. |
| 8,735,366 B2 | 5/2014 | Bauer et al. |
| 8,748,089 B2 | 6/2014 | Kariko et al. |
| 8,779,118 B2 | 7/2014 | Allerson et al. |
| 8,796,437 B2 | 8/2014 | Swayze et al. |
| 8,809,516 B2 | 8/2014 | Manoharan et al. |
| 8,846,386 B2 | 9/2014 | Ambati et al. |
| 8,846,637 B2 | 9/2014 | Seth et al. |
| 8,846,639 B2 | 9/2014 | Swayze et al. |
| 8,846,885 B2 | 9/2014 | Hirai et al. |
| 8,895,722 B2 | 11/2014 | Iversen et al. |
| 8,957,040 B2 | 2/2015 | Bennett et al. |
| 8,957,200 B2 | 2/2015 | Seth et al. |
| 8,957,201 B2 | 2/2015 | Kaneko et al. |
| 9,006,415 B2 | 4/2015 | Ren et al. |
| 9,029,335 B2 | 5/2015 | Prakash et al. |
| 9,045,518 B2 | 6/2015 | Christensen et al. |
| 9,045,754 B2 | 6/2015 | Bhanot et al. |
| 9,057,066 B2 | 6/2015 | Hung et al. |
| 9,109,001 B2 | 8/2015 | Parsy et al. |
| 9,127,272 B2 | 9/2015 | Esau et al. |
| 9,127,276 B2 | 9/2015 | Prakash et al. |
| 9,156,873 B2 | 10/2015 | Prakash et al. |
| 9,157,081 B2 | 10/2015 | Bennett et al. |
| 9,181,549 B2 | 11/2015 | Prakash et al. |
| 9,187,515 B2 | 11/2015 | Mayes et al. |
| 9,192,621 B2 | 11/2015 | Mayes et al. |
| 9,193,752 B2 | 11/2015 | Migawa et al. |
| 9,193,969 B2 | 11/2015 | Montefeltro et al. |
| 9,211,300 B2 | 12/2015 | Mayes et al. |
| 9,217,147 B2 | 12/2015 | Singh et al. |
| 9,221,864 B2 | 12/2015 | Seth et al. |
| 9,243,245 B2 | 1/2016 | De et al. |
| 9,290,534 B2 | 3/2016 | Seth et al. |
| 9,296,778 B2 | 3/2016 | Parsy et al. |
| 9,309,275 B2 | 4/2016 | Stewart et al. |
| 9,315,535 B2 | 4/2016 | Mitsuoka et al. |
| 9,334,495 B2 | 5/2016 | Khvorova et al. |
| 9,339,541 B2 | 5/2016 | Dousson et al. |
| 9,347,068 B2 | 5/2016 | Dhugga et al. |
| 9,359,445 B2 | 6/2016 | Finkbeiner et al. |
| 9,359,603 B2 | 6/2016 | Lutz et al. |
| 9,359,609 B2 | 6/2016 | Duffield et al. |
| 9,410,155 B2 | 8/2016 | Collard et al. |
| 9,428,534 B2 | 8/2016 | Christensen et al. |
| 9,447,166 B2 | 9/2016 | Ambati et al. |
| 9,453,261 B2 | 9/2016 | Lee et al. |
| 9,464,292 B2 | 10/2016 | Okumura et al. |
| 9,499,818 B2 | 11/2016 | Van |
| 9,518,259 B2 | 12/2016 | Rigo et al. |
| 9,534,222 B2 | 1/2017 | Ambati et al. |
| 9,550,988 B2 | 1/2017 | Swayze |
| 9,714,422 B2 | 7/2017 | Vorechovsky et al. |
| 9,745,577 B2 | 8/2017 | Vorechovsky et al. |
| 9,771,579 B2 | 9/2017 | Collard et al. |
| 9,976,143 B2 | 5/2018 | Krainer et al. |
| 10,196,639 B2 | 2/2019 | Vorechovsky et al. |
| 2003/0148974 A1 | 8/2003 | Monia et al. |
| 2004/0063129 A1 | 4/2004 | Gaarde et al. |
| 2004/0102401 A1 | 5/2004 | Dean et al. |
| 2004/0219515 A1 | 11/2004 | Bentwich |
| 2005/0221354 A1 | 10/2005 | Mounts |
| 2005/0233327 A1 | 10/2005 | Welch et al. |
| 2006/0062790 A1 | 3/2006 | Reinhard et al. |
| 2006/0134670 A1 | 6/2006 | Piu |
| 2007/0009899 A1 | 1/2007 | Mounts |
| 2007/0087376 A1 | 4/2007 | Potashkin |
| 2007/0249538 A1 | 10/2007 | Sazani et al. |

(56) References Cited

U.S. PATENT DOCUMENTS

| | | |
|---|---|---|
| 2008/0269123 A1 | 10/2008 | Li et al. |
| 2009/0186846 A1 | 7/2009 | Chabot et al. |
| 2009/0186946 A1 | 7/2009 | Taketomi et al. |
| 2009/0264353 A1 | 10/2009 | Orum et al. |
| 2009/0270332 A1 | 10/2009 | Bare et al. |
| 2010/0150839 A1 | 6/2010 | Kelleher |
| 2010/0166784 A1 | 7/2010 | Murphy et al. |
| 2011/0124591 A1 | 5/2011 | Bennett |
| 2011/0229891 A1 | 9/2011 | Michaud et al. |
| 2012/0190728 A1 | 7/2012 | Bennett et al. |
| 2012/0252877 A1 | 10/2012 | Lo |
| 2013/0072671 A1 | 3/2013 | Van |
| 2013/0096183 A1 | 4/2013 | Collard et al. |
| 2013/0109850 A1 | 5/2013 | Prakash et al. |
| 2013/0136732 A1 | 5/2013 | Wagner et al. |
| 2013/0184223 A1 | 7/2013 | Land et al. |
| 2013/0253036 A1 | 9/2013 | Collard et al. |
| 2013/0266560 A1 | 10/2013 | Demopulos et al. |
| 2013/0289092 A1 | 10/2013 | Rigo et al. |
| 2014/0011761 A1 | 1/2014 | Hotamisligil et al. |
| 2014/0128449 A1 | 5/2014 | Liu et al. |
| 2014/0186839 A1 | 7/2014 | Margulies et al. |
| 2014/0194610 A1 | 7/2014 | Verdine et al. |
| 2014/0235605 A1 | 8/2014 | Shiffman et al. |
| 2014/0309181 A1 | 10/2014 | Collard et al. |
| 2014/0343127 A1 | 11/2014 | Kammler |
| 2014/0349290 A1 | 11/2014 | Watnick et al. |
| 2014/0378526 A1 | 12/2014 | Rossi et al. |
| 2014/0378527 A1 | 12/2014 | Van |
| 2014/0378533 A1 | 12/2014 | Freier |
| 2015/0004217 A1 | 1/2015 | Guild et al. |
| 2015/0018540 A1 | 1/2015 | Prakash et al. |
| 2015/0184153 A1 | 7/2015 | Freier et al. |
| 2015/0211006 A1 | 7/2015 | Butler et al. |
| 2015/0211010 A1 | 7/2015 | Kerem et al. |
| 2015/0232845 A1 | 8/2015 | Ozsolak |
| 2015/0232858 A1 | 8/2015 | Ozsolak |
| 2015/0238516 A1 | 8/2015 | Dowdy et al. |
| 2015/0267192 A1 | 9/2015 | Heartlein et al. |
| 2015/0291957 A1 | 10/2015 | Smith |
| 2015/0329918 A1 | 11/2015 | Kang et al. |
| 2015/0337310 A1 | 11/2015 | Walker et al. |
| 2015/0361497 A1 | 12/2015 | Rose |
| 2016/0017322 A1 | 1/2016 | Vorechovsky et al. |
| 2016/0024500 A1 | 1/2016 | Popplewell et al. |
| 2016/0046935 A1 | 2/2016 | Bentwich et al. |
| 2016/0122767 A1 | 5/2016 | Gouya et al. |
| 2016/0201063 A1 | 7/2016 | Ozsolak |
| 2016/0201064 A1 | 7/2016 | Ozsolak |
| 2016/0208264 A1 | 7/2016 | Wilton et al. |
| 2016/0215291 A1 | 7/2016 | Garcia et al. |
| 2016/0244762 A1 | 8/2016 | Igor et al. |
| 2016/0244767 A1 | 8/2016 | Hastings |
| 2016/0298121 A1* | 10/2016 | Krainer .................... A61P 9/10 |
| 2017/0159049 A9 | 6/2017 | Krainer et al. |
| 2017/0240904 A1 | 8/2017 | Tallent et al. |
| 2018/0002694 A1 | 1/2018 | Vorechovsky et al. |
| 2018/0201937 A1* | 7/2018 | Gomez ............. C12N 15/1138 |
| 2018/0362987 A1 | 12/2018 | Krainer et al. |
| 2018/0369275 A1 | 12/2018 | Arnarez et al. |
| 2019/0024118 A1 | 1/2019 | Tagliatela et al. |
| 2019/0024119 A1 | 1/2019 | Tagliatela et al. |
| 2019/0024120 A1 | 1/2019 | Tagliatela et al. |
| 2019/0024121 A1 | 1/2019 | Tagliatela et al. |

FOREIGN PATENT DOCUMENTS

| | | |
|---|---|---|
| EP | 1201678 B1 | 9/2004 |
| EP | 1409497 B1 | 1/2005 |
| EP | 1007714 B1 | 12/2005 |
| EP | 1334109 B1 | 5/2006 |
| EP | 1178999 B1 | 3/2007 |
| EP | 1203827 B1 | 5/2007 |
| EP | 1501848 B1 | 8/2007 |
| EP | 1569661 B1 | 9/2009 |
| EP | 1161439 B1 | 4/2010 |
| EP | 1984381 B1 | 9/2010 |
| EP | 1013661 B1 | 1/2012 |
| EP | 2092065 B1 | 1/2012 |
| EP | 2099461 B1 | 3/2012 |
| EP | 2170917 B1 | 6/2012 |
| EP | 2066684 B1 | 7/2012 |
| EP | 2284269 A3 | 8/2012 |
| EP | 2356129 B1 | 4/2013 |
| EP | 2376516 B1 | 4/2013 |
| EP | 2114981 B1 | 5/2013 |
| EP | 2149605 B1 | 7/2013 |
| EP | 2285819 B1 | 10/2013 |
| EP | 2161038 B1 | 12/2013 |
| EP | 1562971 B1 | 2/2014 |
| EP | 2295441 B1 | 5/2014 |
| EP | 2314594 B1 | 7/2014 |
| EP | 2410053 B1 | 10/2014 |
| EP | 2176280 B2 | 6/2015 |
| EP | 2361921 B1 | 6/2015 |
| EP | 2462153 B1 | 7/2015 |
| EP | 1015469 B2 | 11/2015 |
| EP | 2173760 B2 | 11/2015 |
| EP | 1937312 B1 | 6/2016 |
| EP | 2141233 B1 | 10/2016 |
| EP | 2410054 B1 | 1/2017 |
| GB | 2546719 A | 8/2017 |
| WO | WO-9402501 A1 | 2/1994 |
| WO | WO-9426887 A1 | 11/1994 |
| WO | WO-2005049651 A2 | 6/2005 |
| WO | WO-2006107846 A2 | 10/2006 |
| WO | WO-2007002390 A2 | 1/2007 |
| WO | WO-2007048628 A2 | 5/2007 |
| WO | WO-2007048629 A2 | 5/2007 |
| WO | WO-2007002390 A3 | 11/2007 |
| WO | WO-2009084472 A1 | 7/2009 |
| WO | WO-2010148249 A1 | 12/2010 |
| WO | WO-2011057350 A1 | 5/2011 |
| WO | WO-2012178146 A1 | 12/2012 |
| WO | WO-2013081755 A1 | 6/2013 |
| WO | WO-2013106770 A1 | 7/2013 |
| WO | WO-2013119916 A2 | 8/2013 |
| WO | WO-2014012081 A2 | 1/2014 |
| WO | WO-201428459 A1 | 2/2014 |
| WO | WO-2014028459 A1 | 2/2014 |
| WO | WO-2014031575 A1 | 2/2014 |
| WO | WO-2014049536 A2 | 4/2014 |
| WO | WO-2014121287 A2 | 8/2014 |
| WO | WO-2014172698 A1 | 10/2014 |
| WO | WO-2014201413 A1 | 12/2014 |
| WO | WO-2014209841 A2 | 12/2014 |
| WO | WO-2015035091 A1 | 3/2015 |
| WO | WO-2015024876 A3 | 7/2015 |
| WO | WO-2015190922 A1 | 12/2015 |
| WO | WO-2015193651 A1 | 12/2015 |
| WO | WO-2015198054 A1 | 12/2015 |
| WO | WO-2016027168 A2 | 2/2016 |
| WO | WO-2016054615 A2 | 4/2016 |
| WO | WO-2016061509 A1 | 4/2016 |
| WO | WO-2016077837 A1 | 5/2016 |
| WO | WO-2016087842 A1 | 6/2016 |
| WO | WO-2016118697 A1 | 7/2016 |
| WO | WO-2016128343 A1 | 8/2016 |
| WO | WO-2016138534 A2 | 9/2016 |
| WO | WO-2016161429 A1 | 10/2016 |
| WO | WO-2016196386 A1 | 12/2016 |
| WO | WO-2017053982 A1 | 3/2017 |
| WO | WO-2017060731 A1 | 4/2017 |
| WO | WO-2017106210 A1 | 6/2017 |
| WO | WO-2017106211 A1 | 6/2017 |
| WO | WO-2017106283 A1 | 6/2017 |
| WO | WO-2017106292 A1 | 6/2017 |
| WO | WO-2017106364 A2 | 6/2017 |
| WO | WO-2017106370 A1 | 6/2017 |
| WO | WO-2017106375 A1 | 6/2017 |
| WO | WO-2017106377 A1 | 6/2017 |
| WO | WO-2017106382 A1 | 6/2017 |
| WO | WO-2017106364 A3 | 7/2017 |

(56) References Cited

FOREIGN PATENT DOCUMENTS

| WO | WO-2018187363 A1 | 10/2018 |
|---|---|---|
| WO | WO-2019040923 A1 | 2/2019 |
| WO | WO-2019084050 A1 | 5/2019 |

OTHER PUBLICATIONS

Aizer AA, et al. Lack of reduction in racial disparities in cancer-specific mortality over a 20-year period. Cancer. 2014;120:1532-9.
Altschul SF et al.Basic local alignment search tool. J. Mol. Biol., vol. 215, No. 3, pp. 403-410, (Oct. 5, 1990).
Aly, et al. Extreme genetic risk for type 1A diabetes. Proc Natl Acad Sci U S A. Sep. 19, 2006;103(38):14074-9. Epub Sep. 11, 2006.
Amarnath, S. et al. The PDL1-PD1 Axis Converts Human TH1 Cells into Regulatory T Cells. Science Translational Medicine, vol. 3, No. 111, pp. 1-13. (Nov. 30, 2011).
Anders S. et al. Detecting differential usage of exons from RNA-seq data. Genome Res. 2012;22(10):2008-17. Epub Jun. 23, 2012.doi: gr.133744.111 [pii] 10.1101/gr.133744.111. PubMed PMID: 22722343.
Au, K.S. et al. Molecular Genetic Basis of Tuberous Sclerosis Complex: From Bench to Bedside.Journal of Child Neurology. vol. 19, No. 9 (Sep. 2004).
Aznarez, et al. TANGO—Targeted augmentation of nuclear gene output—for the treatment of genetic diseases [abstract]. In: 2018 Annual Meeting Abstract of the American Society of Gene and Cell Therapy; May 16-19, 2018; Chicago, IL; 2018. Abstract No. 304.
Bakkenist CJ, Kastan MB. DNA damage activates ATM through intermolecular autophosphorylation and dimer dissociation. Nature. 2003;421(6922):499-506. doi: 10.1038/nature01368. PubMed PMID: 12556884.
Balagurumoorthy, et al. Hairpin and parallel quartet structures for telomeric sequences. Nucleic Acids Res. Aug. 11, 1992;20(15):4061-7.
Balkwill, et al. Repression of translation of human estrogen receptor alpha by G-quadruplex formation. Biochemistry. Dec. 8, 2009;48(48):11487-95. doi: 10.1021/bi901420k.
Barratt, et al. Remapping the insulin gene/IDDM2 locus in type 1 diabetes. Diabetes. Jul. 2004;53(7):1884-9.
Bassi et al. A novel mutation in the ATP1A2 gene causes alternating hemiplegia of childhood. J. Med. Genet. 41:621-628 (2004).
Battistini et al. A new CACNA1A gene mutation in acetazolamide-responsive familial hemiplegic migraine and ataxia.Neurology, vol. 53, No. 1, pp. 38-43 (Jul. 13, 1999).
Baughan, et al. Delivery of bifunctional RNAs that target an intronic repressor and increase SMN levels in an animal model of spinal muscular atrophy. Hum Mol Genet. May 1, 2009;18(9):1600-11. doi: 10.1093/hmg/ddp076. Epub Feb. 19, 2009.
Bauman et al. Therapeutic potential of splice-switching oligonucleotides. Oligonucleotides 19.1 (2009): 1-13.
Beaudoin, et al. 5'-UTR G-quadruplex structures acting as translational repressors. Nucleic Acids Res. Nov. 2010;38(20):7022-36. doi: 10.1093/nar/gkq557. Epub Jun. 22, 2010.
Belt P, et al., Proteomic investigations reveal a role for RNA processing factor THRAP3 in the DNA damage response. Mol Cell. 2012;46(2):212-25. doi: 10.1016/j.molcel.2012.01.026. PubMed PMID: 22424773; PubMed Central PMCID: PMC3565437.
Berge, SM et al. Pharmaceutical Salts Journal of Pharmaceutical Sciences, vol. 66, No. 1, pp. 1-19 (1977).
Berger, W. et al. The molecular basis of human retinal and vitreoretinal diseases. Progress in Retinal and Eye Research . vol. 29, pp. 335-375 (2010).
Bethke L, et al. Comprehensive analysis of the role of DNA repair gene polymorphisms on risk of glioma. Hum Mol Genet. 2008;17(6):800-5. Epub Dec. 1, 2007.doi: ddm351 [pii] 10.1093/hmg/ddm351. PubMed PMID: 18048407.
Bicknell, et al. Introns in UTRs: why we should stop ignoring them. Bioessays. Dec. 2012;34(12):1025-34. doi: 10.1002/bies.201200073. Epub Oct. 26, 2012.
Blencowe, Benjamin. Reflections for the 20th anniversary issue of RNA journal.RNA Journal, vol. 21, No. 4, pp. 573-575 (2015).
Blencowe BJ. Splicing regulation: the cell cycle connection. Curr Biol. 2003;13(4):R149-51. PubMed PMID: 12593819.
Bonnen, P.E., et al. Haplotypes at ATM identify coding-sequence variation and indicate a region of extensive linkage disequilibrium. Am J Hum Genet. 2000;67(6):1437-51. Epub Nov. 15, 2000.doi: S0002-9297(07)63213-3 [pii] 10.1086/316908. PubMed PMID: 11078475.
Boothby, T. et al. Removal of Retained Introns Regulates Translation in the Rapidly Developing Gametophyte of Marsilea vestita. Developmental Cell vol. 24, pp. 517-529, (Mar. 11, 2013).
Booy, et al. The RNA helicase RHAU (DHX36) unwinds a G4-quadruplex in human telomerase RNA and promotes the formation of the P1 helix template boundary. Nucleic Acids Res. May 2012;40(9):4110-24. doi: 10.1093/nar/gkr1306. Epub Jan. 11, 2012.
Boutz, et al. Detained introns are a novel, widespread class of post-transcriptionally spliced introns. Genes Dev. Jan. 1, 2015;29(1):63-80. doi: 10.1101/gad.247361.114.
Braunschweig, et al. Widespread intron retention in mammals functionally tunes transcriptomes. Widespread intron retention in mammals functionally tunes transcriptomes. Genome Res. Nov. 2014;24(11):1774-86. doi: 10.1101/gr.177790.114. Epub Sep. 25, 2014.
Bravo-Gil, et al., Improving the management of Inherited Retinal Dystrophies by targeted sequencing of a population-specific gene panel, Scientific Reports, 6:23910, 10 pages.
Brooks, A.N., et al. A pan-cancer analysis of transcriptome changes associated with somatic mutations in U2AF1 reveals commonly altered splicing events. PLoS One. 2014; 9(1):e87361. Epub Feb. 6, 2014.doi: 10.1371/journal.pone.0087361 PONE-D-13-26905 [pii]. PubMed PMID: 24498085.
Buchman, et al. Comparison of intron-dependent and intron-independent gene expression. Mol Cell Biol. Oct. 1988;8(10):4395-405.
Buckley, P.T. et al. Cytoplasmic intron retention, function, splicing, and the sentinel RNA hypothesis.WIREs RNA, vol. 5, pp. 223-2330 (Mar./Apr. 2014).
Bugaut, et al. 5'-UTR RNA G-quadruplexes: translation regulation and targeting. Nucleic Acids Res. Jun. 2012;40(11):4727-41. doi: 10.1093/nar/gks068. Epub Feb. 20, 2012.
Bugaut, et al. An RNA hairpin to G-quadruplex conformational transition. J Am Chem Soc. Dec. 12, 2012;134(49):19953-6. doi: 10.1021/ja308665g. Epub Nov. 29, 2012.
Buratti, et al. DBASS3 and DBASS5: databases of aberrant 3'- and 5'-splice sites. Nucleic Acids Res. Jan. 2011;39(Database issue):D86-91. doi: 10.1093/nar/gkq887. Epub Oct. 6, 2010.
Buratti, et al. RNA folding affects the recruitment of SR proteins by mouse and human polypurinic enhancer elements in the fibronectin EDA exon. Mol Cell Biol. Feb. 2004;24(3):1387-400.
Burnette et al. Subdivision of large introns in *Drosophila* by recursive splicing at non-exonic elements. Genetics (2005).
Burns, CG, et al. Connections between pre-mRNA processing and regulation of the eukaryotic cell cycle. Front Horm Res. 1999; 25:59-82.
Busslinger, et al. β+ Thalassemia: Aberrant splicing results from a single point mutation in an intron. Cell 27.2 (1981): 289-298.
Callis, et al. Introns increase gene expression in cultured maize cells. Genes Dev. Dec. 1987;1(10):1183-200.
Catterall, et al. Nav1.1 channels and epilepsy. J Physiol. Jun. 1, 2010;588(Pt 11):1849-59.
Cavaloc, et al. The splicing factors 9G8 and SRp20 transactivate splicing through different and specific enhancers. RNA. Mar. 1999;5(3):468-83.
Cazzola, et al. Translational pathophysiology: a novel molecular mechanism of human disease. Blood. Jun. 1, 2000;95(11):3280-8.
Chambers, A.L., et al. The INO80 chromatin remodeling complex prevents polyploidy and maintains normal chromatin structure at centromeres. Genes Dev. 2012; 26(23):2590-603. Epub Dec. 5, 2012.doi: 26/23/2590 [pii] 10.1101/gad.199976.112. PubMed PMID: 23207916.
Chen, M.S., et al. Chk1 kinase negatively regulates mitotic function of Cdc25A phosphatase through 14-3-3 binding. Mol Cell Biol. 2003; 23(21):7488-97. PubMed PMID: 14559997; PubMed Central PMCID PMC207598.

(56) References Cited

OTHER PUBLICATIONS

Chen, T., et al. A functional single nucleotide polymorphism in promoter of ATM is associated with longevity. Mech Ageing Dev. 2010; 131:636-40.
Choi, HH, et al. CHK2 kinase promotes pre-mRNA splicing via phosphorylating CDK11p110. Oncogene. 2014; 33:108-15.
Colla, S., et al. Telomere dysfunction drives aberrant hematopoietic differentiation and myelodysplastic syndrome. Cancer Cell. 2015; 27(5):644-57. doi: 10.1016/j.ccell.2015.04.007. PubMed PMID: 25965571.
Collie, et al. The application of DNA and RNA G-quadruplexes to therapeutic medicines. Chem Soc Rev. Dec. 2011;40(12):5867-92. doi: 10.1039/c1cs15067g. Epub Jul. 25, 2011.
Consortium. TGP. An integrated map of genetic variation from 1,092 human genomes. Nature (London). 2012; 491:56-65.
Co-pending U.S. Appl. No. 16/213,535, filed Dec. 7, 2018.
Corallini et al. Transcriptional and Posttranscriptional Regulation of the CTNS Gene. Pediatric Research 70(2):130-135 (Aug. 2011).
Corey, S.J., et al. A non-classical translocation involving 17q12 (retinoic acid receptor alpha) in acute promyelocytic leukemia (APML) with atypical features. Leukemia. 1994; 8(8):1350-3. PubMed PMID: 8057672.
Corvelo, A., et al. Genome-wide association between branch point properties and alternative splicing. PLoS Comput Biol. 2010; 6(11):e1001016. Epub Dec. 3, 2010.doi: 10.1371/journal.pcbi. 1001016. PubMed PMID: 21124863.
Coulombe-Huntington J., et al. Fine-Scale Variation and Genetic Determinants of Alternative Splicing across Individuals. PLoS Genet. 2009; 5(12):e1000766. Epub Dec. 17, 2009.doi: 10.1371/journal.pgen.1000766. PubMed PMID: 20011102.
Coutinho, G., et al. Functional significance of a deep intronic mutation in the ATM gene and evidence for an alternative exon 28a. Hum Mutat. 2005; 25(2):118-24. Epub Jan. 12, 2005.doi: 10.1002/humu.20170. PubMed PMID: 15643608.
Creacy, et al. G4 resolvase 1 binds both DNA and RNA tetramolecular quadruplex with high affinity and is the major source of tetramolecular quadruplex G4-DNA and G4-RNA resolving activity in HeLa cell lysates. J Biol Chem. Dec. 12, 2008;283(50):34626-34. doi: 10.1074/jbc.M806277200. Epub Oct. 7, 2008.
Culler, et al. Functional selection and systematic analysis of intronic splicing elements identify active sequence motifs and associated splicing factors. Nucleic Acids Res. Aug. 2010;38(15):5152-65. doi: 10.1093/nar/gkq248. Epub Apr. 12, 2010.
Davies, et al. A genome-wide search for human type 1 diabetes susceptibility genes. Nature. Sep. 8, 1994;371(6493):130-6.
Decorsiere, et al. Essential role for the interaction between hnRNP H/F and a G quadruplex in maintaining p53 pre-mRNA 3'-end processing and function during DNA damage. Genes Dev. Feb. 1, 2011;25(3):220-5. doi: 10.1101/gad.607011.
Dedic, T. et al. Alagille Syndrome Mimicking Biliary Atresia in Early Infancy, PLOS OONE, 10(11):e0143939: pp. 1-7 (Nov. 20, 2015).
Deere, J. et al. AntisensePhosphorodiamidate Morpholino OligomerLengthand TargetPositionEffects on Gene-SpecificInhibitionin *Escherichia coli*. Antimicrobial Agents andChemotherapy, vol. 49, No. 1, p. 249-255(Jan. 2005.
Derecka, et al. Occurrence of a quadruplex motif in a unique insert within exon C of the bovine estrogen receptor alpha gene (ESR1). Biochemistry. Sep. 7, 2010;49(35):7625-33. doi: 10.1021/bi100804f.
Dias, N. et al. Antisense oligonucleotides: basic concepts and mechanisms Mol. Cancer Ther. vol. 1, pp. 347-355, (Mar. 2002).
Didiot, et al. The G-quartet containing FMRP binding site in FMR1 mRNA is a potent exonic splicing enhancer. Nucleic Acids Res. Sep. 2008;36(15):4902-12. doi: 10.1093/nar/gkn472. Epub Jul. 24, 2008.
Ding, H. et al. DeliveringPD-1 inhibitory signal concomitant with blocking ICOS co-stimulation suppresses lupus-like syndrome in autoimmune BXSB mice.Clinical Immunology, vol. 118, pp. 258-267, (2006).
Divina, P. et al. Ab initio prediction of cryptic splice-site activation and exon skipping. Eur J Hum Genet. 2009; 17:759-65.
Dominski, et al. Restoration of correct splicing in thalassemic pre-mRNA by antisense oligonucleotides. Proc Natl Acad Sci U S A. Sep. 15, 1993;90(18):8673-7.
Dredge, et al. NeuN/Rbfox3 Nuclear and Cytoplasmic Isoforms Differentially Regulate Alternative Splicing and Nonsense-Mediated Decay of Rbfox2. PLoS One. 2011; 6(6): e21585.
Du, et al. Correction of prototypic ATM splicing mutations and aberrant ATM function with antisense morpholino oligonucleotides. Proc Natl Acad Sci U S A. Apr. 3, 2007;104(14):6007-12. Epub Mar. 26, 2007.
Ducros et al.Recurrence of the T666M calcium channel CACNA1A gene mutation in familial hemiplegic migraine with progressive cerebellar ataxia.Am J Hum Genet. vol. 64, No. 1, pp. 89-98 (Jan. 1999).
Duryagina R, et al. Overexpression of Jagged-1 and its intracellular domain in human mesenchymal stromal cells differentially affect the interaction with hematopoietic stem and progenitor cells.Stem Cells Dev. vol. 22, No. 20, pp. 2736-2750 (2013).
Dutertre, M., et al. et al. DNA damage: RNA-binding proteins protect from near and far. Trends Biochem Sci. 2014; 39(3):141-9. Epub Feb. 19, 2014.doi: S0968-0004(14)00015-2 [pii] 10.1016/j.tibs.2014.01.003. PubMed PMID: 24534650.
Eddy, et al. G4 motifs correlate with promoter-proximal transcriptional pausing in human genes. Nucleic Acids Res. Jul. 2011;39(12):4975-83. doi: 10.1093/nar/gkr079. Epub Mar. 3, 2011.
El Bougrini, J., et al. PML positively regulates interferon gamma signaling. Biochimie. 2011; 93(3):389-98. doi: 10.1016/j.biochi. 2010.11.005. PubMed PMID: 21115099.
Emerick, et al. Multivariate analysis and visualization of splicing correlations in single-gene transcriptomes. BMC Bioinformatics. Jan. 18, 2007;8:16.
EP 15846242.4 Partial Supplementary Search Report and Search Opinion dated May 2, 2018.
EP15729929.8 Office Action dated Dec. 22, 2017.
EP15729929.8 Office Action dated Oct. 30, 2018.
EP15846242.4 Extended European Search Report dated Aug. 21, 2018.
Fairbrother, W.G., et al. Predictive identification of exonic splicing enhancers in human genes. Science. 2002; 297(5583):1007-13. PubMed PMID: 12114529.
Fededa, et al. A polar mechanism coordinates different regions of alternative splicing within a single gene. Mol Cell. Aug. 5, 2005;19(3):393-404.
Ferreira, P.G., et al. Transcriptome characterization by RNA sequencing identifies a major molecular and clinical subdivision in chronic lymphocytic leukemia. Genome Res. 2014; 24:212-26.
Fletcher, Sue et al. Antisense suppression of donor splice site mutations in the dystrophin gene transcript.Molecular Genetics & Genomic Medicine, vol. 1, No. 3, pp. 162-173, Jun. 13, 2013.
Fred, et al. The human insulin mRNA is partly translated via a cap- and eIF4A-independent mechanism. Biochem Biophys Res Commun. Sep. 9, 2011;412(4):693-8. doi: 10.1016/j.bbrc.2011.08.030. Epub Aug. 16, 2011.
Friedman, KJ et al. Correction of aberrant splicing of the cystic fibrosis transmembrane conductance regulator (CFTR) gene by antisense oligonucleotides. J Biol Chem. Dec. 17, 1999;274(51):36193-36199.
Friend, KL et al. Detection of a novel missense mutation and second recurrent mutation in the CACNA1A gene in individuals with EA-2 and FHM. Hum Genet. vol. 105(3):261-5 (Sep. 1999).
Furukawa & Kish 2008, GeneReviews Pagon Ra et al. eds. Univ. of WA Seattle, NCBI Bookshelf ID NBK1437.
Galante, et al. Detection and evaluation of intron retention events in the human transcriptome. RNA. May 2004;10(5):757-65.
Garner, et al. Selectivity of small molecule ligands for parallel and anti-parallel DNA G-quadruplex structures. Org Biomol Chem. Oct. 21, 2009;7(20):4194-200. doi: 10.1039/b910505k. Epub Aug. 14, 2009.

(56) References Cited

OTHER PUBLICATIONS

Geary et al. Absolute Bioavailability of 29-O-(2-Methoxyethyl)-Modified Antisense Oligonucleotides following Intraduodenal Instillation in Rats. J Pharmacal Exp Ther. vol. 296, No. 3, pp. 898-904 (Mar. 2001).

Geary, RS, et al., Pharmacokinetic properties of 2'-O-(2-methoxyethyl)-modified oligonucleotide analogs in ratsJ Pharmacal Exp Ther. vol. 296, No. 3, pp. 890-897 (Mar. 2001).

Gianchecchi, E. et al. Recent insights into the role of the PD-1/PD-L1 pathway in immunological tolerance and autoimmunity Autoimmunity Reviews vol. 12, pp. 1091-1100, (2013).

Gibson, G. Hints of hidden heritability in GWAS. Nat Genet. 2010; 42(7):558-60. Epub Jun. 29, 2010.doi: ng0710-558 [pii] 10.1038/ng0710-558. PubMed PMID: 20581876.

Gohring, J. et al. Imaging of Endogenous MessengerRNA Splice Variants in Living Cells Reveals Nuclear Retention of Transcripts Inaccessible to Nonsense-Mediated Decay in *Arabidopsis*.The Plant Cell.vol. 26, pp. 754-764.(Feb. 2014).

Gomez, et al. Telomerase downregulation induced by the G-quadruplex ligand 12459 in A549 cells is mediated by hTERT RNA alternative splicing. Nucleic Acids Res. Jan. 16, 2004;32(1):371-9. Print 2004.

Goncharova et al. Tuberin regulates p70 S6 kinase activation and ribosomal protein S6 phosphorylation. A role for the TSC2 tumor suppressor gene in pulmonary lymphangioleiomyomatosis (LAM). J. Biol. Chem. (Aug. 23, 2002) 277(34);30958-67. EPub Jun. 3, 2002.

Gonzalez-Santos, et al., Mutation in the splicing factor Hprp3p linked to retinitis pigmentosa impairs interactions within the U4/U6 snRNP pigmentosa impairs interactions within the U4/U6 snRNP complex, PubMed Central Canada , Author Manuscript, 29 pages.

Goyenvalie, et al. Therapeutic approaches to muscular dystrophy. Hum Mol Genet. Apr. 15, 2011;20(R1):R69-78. doi: 10.1093/hmg/ddr105. Epub Mar. 24, 2011.

Gozani, O., et al. A potential role for U2AF-SAP 155 interactions in recruiting U2 snRNP to the branch site. Mol Cell Biol. 1998; 18(8):4752-60. PubMed PMID: 9671485.

Graveley, B.R. The haplo-spliceo-transcriptome: common variations in alternative splicing in the human population. Trends Genet. 2008; 24(1):5-7. Epub Dec. 7, 2007.doi: S0168-9525(07)00349-6 [pii] 10.1016/j.tig.2007.10.004. PubMed PMID: 18054116.

Gutell, R.R., et al. A story: unpaired adenosine bases in ribosomal RNAs. J Mol Biol. 2000; 304(3):335-54. Epub Nov. 25, 2000.doi: 10.1006/jmbi.2000.4172 50022-2836(00)94172-X [pii]. PubMed PMID: 11090278.

Guth, S., et al. Dual function for U2AF(35) in AG-dependent pre-mRNA splicing. Mol Cell Biol. 2001;21(22):7673-81. PubMed PMID: 11604503.

Hai, et al. A G-tract element in apoptotic agents-induced alternative splicing. Nucleic Acids Res. Jun. 2008;36(10):3320-31. doi: 10.1093/nar/gkn207. Epub Apr. 24, 2008.

Hamdan, F. et al. Mutations in SYNGAP1 in Autosomal Nonsyndromic Mental Retardation.The New England Journal of Medicine.N. Engl. Med. vol. 360, No. 6, pp. 599, (Feb. 5, 2009).

Hamdan, F. F. et al. De Novo SYNGAP1 Mutations in Nonsyndromic Intellectual Disability and Autism, Biol. Psychiatry, 69:898-901 (2011).

Han, et al. TANGO-Targeted augmentation of nuclear gene output for the treatment of genetic diseases. Poster session presented at the American Society of Gene and Cell Therapy, Chicago, IL. (May 2018).

Hargous, et al. Molecular basis of RNA recognition and TAP binding by the SR proteins SRp20 and 9G8. EMBO J. Nov. 1, 2006;25(21):5126-37. Epub Oct. 12, 2006.

Harkin, et al. The spectrum of SCN1A-related infantile epileptic encephalopathies. Brain. Mar. 2007;130(Pt 3):843-52.

Hastings, M.L., et al. Control of pre-mRNA splicing by the general splicing factors PUF60 and U2AF. PLoS ONE. 2007;2:e538. PubMed PMID: 17579712.

He, Y.H., et al. Association of the insulin-like growth factor binding protein 3 (IGFBP-3) polymorphism with longevity in Chinese nonagenarians and centenarians. Aging (Milano). 2014;6:944-56.

Hegele, et al. Dynamic protein-protein interaction wiring of the human spliceosome. Mol Cell. Feb. 24, 2012;45(4):567-80. doi: 10.1016/j.molcel.2011.12.034.

Hernan, I. et al. Cellular Expression and siRNA-Mediated Interference of Rhodopsin cis-Acting Splicing Mutants Associated with Autosomal Dominant Retinitis Pigmentosa, Invest Ophthalmol. Vis. Sci. (2011) 52:3723-3729.

Heyn, P. et al. Introns and gene expression: Cellular constraints, transcriptional regulation, and evolutionary consequences. Bioessays vol. 37, pp. 148-154 (2014).

Hiller et al. Pre-mRNA secondary structures influence exon recognition. PLoS genetics 3.11 (2007): e204.

Hirata et al.Prevention of Experimental Autoimmune Encephalomyelitis by Transfer of Embryonic Stem Cell-Derived Dendritic Cells Expressing Myelin Oligodendrocyte Glycoprotein Peptide along with TRAIL or Programmed Death-1 Ligand.J. Immunology vol. 174 pp. 1888-1897 (2005).

Hishida, A. et al. Polymorphisms in PPAR Genes (PPARD, PPARG, and PPARGC1A) and the Risk of Chronic Kidney Disease in Japanese: Cross-Sectional Data from the J-MICC Study. PPAR 2013; 980471 pp. 1-8.

*Homo sapiens* pre-mRNA processing factor 3 (PRPF3), mRNA, NCBI Reference Sequence: NM_004698.2 Accessed Apr. 6, 2017.

Hua et al. Antisense masking of an hnRNP A1/A2 intronic splicing silencer corrects SMN2 splicing in transgenic mice. Am. J. Hum. Genet. 82:834-848 (Mar. 27, 2008).

Hua, et al. Antisense correction of SMN2 splicing in the CNS rescues necrosis in a type III SMA mouse model. Genes Dev. Aug. 1, 2010;24(15):1634-44. doi: 10.1101/gad.1941310. Epub Jul. 12, 2010.

Hua, Y., et al. Enhancement of SMN2 exon 7 inclusion by antisense oligonucleotides targeting the exon. PLoS Biol. 2007;5(4):e73. Epub Mar. 16, 2007.doi: 06-PLBI-RA-1492R3 [pii] 10.1371/journal.pbio.0050073. PubMed PMID: 17355180.

Hunt, et al. Negligible impact of rare autoimmune-locus coding-region variants on missing heritability. Nature. Jun. 13, 2013;498(7453):232-5. doi: 10.1038/nature12170. Epub May 22, 2013.

Huynh, K.D., et al. BCoR, a novel corepressor involved in BCL-6 repression. Genes Dev. 2000;14(14):1810-23. PubMed PMID: 10898795; PubMed Central PMCID: PMC316791.

International Application No. PCT/GB2015/051756 International Preliminary Report on Patentability, dated Dec. 26, 2016.

International Application No. PCT/GB2015/051756 International Search Report and Written Opinion dated Nov. 30, 2015.

International Application No. PCT/GB2016/053136 International Search Report and Written Opinion dated Mar. 6, 2017.

International Application No. PCT/GB2016/053136 Partial International Search Report dated Jan. 19, 2017.

International Application No. PCT/US16/66576 International Search Report and Written Opinion dated May 4, 2017.

International Application No. PCT/US16/66691 International Search Report and Written Opinion dated May 10, 2017.

International Application No. PCT/US16/66708 International Search Report and Written Opinion dated May 8, 2017.

International Application No. PCT/US16/66721 International Search Report and Written Opinion dated May 1, 2017.

International Application No. PCT/US2015/053896 International Preliminary Report on Patentability dated Apr. 4, 2017.

International Application No. PCT/US2015/53896 International Search Report and Written Opinion dated Mar. 3, 2016.

International Application No. PCT/US2016/066414 International Search Report and Written Opinion dated Apr. 19, 2017.

International Application No. PCT/US2016/066417 International Search Report and Written Opinion dated Apr. 19, 2017.

International Application No. PCT/US2016/066564 International Search Report and Written Opinion dated May 4, 2017.

International Application No. PCT/US2016/066705 International Search Report and Written Opinion dated Apr. 24, 2017.

(56) References Cited

OTHER PUBLICATIONS

International Application No. PCT/US2018/048031 International Search Report and Written Opinion dated Jan. 22, 2019.
International search report and written opinion dated Jun. 5, 2017 for PCT Application No. PCT/US2016/066684.
Iwamoto, et al. Transcription-dependent nucleolar cap localization and possible nuclear function of DExH RNA helicase RHAU. Exp Cell Res. Apr. 1, 2008;314(6):1378-91. doi: 10.1016/j.yexcr.2008.01.006. Epub Jan. 16, 2008.
Jacob et al. Intron retention as a component of regulated gene expression programs. Hum Genet 136:1043-1057 (2017).
Jarver, P. et al., A Chemical View of Oligonucleotides for Exon Skipping and Related Drug Applications, Nucleic Acid Therapeutics vol. 24, No. (1), pp. 37-47, (2014).
Jearawiriyapaisarn, et al. Sustained Dystrophin Expression Induced by Peptide-conjugated Morpholino Oligomers in the Muscles of mdx Mice. Mol Ther. Sep. 2008; 16(9): 1624-1629.
Jurkiewicz, D. et al. Spectrum of JAG1 gene mutations in Polish patients with Alagille syndrome J. Appl. Genetics vol. 55, pp. 329-336, (2014).
Kaminker, P.G., et al. A novel form of the telomere-associated protein TIN2 localizes to the nuclear matrix. Cell Cycle. 2009;8(6):931-9. PubMed PMID: 19229133; PubMed Central PMCID: PMC2751576.
Kang et al. Up-regulation of luciferase gene expression with antisense oligonucleotides: implications and applications in functional assay development. Biochemistry 37.18 (1998): 6235-6239.
Katsani, K.R. et al. Functional Genomics Evidence Unearths New Moonlighting Roles of Outer Ring Coat Nucleoporins Scientific Reports vol. 4, No. 4655 (Apr. 11, 2014).
Kawamata, N., et al. Genetic differences between Asian and Caucasian chronic lymphocytic leukemia. Int J Oncol. 2013;43(2):561-5. doi: 10.3892/ijo.2013.1966. PubMed PMID: 23708256; PubMed Central PMCID: PMC3775563.
Ke, et al. Quantitative evaluation of all hexamers as exonic splicing elements. Genome Res. Aug. 2011;21(8):1360-74. doi: 10.1101/gr.119628.110. Epub Jun. 9, 2011.
Keir, M.E. et al. PD-1 and Its Ligands in Tolerance and Immunity. Annu. Rev. Immunol. vol. 26, pp. 677-704 (2008).
Kervestin et al. NMD: a multifaceted response to premature translational termination. Nature reviews Molecular cell biology13.11 (2012): 700.
Kikin, et al. QGRS Mapper: a web-based server for predicting G-quadruplexes in nucleotide sequences. Nucleic Acids Res. Jul. 1, 2006;34(Web Server issue):W676-82.
Kim, E., et al. SRSF2 Mutations Contribute to Myelodysplasia by Mutant-Specific Effects on Exon Recognition. Cancer Cell. 2015;27(5):617-30. doi: 10.1016/j.ccell.2015.04.006. PubMed PMID: 25965569; PubMed Central PMCID: PMC4429920.
Kim et al. The role of synaptic GTPase-activating protein in neuronal development and synaptic plasticity. J. Neurosci. 23(4):1119-1124 (Feb. 15, 2003).
Kim, J. et al. The splicing factor U2AF65 stabilizes TRF1 protein by inhibiting its ubiquitin-dependent proteolysis. Biochem Biophys Res Commun. 2014;443(3):1124-30. doi: 10.1016/j.bbrc.2013.12.118. PubMed PMID: 24389012.
Kim P., et al. ChimerDB 2.0—a knowledgebase for fusion genes updated. Nucleic Acids Res. 2009;38(Database issue):D81-5. Epub Nov. 13, 2009.doi: gkp982 [pii] 10.1093/nar/gkp982. PubMed PMID: 19906715.
Kole, et al. RNA therapeutics: beyond RNA interference and antisense oligonucleotides. Nat Rev Drug Discov. Jan. 20, 2012;11(2):125-40. doi: 10.1038/nrd3625.
Kralovicova, et al. Allele-specific recognition of the 3' splice site of INS intron 1. Hum Genet. Oct. 2010;128(4):383-400. doi: 10.1007/s00439-010-0860-1. Epub Jul. 14, 2010.
Kralovicova, et al. Compensatory signals associated with the activation of human GC 5' splice sites. Nucleic Acids Res. Sep. 1, 2011;39(16):7077-91. doi: 10.1093/nar/gkr306. Epub May 23, 2011.
Kralovicova et al. Exon-centric regulation of ATM expression is population-dependent and amenable to antisense modification by pseudoexon targeting, Scientific Reports, 6:18741, doi:10.1038/srep18741, Jan. 6, 2016, 13 pages.
Kralovicova, et al. Global control of aberrant splice-site activation by auxiliary splicing sequences: evidence for a gradient in exon and intron definition. Nucleic Acids Res. Oct. 2007; 35(19): 6399-6413.
Kralovicova, et al. Identification of U2AF(35)-dependent exons by RNA-Seq reveals a link between 3' splice-site organization and activity of U2AF-related proteins. Nucleic Acids Res. Apr. 20, 2015;43(7):3747-63. doi: 10.1093/nar/gkv194. Epub Mar. 16, 2015.
Kralovicova, et al. Optimal antisense target reducing INS intron 1 retention is adjacent to a parallel G quadruplex. Nucleic Acids Res. Jul. 2014;42(12):8161-73. doi: 10.1093/nar/gku507. Epub Jun. 17, 2014.
Kralovicova, et al. Phenotypic consequences of branch point substitutions. Hum Mutat. Aug. 2006;27(8):803-13.
Kralovicova, et al. Position-dependent repression and promotion of DQB1 intron 3 splicing by GGGG motifs. J Immunol. Feb. 15, 2006;176(4):2381-8.
Kralovicova, et al. Variants in the human insulin gene that affect pre-mRNA splicing: is—23Hphl a functional single nucleotide polymorphism at IDDM2? Diabetes. Jan. 2006;55(1):260-4.
Kralovicova, et al. Antisense Oligonucleotides Modulating Activation of a Nonsense-Mediated RNA Decay Switch Exon in the ATM Gene.Nucleic Acid Ther. Dec. 1, 2016; 26(6): 392-400.
Kralovicova, J. et al. Branch sites haplotypes that control alternative splicing. Hum Mol Genet. 2004;13:3189-202.
Kralovicova, J. et al. The role of short RNA loops in recognition of a single-hairpin exon derived from a mammalian-wide interspersed repeat. RNA Biol. 2015;12(1):54-69. doi: 10.1080/15476286.2015.1017207. PubMed PMID: 25826413.
LaPlanche et al. Phosphorothioate-modified oligodeoxyribonucleotides. III. NMR and UV spectroscoptc studies of thRp-Rp,Sp-Sp, anRp-Sduplexes, [d(GGsAATTCC)]2, derived from diastereomeriO-ethyl phosphorothioates Nucleic Acids Res. vol. 14, No. 22, pp. 9081-9093 (Nov. 25, 1986).
Le Hir, et al. How introns influence and enhance eukaryotic gene expression. Trends Biochem Sci. Apr. 2003;28(4):215-20.
Lee, E.S. et al. The Consensus 5' Splice Site Motif Inhibits mRNA Nuclear Export.PLoS One vol. 10, No. 3, p. e0122743 (Mar. 31, 2015).
Lee, J., et al. Metastasis of neuroendocrine tumors are characterized by increased cell proliferation and reduced expression of the ATM gene. PLoS One. 2012;7:e34456.
LeHir, H. et al. 5'-End RET Splicing: Absence of Variants in Normal Tissues and Intron Retention in Pheochromocytomas, Oncology 63:84-91 (2002).
Lei et al. Exonization of Alu Ya5 in the human ACE gene requires mutations in both 3' and 5' splice sites and is facilitated by a conserved splicing enhancer. Nucleic acids research 33.12 (2005): 3897-3906.
Lei, et al. Identification of splicing silencers and enhancers in sense Alus: a role for pseudoacceptors in splice site repression. Mol Cell Biol. Aug. 2005;25(16):6912-20.
Lemaire, M., et al. CDC25B phosphorylation by p38 and MK-2. Cell Cycle. 2006;5(15):164953. PubMed PMID: 16861915.
Lev-Maor et al. Intronic Alus influence alternative splicing. PLoS genetics 4.9 (2008): e1000204.
Lev-Maor et al. The birth of an alternatively spliced exon: 3'splice-site selection in Alu exons. Science 300.5623 (2003): 1288-1291.
Levy et al.TranspoGene and microTranspoGene: transposed elements influence on the transcriptome of seven vertebrates and invertebrates. Nucleic acids research 36.suppl_1 (2007): D47-D52.
Li et al. PD-L1—Driven Tolerance Protects Neurogenin3-Induced Islet Neogenesis to Reverse Established Type 1 Diabetes in NOD Mice.Diabetes vol. 64, pp. 529-540 (Feb. 2015; epub Oct. 20, 2014).
Liang et al. Short intronic repeat sequences facilitate circular RNA production. Genes & development (2014): gad-251926.
Liang, Xue-Hai et al., T ranslation efficiency of mRNAs is increased by antisense oligonucleotides targeting upstream open reading frames,Nature Biotechnology, 34(8):875-882 (Aug. 2016).
Lianoglou, S., et al. Ubiquitously transcribed genes use alternative polyadenylation to achieve tissue-specific expression. Genes Dev.

(56) References Cited

OTHER PUBLICATIONS

2013;27(21):2380-96. Epub Oct. 23, 2013.doi: gad.229328.113 [pii] 10.1101/gad.229328.113. PubMed PMID: 24145798.

Lim et al. A computational analysis of sequence features involved in recognition of short introns. Proceedings of the National Academy of Sciences98.20 (2001): 11193-11198.

Litchfield, D.W., et al. Pin1: Intimate involvement with the regulatory protein kinase networks in the global phosphorylation landscape. Biochem Biophys Acta. 2015. doi: 10.1016/j.bbagen.2015. 02.018. PubMed PMID: 25766872.

Llorian et al. Position-dependent alternative splicing activity revealed by global profiling of alternative splicing events regulated by PTB. Nature structural & molecular biology 17.9 (2010): 1114.

Lo, Yl et al. ATM Polymorphisms and risk of lung cancer among never smokers, Lung Cancer 69(2):148-154 (2010).

Lorenz, et al. 2D meets 4G: G-Quadruplexes in RNA Secondary Structure Prediction. IEEE/ACM Trans Comput Biol Bioinform. Jul.-Aug. 2013;10(4):832-44. doi: 10.1109/TCBB.2013.7.

Lu, F. Conditional JAG1 MutationShows the Developing Heart Is More Sensitive Than Developing Liver to JAG1 Dosage.Am. J. Hum. Genet. vol. 72, pp. 1065-1070 (2003).

Ludecke et al.Recessively inherited L-DOPA-responsive parkinsonism in infancy caused by a point mutation (L205P) in the tyrosine hydroxylase gene Hum. Mol. Genet. vol. 5, pp. 1023-1028, (1996).

Luo et al. Palmitic Acid Suppresses Apolipoprotein M Gene Expression via the Pathway of PPARb/d in HepG2 Cells. Biochemical and Biophysical Research Communications, 445(1):203-207 (Feb. 2014).

Magi-Galuzzi, C. et al. TMPRSS2-ERG gene fusion prevalence and class are significantly difference in prostate cancer of Caucasian, African-American and Japanese patients. The Prostate. 2011;71:489-97.

Makishima, et al. Mutations in the spliceosome machinery, a novel and ubiquitous pathway in leukemogenesis. Blood. Apr. 5, 2012;119(14):3203-10. doi: 10.1182/blood-2011-12-399774. Epub Feb. 9, 2012.

Maniatis et al. An extensive network of coupling among gene expression machines. Nature 416.6880 (2002): 499.

Mansouri, S. et al. Epstein-Barr Virus EBNA1 Protein Regulates Viral Latency through Effects on let-7 MicroRNA and Dicer.Journal of Virology, vol. 88, No. 19, pp. 11166-11177, (Oct. 2014).

Marcel, et al. G-quadruplex structures in TP53 intron 3: role in alternative splicing and in production of p53 mRNA isoforms. Carcinogenesis. Mar. 2011;32(3):271-8. doi: 10.1093/carcin/bgq253. Epub Nov. 26, 2010.

Marquez, Y. et al. Unmasking alternative splicing inside protein-coding exons defines exitrons and their role inproteome plasticity. Genome vol. 25, pp. 995-1007 (2015).

Matsuoka, S., et al. Ataxia telangiectasia-mutated phosphorylates Chk2 in vivo and in vitro. Proc Natl Acad Sci USA. 2000;97:10389-94.

Matsuoka, S., et al. ATM and ATR substrate analysis reveals extensive protein networks responsive to DNA damage. Science. 2007;316(5828):1160-6. Epub May 26, 2007.doi: 10.1126/science.1140321. PubMed PMID: 17525332.

Mayeda, et al. Surveying cis-acting sequences of pre-mRNA by adding antisense 2'-O-methyl oligoribonucleotides to a splicing reaction. J Biochem. Sep. 1990;108(3):399-405.

Melhuish, et al. The Tgif2 gene contains a retained intron within the coding sequence, BMC Molecular Biology 7(2);1-10 (2006).

Melko, et al. Functional characterization of the AFF (AF4/FMR2) family of RNA-binding proteins: insights into the molecular pathology of FRAXE intellectual disability. Hum Mol Genet. May 15, 2011;20(10):1873-85. doi: 10.1093/hmg/ddr069. Epub Feb. 17, 2011.

Mendell, J.T., Ap Rhys CM, Dietz HC. Separable roles for rent1/hUpf1 in altered splicing and decay of nonsense transcripts. Science. 2002;298(5592):419-22. Epub Sep. 14, 2002.doi: 10.1126/science.1074428 1074428 [pii]. PubMed PMID: 12228722.

Merendino, L., et al. Inhibition of msl-2 splicing by Sex-lethal reveals interaction between U2AF35 and the 3' splice site AG. Nature. 1999;402(6763):838-41. PubMed PMID: 10617208.

Michael, et al. Mfold web server for nucleic acid folding and hybridization prediction. Nucleic Acids Research. 31 (2003): 3406-3415.

Miller at al. 1993-2015 GeneReviews Eds. Pagon RA et al. Seattle (WA); University of WA, Seattle Bookshelf ID NBK1318.

Millevoi, et al. G-quadruplexes in RNA biology. Wiley Interdiscip Rev RNA. Jul.-Aug. 2012;3(4):495-507. doi: 10.1002/wrna.1113. Epub Apr. 4, 2012.

Mirey, G., et al. CDC25B phosphorylated by pEg3 localizes to the centrosome and the spindle poles at mitosis. Cell Cycle. 2005;4(6):806-11. PubMed PMID: 15908796.

Mitelman, F., et al. The impact of translocations and gene fusions on cancer causation. Nat Rev Cancer. 2007;7(4):233-45. Epub Mar. 16, 2007

Mochizuki, T. et al. PKD2, a gene for polycystic kidney disease that encodes an integral membrane protein.Science vol. 272, pp. 1339-1342 (1996).

Montecucco, A., et al. Pre-mRNA processing factors meet the DNA damage response. Front Genet. 2013;4:102. doi: 10.3389/fgene. 2013.00102. PubMed PMID: 23761808; PubMed Central PMCID: PMC3674313.

Morris, et al. An RNA G-quadruplex is essential for cap-independent translation initiation in human VEGF IRES. J Am Chem Soc. Dec. 22, 2010;132(50):17831-9. doi: 10.1021/ja106287x. Epub Nov. 24, 2010.

Morrison, a.J., et al. Mec1/Tel1 phosphorylation of the INO80 chromatin remodeling complex influences DNA damage checkpoint responses. Cell. 2007;130(3):499-511. doi: 10.1016/j.cell.2007.06. 010. PubMed PMID: 17693258.

Moskowitz, et al., Mutation in Scheie syndrome (MPS IS): A G-->A transition creates new splice site in intron 5 of one IDUA allele, Hum. Mutat. 2(2):141-144 (1993).

Mulley et al. A new molecular mechanism for severe myoclonic epilepsy of infancy: Exonic deletions in SCN1A.Neurol. vol. 67, pp. 1094-1095 (2006).

Mulley et al. SCN1A mutations and epilepsy.Hum. Muta. vol. 25, pp. 535-542 (2005).

Murray, S.F. et al. Allele-Specific Inhibition of Rhodopsin with an Antisense Oligonucleotide Slows Photoreceptor Cell Degeneration, Invest Ophthalmol. Vis. Sci. 56:6362-6375 (Oct. 2015).

Neidle, S. and Balasubramanian, S. (2006) Quadruplex Nucleic Acids. RSC Biomolecular Sciences, Cambridge, UK.

Nemeroff et al. Identification of cis-acting intron and exon regions in influenza virus NS1 mRNA that inhibit splicing and cause the formation of aberrantly sedimenting presplicing complexes. Molecular and cellular biology 12.3 (1992): 962-970.

Nguyen, L.A., et al. Physical and functional link of the leukemia-associated factors AML1 and PML. Blood. 2005;105(1):292-300. doi: 10.1182/blood-2004-Mar. 1185. PubMed PMID: 15331439.

Nishi, M. et al. Insulin gene mutations and diabetes. Journal of Diabetes Investigation vol. 2 Issue 2 (Apr. 2011).

Nishida, A. et al. Tissue- and Case-specific retention of intron 40 in mature dystrophin mRNA, Journal of Human Genetic 60;327-333 (2015).

Nisole, S., et al. Differential Roles of PML Isoforms. Front Oncol. 2013;3:125. doi: 10.3389/fonc.2013.00125. PubMed PMID: 23734343; PubMed Central PMCID: PMC3660695.

Nomakuchi et al. Antisense-oligonucleotide-directed inhibition of nonsense-mediated mRNA decay. Nat. Biotechnol. 34(2):164-166 (Feb. 2016).

Nozu et al. Alport syndrome caused by a COL4A5 deletion and exonization of an adjacent AluY. Molecular genetics & genomic medicine 2.5 (2014): 451-453.

Nussinov. Conserved quartets near 5' intron junctions in primate nuclear pre-mRNA. J Theor Biol. Jul. 8, 1988;133(1):73-84.

Oda, T. et al. Identification and cloning of the human homolog (JAG) of the rat Jagged1 gene from the Alagille syndrome critical region at 20p12.Genomics vol. 43, No. 3, pp. 376-379 (1997).

(56) References Cited

OTHER PUBLICATIONS

Okazaki, T. et al. PD-1 and PD-1 ligands: from discovery to clinical application. International Immunology(the Japanese Society for Immunology), vol. 19, No. 7, pp. 813-824, (2007).
Oustric, V. et al. Antisense oligonucleotide-based therapy in human erythropoietic protoporphyria. Am J Hum Genet. 2014;94(4):611-7. doi: 10.1016/j.ajhg.2014.02.010. PubMed PMID: 24680888; PubMed Central PMCID: PMC3980518.
Pacheco, et al. Diversity of vertebrate splicing factor U2AF35: identification of alternatively spliced U2AF1 mRNAS. J Biol Chem. Jun. 25, 2004;279(26):27039-49. Epub Apr. 19, 2004.
Pacheco, et al. RNA interference knockdown of hU2AF35 impairs cell cycle progression and modulates alternative splicing of Cdc25 transcripts. Mol Biol Cell. Oct. 2006;17(10):4187-99. Epub Jul. 19, 2006.
Page-McCAW, P.S., et al. PUF60: a novel U2AF65-related splicing activity. RNA. 1999;5(12):1548-60. PubMed PMID: 10606266.
Pandit et al. Genome-wide analysis reveals SR protein cooperation and competition in regulated splicing. Molecular cell 50.2 (2013): 223-235.
Papaemmanuil, et al. Clinical and biological implications of driver mutations in myelodysplastic syndromes. Blood. Nov. 21, 2013;122(22):3616-27; quiz 3699. doi: 10.1182/blood-2013-08-518886. Epub Sep. 12, 2013.
Passamonti, C. et al. A novel inherited SCN1A mutation associated with different neuropsychological phenotypes: Is there a common core deficit? Epilepsy & Behavior 43:89-92 (2015).
Pastor, et al. Interaction of hnRNPA1/A2 and DAZAP1 with an Alu-derived intronic splicing enhancer regulates ATM aberrant splicing. PLoS One. 2011;6(8):e23349. doi: 10.1371/journal.pone.0023349. Epub Aug. 8, 2011.
Pastor, F., et al. Induction of tumour immunity by targeted inhibition of nonsense-mediated mRNA decay. Nature. 2010;465(7295):227-30. doi: 10.1038/nature08999. PubMed PMID: 20463739; PubMed Central PMCID: PMC3107067.
Paz, A., et al. SPIKE: a database of highly curated human signaling pathways. Nucleic Acids Res. 2011;39(Database issue):D793-9. doi: 10.1093/nar/gkq1167. PubMed PMID: 21097778; PubMed Central PMCID: PMC3014840.
Pear, Warren S. New roles for Notch in tuberous sclerosis, Journal of Clinical Investigation, 120(1):84-87 (Jan. 4, 2010).
Pecarelli et al. Regulation of natural mRNAs by the nonsense-mediated mRNA decay pathway. Eukaryotic cell(2014): EC-00090.
Pellagatti, A., et al. Deregulated gene expression pathways in myelodysplastic syndrome hematopoietic stem cells. Leukemia. 2010;24(4):756-64. doi: 10.1038/leu.2010.31. PubMed PMID: 20220779.
Peng, et al. Functional importance of different patterns of correlation between adjacent cassette exons in human and mouse. BMC Genomics. Apr. 26, 2008;9:191. doi: 10.1186/1471-2164-9-191.
Penton, A.L.Notch signaling in humandevelopment and disease. Seminars in Cell & Developmental Biology. vol. 23, pp. 450-457 (2012).
Perdiguero, E., et al. Regulation of Cdc25C activity during the meiotic G2/M transition. Cell Cycle. 2004;3(6):733-7. PubMed PMID: 15136768.
Piaceri, I., et al. Ataxia-telangiectasia mutated (ATM) genetic variant in Italian centenarians. Neurophysiology. 2013;34:573-5.
Pomentel et al. A dynamic intron retention program enriched in RNA processing genes regulates gene expression during terminal erythropoiesis. Nucleic acids research 44.2 (2015): 838-851.
Precursor mRNA-Processing Factor 3, S. Cerevisiae, Homolog of; PRPF3m, 3 pages.
Przychodzen, B., et al. Patterns of missplicing due to somatic U2AF1 mutations in myeloid neoplasms. Blood. 2013;122:999-1006. Epub Jun. 19, 2013.doi: blood-2013-01-480970 [pii] 10.1182/blood-2013-01-480970. PubMed PMID: 23775717.
Pugliese, et al. The insulin gene is transcribed in the human thymus and transcription levels correlated with allelic variation at the INS VNTR-IDDM2 susceptibility locus for type 1 diabetes. Nat Genet. Mar. 1997;15(3):293-7.
Ray, D. et al. A compendium of RNA-binding motifs for decoding gene regulation. Nature. vol. 499, No. 7457, pp. 172-177 (Jul. 11, 2013).
Reineke, E.L., et al. Degradation of the tumor suppressor PML by Pin1 contributes to the cancer phenotype of breast cancer MDA-MB-231 cells. Mol Cell Biol. 2008;28(3):997-1006. doi: 10.1128/MCB.01848-07. PubMed PMID: 18039859; PubMed Central PMCID: PMC2223389.
Rendu, J. et al. Hum Gene Ther. Exon skipping as a therapeutic strategy applied to an RYR1 mutation with pseudo-exon inclusion causing a severe core myopathy. Jul. 2013;24(7):702-13. doi: 10.1089/hum.2013.052.
Reynolds, DM et al.Aberrant Splicing in the PKD2 Gene as a Cause of Polycystic Kidney Disease.Am. Soc. Nephrol. vol. 10, pp. 2342-2351 (1999).
Ritprajak et al. Keratinocyte-Associated B7-H1 Directly Regulates Cutaneous Effector CD8+ T Cell Responses.J Immunology vol. 184, pp. 4918-4925 (2010).
RNA 2-14 The Nineteenth Annual Meeting of the RNA Society. Quebec City, Canada. (Jun. 3-8, 2014).
Roberts, Jennifer et al. Efficient and Persistent Splice Switching by Systemically Delivered LNA Oligonucleotides in Mice. Molecular Therapy, Nature Publishing, vol. 14, No. 4, pp. 471-475, Oct. 1, 2006.
Romero, P.R., et al. Alternative splicing in concert with protein intrinsic disorder enables increased functional diversity in multicellular organisms. Proc Natl Acad Sci USA. 2006;103(22):8390-5. Epub May 24, 2006.doi: 0507916103 [pii] 10.1073/pnas.0507916103. PubMed PMID: 16717195.
Rosenbloom et al. The UCSC Genome Browser database: 2015 Update. Nucleic Acids Research 43, Database Issue doi:101093/nar/gku1177.
Ruchlemer, R., et al. Geography, ethnicity and "roots" in chronic lymphocytic leukemia. Leuk Lymphoma. 2013;54(6):1142-50. doi: 10.3109/10428194.2012.740670. PubMed PMID: 23121522.
Rudd, M.F., et al. Variants in the ATM-BRCA2-CHEK2 axis predispose to chronic lymphocytic leukemia. Blood. 2006;108(2):638-44. Epub Apr. 1, 2006.doi: 2005-12-5022 [pii] 10.1182/blood-2005-12-5022. PubMed PMID: 16574953.
Ruskin, et al. A factor, U2AF, is required for U2 snRNP binding and splicing complex assembly. Cell. Jan. 29, 1988;52(2):207-19.
Sadleir, et al. Not all SCN1A epileptic encephalopathies are Dravet syndrome. Neurology. Sep. 5, 2017; 89(10): 1-8.
Sahashi et al. Pathological impact of SMN2 mis-splicing in adult SMA mice. EMBO Mol. Med. 5(10):1586-601 (Oct. 2013).
Sahashi et al. TSUNAMI: an antisense method to phenocopy splicing-associated diseases in animals. Genes Dev. 26(16):1874-1884 (Aug. 15, 2012).
Sakabe, et al. Sequence features responsible for intron retention in human. BMC Genomics. Feb. 26, 2007;8:59.
Samatanga, et al. The high kinetic stability of a G-quadruplex limits hnRNP F qRRM3 binding to G-tract RNA. Nucleic Acids Res. Feb. 1, 2013;41(4):2505-16. doi: 10.1093/nar/gks1289. Epub Dec. 28, 2012.
Schwarze, et al. Redefinition of exon 7 in the COL1A1 gene of type I collagen by an intron 8 splice-donor-site mutation in a form of osteogenesis imperfecta: influence of intron splice order on outcome of splice-site mutation. Am J Hum Genet. Aug. 1999;65(2):336-44.
Scott, S.P., et al. Missense mutations but not allelic variants alter the function of ATM by dominant interference in patients with breast cancer. Proc Natl Acad Sci USA. 2002;99:925-30.
SG 11201702682P Search Report and Written Opinion dated Apr. 9, 2018.
Shao, C., et al. Mechanisms for U2AF to define 3' splice sites and regulate alternative splicing in the human genome. Nat Struct Mol Biol. 2014;doi: 10.1038/nsmb.2906.
Shcherbakova, I., et al. Alternative spliceosome assembly pathways revealed by single-molecule fluorescence microscopy. Cell Rep.

(56) References Cited

OTHER PUBLICATIONS

2013;5(1):151-65. Epub Oct. 1, 2013.doi: S2211-1247(13)00467-1 [pii] 10.1016/j.celrep.2013.08.026. PubMed PMID: 24075986.
Shen, M., et al. Characterization and cell cycle regulation of the related human telomeric proteins Pin2 and TRF1 suggest a role in mitosis. Proc Natl Acad Sci USA. 1997;94(25):13618-23. PubMed PMID: 9391075; PubMed Central PMCID: PMC28355.
Shiloh, Y., et al The ATM protein kinase: regulating the cellular response to genotoxic stress, and more. Nat Rev Mol Cell Biol. 2013;14(4):197-210. doi: 10.1038/nrm3546. PubMed PMID: 23486281.
Shirai, C.L. et al. Mutant U2AF1 Expression Alters Hematopoiesis and Pre-mRNA Splicing In Vivo. Cancer Cell. 2015;27(5):631-43. doi: 10.1016/j.ccell.2015.04.008. PubMed PMID: 25965570; PubMed Central PMCID: PMC4430854.
Shirley, M.H., et al Incidence of haematological malignancies by ethnic group in England, 2001-7. Br J Haematol. 2013;163(4):465-77. doi: 10.1111/bjh.12562. PubMed PMID: 24033296.
Sierakowska, H et al. Repair of thalassemic human beta-globin mRNA in mammalian cells by antisense oligonucleotides. Proc Natl Acad Sci U S A. Nov. 12, 1996;93(23):12840-4.
Singh, et al. An antisense microwalk reveals critical role of an intronic position linked to a unique long-distance interaction in pre-mRNA splicing. RNA. Jun. 2010;16(6):1167-81. doi: 10.1261/rna.2154310. Epub Apr. 22, 2010.
Sirand-Pugnet, et al. An intronic (A/U)GGG repeat enhances the splicing of an alternative intron of the chicken beta-tropomyosin pre-mRNA. Nucleic Acids Res. Sep. 11, 1995;23(17):3501-7.
Skjevik et al. The N-Terminal Sequence of Tyrosine Hydroxylase Is a Conformationally Versatile Motif That Binds 14-3-3 Proteins and Membranes.J. Mol. Bio. vol. 426, pp. 150-168 (2014).
Smith, C.W., et al. Scanning and competition between AGs are involved in 3' splice site selection in mammalian introns. Mol Cell Biol. 1993;13(8):4939-52. PubMed PMID: 8336728.
Smith, et al. Alternative pre-mRNA splicing: the logic of combinatorial control. Trends Biochem Sci. Aug. 2000;25(8):381-8.
Smith, P.J., et al. An increased specificity score matrix for the prediction of SF2/ASF-specific exonic splicing enhancers. Hum Mol Genet. 2006;15(16):2490-508. PubMed PMID: 16825284.
Soo, R.A., et al. Ethnic differences in survival outcome in patients with advanced stage non-small cell lung cancer. J Thorac Oncol. 2011;6:1030-8.
Sorek et al. Minimal conditions for exonization of intronic sequences: 5' splice site formation in alu exons. Molecular cell 14.2 (2004): 221-231.
Soutar et al. Mechanisms of disease: genetic causes of familial hpercholesterolemia. Nat. Clin. Pract. Cardiovasc. Med. 4:214-255 (Apr. 1, 2007).
Spellman et al. Regulation of alternative splicing by PTB and associated factors. (2005): 457-460.
Stamm, S. Regulation of alternative splicing by reversible protein phosphorylation. J Biol Chem. 2008;283(3):1223-7. PubMed PMID: 18024427.
Stankovic, T., et al. Inactivation of ataxia telangiectasia mutated gene in B-cell chronic lymphocytic leukaemia. Lancet. 1999;353(9146):26-9. doi: 10.1016/S0140-6736(98)10117-4. PubMed PMID: 10023947.
Staropoli et al. Rescue of gene-expression changes in an induced mouse model of spinal muscular atrophy by an antisense oligonucleotide that promotes inclusion of SMN2 exon 7. Genomics 105:220-228 (2015).
Stead, et al. Global haplotype diversity in the human insulin gene region. Genome Res. Sep. 2003;13(9):2101-11.
Stec et al. Automated solid-phase synthesis, separation, and stereochemistry of phosphorothioate analogs of oligodeoxyribonucleotides J. Am. Chem. Soc., 1984, 106 (20), pp. 6077-6079 (1984).
Stein et al. Physicochemical properties of phosphorothioate oligodeoxynucleotides. Nucleic Acids Res. Apr. 25, 1988;16(8):3209-21.
Story, M.D. et al. ATM has a major role in the double-stand break repair pathway dysregulation in sporadic breast carcinomas and is an independent prognostic marker at both mRNA and protein levels, Breast Diseases: A Yearbook Quarterly, 26(4);297-299 (Mar. 17, 2015).
Strausfeld, U., et al. Activation of p34cdc2 protein kinase by microinjection of human cdc25C into mammalian cells. Requirement for prior phosphorylation of cdc25C by p34cdc2 on sites phosphorylated at mitosis. J Biol Chem. 1994;269(8):5989-6000. PubMed PMID: 8119945.
Suarez, F. et al. Incidence, presentation, and prognosis of malignancies in ataxia-telangiectasia: a report from the French national registry of primary immune deficiencies. J Clin Oncol. 2015;33(2):202-8. doi: 10.1200/JCO.2014.56.5101. PubMed PMID: 25488969.
Summerton, James. Morpholino Antisense Oligos: Applications in Biopharmaceutical ResearchMorpholinos constitute a radical redesign of DNA, providing decisive advantages over the moreconventional oligo types used for modulating gene expression. Innovations in Pharmaceutical Technology Issue No. 17 (2005).
Sun, H., et al. Multiple splicing defects in an intronic false exon. Mol Cell Biol. 2000;20(17):6414-25. PubMed PMID: 10938119.
Svasti, et al. RNA repair restores hemoglobin expression in IVS2-654 thalassemic mice. Proc Natl Acad Sci U S A. Jan. 27, 2009; 106(4): 1205-1210.
Swaans, RJM et al.Four novel mutations in the Tyrosine Hydroxylase gene in patients with infantile parkinsonism Annals of Human Genetic, vol. 64, No. 1, pp. 25-31, (Jan. 2000).
Tabrez, S. et al. A Synopsis of the Role of Tyrosine Hydroxylase in Parkinson's Disease.CNS & Neurological Disorders—Drug Targets vol. 11, No. 4 (2012).
Tavanez, J.P., et al. hnRNP A1 proofreads 3' splice site recognition by U2AF. Mol Cell. 2012;45(3):314-29. Epub Feb. 14, 2012. doi: S1097-2765(12)00032-9 [pii] 10.1016/j.molcel.2011.11.033. PubMed PMID: 22325350.
Taylor, A.M., et al. Ataxia telangiectasia: more variation at clinical and cellular levels. Clin Genet. 2015;87(3):199-208. doi: 10.1111/cge.12453. PubMed PMID: 25040471.
Taylor, A.M., et al. Leukemia and lymphoma in ataxia telangiectasia. Blood. 1996;87(2):423-38. PubMed PMID: 8555463.
Thisted, et al. Optimized RNA targets of two closely related triple KH domain proteins, heterogeneous nuclear ribonucleoprotein K and alphaCP-2KL, suggest Distinct modes of RNA recognition. J Biot Chem. May 18, 2001;276(20):17484-96. Epub Feb. 2, 2001.
Tilgner et al. Deep Sequencing of subcellular RNA factions shows splicing to be predominantly co-transcriptional in the human genome but inefficient for lncRNAs.Genome Research vol. 22, No. 9, pp. 1616-1625 (2012).
Torres, V.E. et al. Autosomal dominant polycystic kidney disease: the last 3 years.Kidney International vol. 76, pp. 149-168 (May 20, 2009).
Trabattoni, M. et al.Costimulatory Pathways in Multiple Disease Sclerosis: Distinctive Expression of PD-1 and PD-L1 in Patients with Different Patterns of Disease.J. Immunol. vol. 183, pp. 4984-4993 (2009).
Trapnell, C. et al. Differential gene and transcript expression analysis of RNA-seq experiments with Top Hat and Cufflinks. Nat Protoc. 2012;7(3):562-78. Epub Mar. 3, 2012.doi: nprot.2012.016 [pii] 10.1038/nprot.2012.016. PubMed PMID: 22383036.
Turnpenny, P.D. et al. Alagille syndrome: pathogenesis, diagnosis and management.European Journal of Human Genetics vol. 20, pp. 251-257 (2012.
Uhlmann, E. et al. Antisense oligonucleotides: a new therapeutic principle. Chemical Reviews vol. 90, No. 4, pp. 543-584 (Jun. 1990).
U.S. Appl. No. 14/741,071 Non-Final Office Action dated Dec. 1, 2016.
U.S. Appl. No. 14/874,420 Non-Final Office Action dated Mar. 21, 2017.
U.S. Appl. No. 14/874,420 Office Action dated Oct. 24, 2017.
U.S. Appl. No. 15/619,984 Office Action dated Dec. 17, 2018.
U.S. Appl. No. 15/949,902 Office Action dated Mar. 1, 2019.
U.S. Appl. No. 15/288,415 Office Action dated Jun. 26, 2018.

(56) References Cited

OTHER PUBLICATIONS

Vafiadis, et al. Insulin expression in human thymus is modulated by INS VNTR alleles at the IDDM2 locus. Nat Genet. Mar. 1997;15(3):289-92.
Verhaart, I.E.C. AON-Mediated Exon Skipping for Duchenne Muscular Dystrophy. Chapter 3. pp. 1-26 (Aug. 1, 2012).
Verret et al., Inhibitory Interneuron Deficit Links Altered Network Activity and Cognitive Dysfunction in Alzheimer Model, Cell, 149(3): 708-721 (2012).
Vieira, N. et al. Jagged 1Rescues the Duchenne Muscular Dystrophy Phenotype. Cell vol. 163, pp. 1204-1213 (Nov. 19, 2015).
Voelker, et al. A comprehensive computational characterization of conserved mammalian intronic sequences reveals conserved motifs associated with constitutive and alternative splicing. Genome Res. Jul. 2007;17(7):1023-33. Epub May 24, 2007.
Vorechovsky Correspondence Pediatric Research 2010.
Vorechovsky, I. Letter to the Editor: MER91 B-assisted cryptic exon activation in Gitelman syndrome. Pediatric research 67.4 (2010): 444-445.
Vorechovsky Transposable elements in disease-associated cryptic exons. Human genetics 127.2 (2010): 135-154.
Wahl, et al. The spliceosome: design principles of a dynamic RNP machine. Cell. Feb. 20, 2009;136(4):701-18. doi: 10.1016/j.cell. 2009.02.009.
Wan et al.Synthesis, biophysical properties and biological activity of second generation antisense oligonucleotides containing chiral phosphorothioate linkages.Nucleic Acids Research, vol. 42, No. 22, pp. 13456-13468 (2014).
Wang, et al. A complex network of factors with overlapping affinities represses splicing through intronic elements. Nat Struct Mol Biol. Jan. 2013;20(1):36-45. doi: 10.1038/nsmb.2459. Epub Dec. 16, 2012.
Wang et al. Alternative isoform regulation in human tissue transcriptomes. Nature. 2008;456(November):470-476.
Wang et al. Human Adenovirus Type 36 Enhances Glucose Uptake in Diabetic and Nondiabetic Human Skeletal Muscle Cells Independent of Insulin Signaling.Diabetes vol. 57, pp. 1861-1869 (2008).
Wang, et al. Intronic splicing enhancers, cognate splicing factors and context-dependent regulation rules. Nat Struct Mol Biol. Oct. 2012;19(10):1044-52. doi: 10.1038/nsmb.2377. Epub Sep. 16, 2012.
Wang, et al. Regulation of insulin preRNA splicing by glucose. Proc Natl Acad Sci U S A. Apr. 29, 1997;94(9):4360-5.
Wang, Z. et al. Systematic identification and analysis of exonic splicing silencers. Cell. 2004;119(6):831-45. PubMed PMID: 15607979.
Warf, M.B., et al. Role of RNA structure in regulating pre-mRNA splicing. Trends Biochem Sci. 2010;35(3):169-78. Epub Dec. 5, 2009.doi: S0968-0004(09)00196-0 [pii].
Wieland, et al. RNA quadruplex-based modulation of gene expression. Chem Biol. Jul. 2007;14(7):757-63.
Wong et al. Orchestrated intron retention regulates normal granulocyte differentiation. Cell 154.3 (2013): 583-595.
Wu et al. AT-AC Pre-mRNA Splicing Mechanisms and Conservation of Minor Introns in Voltage-Gated Ion Channel Genes. Molecular and Cellular Biology 19(5): 3225-3236 (May 1999).
Wu, J.Y., et al. Specific interactions between proteins implicated in splice site selection and regulated alternative splicing. Cell. 1993;75(6):1061-70. Epub Dec. 17, 1993.doi: 0092-8674(93)90316-I [pii]. PubMed PMID: 8261509.
Wu, S. et al. Functional recognition of the 3' splice site AG by the splicing factor U2AF35.Nature. 1999;402(6763):832-5. PubMed PMID: 10617206.
Wu, Y. et al. MRE11-RAD5O-NBS1 and ATM function as co-mediators of TRF1 in telomere length control. Nat Struct Mol Biol. 2007;14(9):832-40. doi: 10.1038/nsmb1286. PubMed PMID: 17694070.
Xia, Y. et al. Frequencies of SF3B1, NOTCH1, MYD88, BIRC3 and IGHV mutations and TP53 disruptions in Chinese with chronic lymphocytic leukemia: disparities with Europeans. Oncotarget. 2015;6(7):5426-34. PubMed PMID: 25605254.

Xing, et al. The multiassembly problem: reconstructing multiple transcript isoforms from EST fragment mixtures. Genome Res. Mar. 2004;14(3):426-41. Epub Feb. 12, 2004.
Yamamoto, Y., et al. BCOR as a novel fusion partner of retinoic acid receptor alpha in a t(X;17)(p11;q12) variant of acute promyelocytic leukemia. Blood. 2010;116(20):4274-83. doi: 10.1182/blood-2010-01-264432. PubMed PMID: 20807888.
Yan, et al. Systematic discovery of regulated and conserved alternative exons in the mammalian brain reveals NMD modulating chromatin regulators. Proc Natl Acad Sci U S A. Mar. 17, 2015; 112(11): 3445-3450.
Yang, S. et al. PML-dependent apoptosis after DNA damage is regulated by the checkpoint kinase hCds1/Chk2. Nat Cell Biol. 2002;4(11):865-70. doi: 10.1038/ncb869. PubMed PMID: 12402044.
Yang, S., et al. Promyelocytic leukemia activates Chk2 by mediating Chk2 autophosphorylation. J Biol Chem. 2006;281(36):26645-54. doi: 10.1074/jbc.M604391200. PubMed PMID: 16835227.
Yang, Y. et al.Oligomerization of the polycystin-2 C-terminal tail and effects on its Ca2+binding properties.J. Bio. Chem. vol. 290, No. 16, pp. 10544-10554 (2015).
Yeo, et al. Discovery and analysis of evolutionarily conserved intronic splicing regulatory elements. PLoS Genet. May 25, 2007;3(5):e85. Epub Apr. 13, 2007.
Yoshida, et al. Frequent pathway mutations of splicing machinery in myelodysplasia. Nature. Sep. 11, 2011;478(7367):64-9. doi: 10.1038/ nature10496.
Yoshida, K., et al. Splicing factor mutations and cancer. Wiley Interdiscip Rev RNA. 2014;5(4):445-59. doi: 10.1002/wrna.1222. PubMed PMID: 24523246.
Yu, E.Y., et al. Regulation of telomere structure and functions by subunits of the INO80 chromatin remodeling complex. Mol Cell Biol. 2007;27(16):5639-49. doi: 10.1128/MCB.00418-07. PubMed PMID: 17562861; PubMed Central PMCID: PMC1952117.
Yuan X., et al. Nuclear protein profiling of Jurkat cells during heat stress-induced apoptosis by 2-DE and MS/MS. Electrophoresis. 2007;28(12):2018-26. doi: 10.1002/elps.200600821. PubMed PMID: 17523140.
Zamore, P.D., et al. Identification, purification, and biochemical characterization of U2 small nuclear ribonucleoprotein auxiliary factor. Proc Natl Acad Sci USA. 1989;86(23):9243-7. PubMed PMID: 2531895.
Zarnack K., et al. Direct competition between hnRNP C and U2AF65 protects the transcriptome from the exonization of Alu elements. Cell. 2013;152(3):453-66. Epub Feb. 5, 2013.doi: S0092-8674(12)01545-0 [pii] 10.1016/j.cell.2012.12.023. PubMed PMID: 23374342.
Zhang C., et al. RNA landscape of evolution for optimal exon and intron discrimination. Proc Natl Acad Sci USA. 2008;105(15):5797-802. Epub Apr. 9, 2008.doi: 0801692105 [pii] 10.1073/pnas. 0801692105. PubMed PMID: 18391195.
Zhang, et al. Insulin as an autoantigen in NOD/human diabetes. Curr Opin Immunol. Feb. 2008;20(1):111-8. doi: 10.1016/j.coi.2007. 11.005.
Zhang, et al. The kinetics and folding pathways of intramolecular G-quadruplex nucleic acids. J Am Chem Soc. Nov. 21, 2012;134(46):19297-308. doi: 10.1021/ja309851t. Epub Nov. 12, 2012.
Zhang, J. et al. PowerBLAST: A New Network BLAST Application for Interactive or Automated Sequence Analysis and Annotation Genome Res., vol. 7, pp. 649-656, (1997).
Zhang, X.H., et al. Computational definition of sequence motifs governing constitutive exon splicing. Genes Dev. 2004;18:1241-50. PubMed PMID: 15145827.
Zimrin et al. An Antisense Oligonucleotide to the Notch Ligand Jagged Enhances Firbroblast Growth Factor-induced Angiogenesis in Vitro. J. Biol. Chem. 271(51):32499-502 (Dec. 20, 1996).
Zon et al. Phosphorothioate oligonucleotides: chemistry, purification, analysis, scale-up and future directions. Anti Cancer Drug Design vol. 6, No. 6, pp. 539-568 (1991).
Zon G. and Stec,W.J. (1991) In Eckstein,F. (ed.), Oligonucleotides and Analogues: A Practical Approach. Oxford University Press, Oxford, UK, pp. 87-108.

(56) References Cited

OTHER PUBLICATIONS

Zorio, D.A., et al. Both subunits of U2AF recognize the 3' splice site in Caenorhabditis elegans. Nature. 1999;402(6763):835-8. PubMed PMID: 10617207.
EP16876499.1 Extended Search Report dated Jun. 14, 2019.
Li et al. JAG1 Mutation Spectrum and Origin in Chinese Children with Clinical Features of Alagille Syndrome. PLoS One 10(6):e0130355 (2015).
Pilia et al. Jagged-1 mutation analysis in Italian Alagille syndrome patients. Hum Mut 14(5):394-400 (1999).
Spinner et al. Jagged1 mutations in alagille syndrome. Hum Mutat 17(1):18-33 (2001).
Yamamoto et al. Mib-Jag1-Notch signalling regulates patterning and structural roles of the notochord by controlling cell-fate decisions. Development 137(15):2527-2537 (2010).
EP 16876621.0 Extended European Search Report and Search Opinion dated Mar. 7, 2019.
International Search Report and Written Opinion dated Mar. 28, 2019 for PCT/US2018/057165.
Database Geneseq [Online], Nov. 13, 2008 (Nov. 13, 2008), Dual label detection probe, QF probe 1, 5. 3.11, XP055572852, retrieved from EBI Accession No. GSN:ARK21623.
Supplementary European Search Report dated Apr. 18, 2019 for EP16876615.2.
Audentes Therapeutics Announces Expansion of AAV Technology Platform and Pipeline with New Development Programs for Duchenne Muscular Dystrophy and Myotonic Dystrophy. PRNewswire Apr. 8, 2019 (7 pgs).
EP168766061.1 Extended Search Report dated May 24, 2019.
Guy et al. A mouse Mecp2-null mutation causes neurological symptoms that mimic Rett syndrome. Nat Genet 27:322-326 (2001).
Itoh et al. Methyl CpG-binding Protein Isoform MeCP2_e2 Is Dispensable for Rett Syndrome Phenotypes but Essential for Embryo Viability and Placenta Development. J Biol Chem 287:13859-13867 (2012).
Kach et al. A novel antisense oligonucleotide approach to treat eye diseases by increasing target gene expression. No. 3423-A0194 ARVO Poster Apr. 19, 2019 (1 pg.).
Knudsen et al. Increased skewing of X chromosome inactivation in Rett syndrome patients and their mothers. Eur J Hum Genet 14:1189-1194(2006).

Kriaucionis et al. The major form of MeCP2 has a novel N-terminus generated by alternative splicing. Nucleic Acids Res 32:1818-1823 (2004).
Krishnaraj et al. RettBASE: Rett syndrome database update. Hum Mutat 38:922-931 (2017).
Liu et al. Alternative splicing and retinal degeneration. Clinical Genetics 84(2):142-149 (2013).
Long et al. Correction of diverse muscular dystrophy mutations in human engineered heart muscle by single-site genome editing. Sci Adv 4:eaap9004 (2018).
Mckie et al. Mutations in the pre-mRNA splicing factor gene PRPC8 in autosomal dominant retinitis pigmentosa (RP13). Human Molecular Genetics 10(15):1555-1562 (2001).
Mnatzakanian et al. A previously unidentified MECP2 open reading frame defines a new protein isoform relevant to Rett syndrome. Nat Genet 36:339-341 (2004).
Ramocki et al. The MECP2 duplication syndrome. Am J Med Genet A 152A:1079-1088 (2010).
Rangasamy et al. Reduced neuronal size and mTOR pathway activity in the Mecp2 A140V Rett syndrome mouse model. F1000research 5:2269 (2016).
Schanen et al. A Severely Affected Male Born into a Rett Syndrome Kindred Supports X-Linked Inheritance and Allows Extension of the Exclusion Map. Am J Hum Genetics 63:267-269 (1998).
Stein et al. FDA-Approved Oligonucleotide Therapies in 2017. Mol Ther 25:1069-1075 (2017).
Takahashi et al. Skewed X chromosome inactivation failed to explain the normal phenotype of a carrier female with MECP2 mutation resulting in Rett syndrome. Clin Genet 73:257-261 (2008).
Tillotson et al. Radically truncated MeCP2 rescues Rett syndrome-like neurological defects. Nature 550:398 (2017).
Yang et al. Biophysical analysis and small-angle X-ray scattering-derived structures of MeCP2-nucleosome complexes. Nucleic Acids Res 39:4122-4135 (2011).
Young et al. 915—a GABA-Selective AAV Vector-Based Approach to Up-Regulate Endogenous Scn1a Expression reverses key Phenotypes in a Mouse Model of Dravet Syndrome. 22nd Annual Meeting American Society of Gene & Cell Therapy. Washington, D.C. Apr. 29-May 2, 2019 (Abstract).
EP16781187.6 Office Action dated May 20, 2019

\* cited by examiner

ARPE-19
Cytoplasmic RNA
ASO conc.: 60 nM
48 hrs
n=2

PIR (human cortical neurons): N/A

PIR (ARPE-19): 3%

PIR (ARPE-19): 17%

PIR (ARPE-19): 10%

PIR (ARPE-19 cells): 59%

PIR (ARPE-19 cells) 49%

PIR (ARPE-19) 41%

PIR (THLE-3 cells) 15%

PIR (ARPE-19 cells) 50%

PIR (ARPE-19 cells) 7%

PIR (THLE cells): N/A

PIR (THLE cells): N/A

PIR (THLE cells): 15%

PIR (THLE cells): 15%

PIR (ARPE-19 cells): 32%

PIR (ARPE-19 cells): 25%

PIR (ARPE-19 cells): 51%

PIR (ARPE-19 cells): 33%

PIR (ARPE-19 cells): 21%

PIR (THLE-3 cells) 34%

PIR (THLE-3 cells) 29%

PIR (THLE-3 cells) 29%

PIR (THLE-3 cells) 20%

PIR (ARPE-19 cells) 7%

PIR (THLE cells) 18%

PIR (THLE cells) 12%

PIR (ARPE-19 cells) 7%

ANTISENSE OLIGOMERS AND USES THEREOF

CROSS-REFERENCE

This application is a Continuation-in-Part of: PCT Application No. PCT/US2016/066414 filed Dec. 13, 2016, which claims the benefit of U.S. Provisional Patent Application No. 62/267,210 filed Dec. 14, 2015; PCT Application No. PCT/US2016/066705 filed Dec. 14, 2016, which claims the benefit of U.S. Provisional Patent Application No. 62/267,212 filed Dec. 14, 2015; PCT Application No. PCT/US2016/066417 filed Dec. 13, 2016, which claims the benefit of U.S. Provisional Patent Application No. 62/267,252 filed Dec. 14, 2015; PCT Application No. PCT/US2016/066684 filed Dec. 14, 2016, which claims the benefit of U.S. Provisional Patent Application No. 62/267,261 filed Dec. 14, 2015; PCT Application No. PCT/US2016/066721 filed Dec. 14, 2016, which claims the benefit of U.S. Provisional Patent Application No. 62/267,256 filed Dec. 14, 2015 and U.S. Provisional Patent Application No. 62/319,011 filed Apr. 6, 2016; PCT Application No. PCT/US2016/066691 filed Dec. 14, 2016, which claims the benefit of U.S. Provisional Patent Application No. 62/267,259 filed Dec. 14, 2015 and U.S. Provisional Patent Application No. 62/318,958 filed Apr. 6, 2016; PCT Application No. PCT/US2016/066564 filed Dec. 14, 2016, which claims the benefit of U.S. Provisional Patent Application No. 62/267,238 filed Dec. 14, 2015 and U.S. Provisional Patent Application No. 62/319,015 filed Apr. 6, 2016; and PCT Application No. PCT/US2016/066576 filed Dec. 14, 2016, which claims the benefit of U.S. Provisional Patent Application No. 62/267,242 filed Dec. 14, 2015, which applications are incorporated herein by reference in their entirety.

STATEMENT AS TO FEDERALLY SPONSORED RESEARCH

This invention was made with government support under Grant No. GM042699 awarded by the National Institutes of Health. The government has certain rights in the invention.

SEQUENCE LISTING

The instant application contains a Sequence Listing which has been submitted in ASCII format via EFS-Web and is hereby incorporated by reference in its entirety. Said ASCII copy, created on Jun. 13, 2018 is named 47991_705_501_SL.txt and is 65,978,019 bytes in size.

BACKGROUND OF THE INVENTION

Alagille syndrome (ALGS), also known as arteriohepatic dysplasia, is a rare, debilitating, autosomal dominant, multisystem disorder (Turnpenny and Ellard, Eur. J. Hum. Gen. 2012, 20, 251-257). Patients suffer from liver damage caused by abnormalities in the bile ducts. Other effects include heart disease, vascular anomalies, skeletal anomalies, ophthalmic features, facial features, renal anomalies, growth retardation, and pancreatic insufficiency. The reported ALGS prevalence of 1:70,000 is thought to be an underestimate because of the variability and reduced penetrance of the condition.

Mutations of genes involved in Notch signaling have been reported to cause ALGS. Mutations in JAG1 cause ALGS type 1, while mutations in NOTCH2 cause ALGS type 2, which is less prevalent than ALGS type 1. JAG1 encodes JAG1 protein, a cell surface ligand for the Notch transmembrane receptors. Binding of JAG1 protein to the Notch receptors triggers a signaling cascade that results in transcription of genes involved in cell fate determination and differentiation.

Tuberous sclerosis complex (TSC) is a disorder characterized by growth of benign tumors in multiple organ systems (Au, K., et al., J. Child Neurol., 2004, 19: 699-709). Tumors of the central nervous system (CNS) are the leading cause of morbidity and mortality, followed by renal disease. Patients can suffer from abnormalities of the brain that may include seizures, intellectual disability, and developmental delay, as well as abnormalities of the skin, lung, kidneys, and heart. The disorder affects as many as 25,000 to 40,000 individuals in the United States and about 1 to 2 million individuals worldwide, with an estimated prevalence of one in 6,000 newborns.

TSC is a genetic disorder with an autosomal dominant inheritance pattern, caused by inherited defects or de novo mutations that occur on two genes, TSC1 and TSC2. Only one of the genes needs to be affected for TSC to be present. The TSC1 gene, on chromosome 9, produces a protein called hamartin. The TSC2 gene, discovered in 1993, is on chromosome 16 and produces the protein tuberin. Scientists believe these proteins act in a complex as growth suppressors by inhibiting the activation of a master, evolutionarily conserved kinase called mTOR. Loss of regulation of mTOR occurs in cells lacking either hamartin or tuberin, and this leads to abnormal differentiation and development, and to the generation of enlarged cells, as are seen in TSC brain lesions.

Autosomal dominant polycystic kidney disease (ADPKD), is one of the most common inherited renal cystic diseases, conditions characterized by the development of renal cysts and a variety of extrarenal manifestations (Torres and Harris, 2009, Kidney International (2009) 76, 149-168). Patients suffering from ADPKD generally develop end-stage renal disease (ESRD) by age 70, which ultimately requires interventions such as renal dialysis. The prevalence of ADPKD at birth is estimated to be between 1:400 and 1:1,000, affecting about 600,000 people in the US.

Mutations in either the PKD1 or PKD2 gene have been shown to manifest as ADPKD, with mutations in PKD2 being responsible for the late onset form of ADPKD. The PKD1 and PKD2 genes encode the PC-1 and PC-2 proteins, respectively. These proteins are believed to be essential to maintain the differentiated phenotype of the tubular epithelium (Tones and Harris, 2009).

Retinitis pigmentosa (RP) describes a group of diseases that have similar clinical phenotypes and are associated with genetically heterogeneous causes. RP frequently manifests as a loss of night vision, and can progress to peripheral blindness, resulting in tunnel vision. As the disorder progresses, subjects may lose a significant portion of their photoreceptors before experiencing loss of visual acuity, and can eventually experience complete blindness. RP-associated genes PRPF3, PRPF8, PRPF31, and PAP1 are involved in the assembly of spliceosomes. Although the functional properties of several RP-associated genes have been extensively studied, genotype-phenotype correlations are incompletely understood. However, it is known that disease-causing mutations in the PRPF3, PRPF8, PRPF31 and PAP1 genes have a dominant pattern of inheritance (Berger et al., 2010, Progress in Retinal Eye Research 29, 335-375).

Certain diseases affecting central nervous system function are associated with a deficiency in the expression of a gene, and in turn, a deficiency in the gene product. Examples of gene products for which increased expression can provide benefit in central nervous system diseases or conditions include, ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA and STX1B.

Certain diseases affecting eye function are associated with a deficiency in the expression of a gene, and in turn, a deficiency in the gene product. Examples of gene products for which increased expression can provide benefit in eye diseases or conditions include ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 and IDUA.

Liver disease is a debilitating and often fatal group of conditions with an estimated mortality rate of 80%. The liver is vital for many functions in the body including, but not limited to clearing the blood of harmful toxins, storing and releasing glucose, production of bile, storage of iron and aiding resistance to infections. Dysfunction of the liver ultimately leads to failure of other major organs and ultimately death. While liver transplantation can often prevent mortality, the odds of receiving a donor liver is typically low.

While there are a large number of diseases and conditions associated with the liver, a subset of liver diseases have been shown to proceed via a deficiency in the expression of a gene, and in turn, a deficiency in the gene product. Examples of gene products for which increased expression can provide benefit in liver diseases or conditions include AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 and NCOA5.

Kidney disease is a debilitating and potentially fatal group of conditions associated with the damaging of the kidneys. The kidney is vital for many functions in the body including, but not limited to cleansing of the blood by removing waste and excess fluid, maintaining the balance of salt and minerals in the blood, and regulation of blood pressure. Incidence of kidney disease often results in the buildup of fluid and waste products, vomiting, weakness, poor sleep and shortness of breath, and ultimately could lead to death. While kidney transplantation can often prevent mortality, the odds of receiving a donor kidney are typically low.

While there are a large number of diseases and conditions associated with the kidney, a subset of kidney diseases have been shown to proceed via a deficiency in the expression of a gene, and in turn, a deficiency in the gene prod, for example, CTNS, PAX2, CYP24A1 and PPARD.

SUMMARY OF THE INVENTION

The invention provides compositions and methods for treating Alagille syndrome, including antisense oligomers (ASOs) that promote constitutive splicing at intron splice sites of a JAG1 retained-intron-containing pre-mRNA (RIC pre-mRNA). The invention further provides compositions and methods for increasing production of mature JAG1 mRNA and, in turn, JAG1 protein, in cells of a subject in need thereof, for example, a subject that can benefit from increased production of JAG1 protein. The described methods may be used to treat subjects having Alagille Syndrome caused by a mutation(s) in the JAG1 gene, including missense, splicing, frameshift and nonsense mutations, as well as whole gene deletions that result in deficient JAG1 protein production. In other embodiments, the compositions and methods of the present invention are used to treat subjects having a muscular dystrophy, who can benefit from increased production of JAG1 protein.

Disclosed herein, in certain embodiments, is a method of treating Alagille syndrome in a subject in need thereof by increasing the expression of a target protein or functional RNA by cells of the subject, wherein the cells have a retained-intron-containing pre-mRNA (RIC pre-mRNA), the RIC pre-mRN 6489362A comprising a retained intron, an exon flanking the 5' splice site, an exon flanking the 3' splice site, and wherein the RIC pre-mRNA encodes the target protein or functional RNA, the method comprising contacting the cells of the subject with an antisense oligomer (ASO) complementary to a targeted portion of the RIC pre-mRNA encoding the target protein or functional RNA, whereby the retained intron is constitutively spliced from the RIC pre-mRNA encoding the target protein or functional RNA, thereby increasing the level of mRNA encoding the target protein or functional RNA, and increasing the expression of the target protein or functional RNA in the cells of the subject. In some embodiments, also disclosed herein is a method of increasing expression of a target protein, wherein the target protein is JAG1, by cells having a retained-intron-containing pre-mRNA (RIC pre-mRNA), the RIC pre-mRNA comprising a retained intron, an exon flanking the 5' splice site of the retained intron, an exon flanking the 3' splice site of the retained intron, and wherein the RIC pre-mRNA encodes JAG1 protein, the method comprising contacting the cells with an antisense oligomer (ASO) complementary to a targeted portion of the RIC pre-mRNA encoding JAG1 protein, whereby the retained intron is constitutively spliced from the RIC pre-mRNA encoding JAG1 protein, thereby increasing the level of mRNA encoding JAG1 protein, and increasing the expression of JAG1 protein in the cells. In some embodiments, the target protein is JAG1. In some embodiments, the target protein or the functional RNA is a compensating protein or a compensating functional RNA that functionally augments or replaces a target protein or functional RNA that is deficient in amount or activity in the subject. In some embodiments, the cells are in or from a subject having a condition caused by a deficient amount or activity of JAG1 protein. In some embodiments, the deficient amount of the target protein is caused by haploinsufficiency of the target protein, wherein the subject has a first allele encoding a functional target protein, and a second allele from which the target protein is not produced, or a second allele encoding a nonfunctional target protein, and wherein the antisense oligomer binds to a targeted portion of a RIC pre-mRNA transcribed from the first allele. In some embodiments, the subject has a condition caused by a disorder resulting from a deficiency in the amount or function of the target protein, wherein the subject has a) a first mutant allele from which (i) the target protein is produced at a reduced level compared to production from a wild-type allele, (ii) the target protein is produced in a form having reduced function compared to an equivalent wild-type protein, or (iii) the target protein is not produced, and b) a second mutant allele from which (i) the target protein is produced at a reduced level compared to production from a wild-type allele, (ii) the target protein is produced in a form having reduced function compared to an equivalent wild-type protein, or (iii) the target protein is not produced, and wherein when the subject has a first mutant allele a.iii., the second mutant allele is b.i. or b.ii., and wherein when the subject has a second mutant allele b.iii., the first mutant allele is a.i. or a.ii., and wherein the RIC pre-mRNA is transcribed from either the first mutant allele that is a.i. or a.ii., and/or the second allele that is b.i. or b.ii. In some embodiments, the target protein is produced in a form having reduced function compared to the equivalent wild-type protein. In some embodiments, the target protein is produced in a form that is fully-functional compared to the equivalent wild-type protein. In some embodiments, the targeted portion of the RIC pre-mRNA is in the retained intron within the region +6 relative to the 5' splice site of the retained intron to −16 relative to the 3' splice site of the retained intron. In some embodiments, the targeted portion of the RIC pre-mRNA is in the retained intron within: (a) the region +6 to +500, +6 to +400, +6 to 300, +6 to 200, or +6 to +100 relative to the 5' splice site of the retained intron; or (b) the region −16 to −500, −16 to −400, −16 to −300, −16 to −200, or −16 to −100 relative to the 3' splice site of the retained intron. In some embodiments, the targeted portion of the RIC pre-mRNA is within: (a) the region +2e to −4e in the exon flanking the 5' splice site of the retained intron; or (b) the region +2e to −4e in the exon flanking the 3' splice site of the retained intron. In some embodiments, the RIC pre-mRNA is encoded by a genetic sequence with at least about 80%, 85%, 90%, 95%, 96%, 97%, 98%, 99% or 100% sequence identity to SEQ ID NO: 1. In some embodiments, the RIC pre-mRNA comprises a sequence with at least about 80%, 85%, 90%, 95%, 96%, 97%, 98%, 99% or 100% sequence identity to any one of SEQ ID NO: 2. In some embodiments, the antisense oligomer does not increase the amount of the target protein or the functional RNA by modulating alternative splicing of pre-mRNA transcribed from a gene encoding the functional RNA or target protein. In some embodiments, the antisense oligomer does not increase the amount of the target protein or the functional RNA by modulating aberrant splicing resulting from mutation of the gene encoding the target protein or the functional RNA. In some embodiments, the RIC pre-mRNA was produced by partial splicing of a full-length pre-mRNA or partial splicing of a wild-type pre-mRNA. In some embodiments, the mRNA encoding the target protein or functional RNA is a full-length mature mRNA, or a wild-type mature mRNA. In some embodiments, the target protein produced is full-length protein, or wild-type protein. In some embodiments, the total amount of the mRNA encoding the target protein or functional RNA produced in the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of the mRNA encoding the target protein or functional RNA produced in a control cell. In some embodiments, the total amount of target protein produced by the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of target protein produced by a control cell. In some embodiments, the antisense oligomer comprises a backbone modification comprising a phosphorothioate linkage or a phosphorodiamidate linkage. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, each sugar moiety is a modified sugar moiety. In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or 100%, complementary to the targeted portion of the RIC pre-mRNA encoding the protein. In some embodiments, the targeted portion of the RIC pre-mRNA is within a sequence selected from SEQ ID NOs: 437-439. In some embodiments, the antisense oligomer comprises a nucleotide sequence that is at least about 80%, 85%, 90%, 91%, 92%, 93%, 94%, 95%, 96%, 97%, 98%, or 99% sequence identity to any one of SEQ ID NOs: 3-436. In some embodiments, the antisense oligomer comprises a nucleotide sequence selected from SEQ ID NOs: 3-436. In some embodiments, the cell comprises a population of RIC pre-mRNAs transcribed from the gene encoding the target protein or functional RNA, wherein the population of RIC pre-mRNAs comprises two or more retained introns, and wherein the antisense oligomer binds to the most abundant retained intron in the population of RIC pre-mRNAs. In some embodiments, the binding of the antisense oligomer to the most abundant retained intron induces splicing out of the two or more retained introns from the population of RIC pre-mRNAs to produce mRNA encoding the target protein or functional RNA. In some embodiments, the cell comprises a population of RIC pre-mRNAs transcribed from the gene encoding the target protein or functional RNA, wherein the population of RIC pre-mRNAs comprises two or more retained introns, and wherein the antisense oligomer binds to the second most abundant retained intron in the population of RIC pre-mRNAs. In some embodiments, the binding of the antisense oligomer to the second most abundant retained intron induces splicing out of the two or more retained introns from the population of RIC pre-mRNAs to produce mRNA encoding the target protein or functional RNA. In some embodiments, the condition is a disease or disorder. In some embodiments, the disease or disorder is Alagille syndrome or a muscular dystrophy. In some embodiments, the target protein and the RIC pre-mRNA are encoded by the JAG1 gene. In some embodiments, the method further comprises assessing JAG1 protein expression. In some embodiments, the antisense oligomer binds to a targeted portion of a JAG1 RIC pre-mRNA, wherein the targeted portion is within a sequence selected from SEQ ID NOS: 49, 50, 51, 52, 53, 54, 55, 56, and 57. In some embodiments, the subject is a human. In some embodiments, the subject is a non-human animal. In some embodiments, the subject is a fetus, an embryo, or a child. In some embodiments, the cells are ex vivo. In some embodiments, the antisense oligomer is administered by intraperitoneal injection, intramuscular injection, subcutaneous injection, or intravenous injection of the subject. In some embodiments, the 9 nucleotides at −3e to −1e of the exon flanking the 5' splice site and +1 to +6 of the retained intron, are identical to the corresponding wild-type sequence. In some embodiments, the 16 nucleotides at −15 to −1 of the retained intron and +1e of the exon flanking the 3' splice site are identical to the corresponding wild-type sequence.

Disclosed herein, in certain embodiments, is an antisense oligomer as used in a method described above.

Disclosed herein, in certain embodiments, is an antisense oligomer comprising a sequence with at least about 80%, 85%, 90%, 95%, 97%, or 100% sequence identity to any one of SEQ ID NOs: 3-436.

Disclosed herein, in certain embodiments, is a pharmaceutical composition comprising the antisense oligomer described above and an excipient.

Disclosed herein, in certain embodiments, is a method of treating a subject in need thereof by administering the pharmaceutical composition described above by intraperitoneal injection, intramuscular injection, subcutaneous injection, or intravenous injection.

Disclosed herein, in certain embodiments, is a composition comprising an antisense oligomer for use in a method of increasing expression of a target protein or a functional RNA by cells to treat Alagille syndrome in a subject in need thereof associated with a deficient protein or deficient functional RNA, wherein the deficient protein or deficient functional RNA is deficient in amount or activity in the subject, wherein the antisense oligomer enhances constitutive splicing of a retained intron-containing pre-mRNA (RIC pre-mRNA) encoding the target protein or the functional RNA, wherein the target protein is: (a) the deficient protein; or (b) a compensating protein which functionally augments or replaces the deficient protein or in the subject; and wherein the functional RNA is: (a) the deficient RNA; or (b) a compensating functional RNA which functionally augments or replaces the deficient functional RNA in the subject; wherein the RIC pre-mRNA comprises a retained intron, an exon flanking the 5' splice site and an exon flanking the 3' splice site, and wherein the retained intron is spliced from the RIC pre-mRNA encoding the target protein or the functional RNA, thereby increasing production or activity of the target protein or the functional RNA in the subject. In some embodiments, also disclosed herein is a composition comprising an antisense oligomer for use in a method of treating a condition associated with JAG1 protein in a subject in need thereof, the method comprising the step of increasing expression of JAG1 protein by cells of the subject, wherein the cells have a retained-intron-containing pre-mRNA (RIC pre-mRNA) comprising a retained intron, an exon flanking the 5' splice site of the retained intron, an exon flanking the 3' splice site of the retained intron, and wherein the RIC pre-mRNA encodes the JAG1 protein, the method comprising contacting the cells with the antisense oligomer, whereby the retained intron is constitutively spliced from the RIC pre-mRNA transcripts encoding JAG1 protein, thereby increasing the level of mRNA encoding JAG1, and increasing the expression of JAG1 protein, in the cells of the subject. In some embodiments, the condition is a disease or disorder. In some embodiments, the disease or disorder is Alagille syndrome or a muscular dystrophy. In some embodiments, the target protein and RIC pre-mRNA are encoded by the JAG1 gene. In some embodiments, the antisense oligomer targets a portion of the RIC pre-mRNA that is in the retained intron within the region +6 relative to the 5' splice site of the retained intron to −16 relative to the 3' splice site of the retained intron. In some embodiments, the antisense oligomer targets a portion of the RIC pre-mRNA that is in the retained intron within: (a) the region +6 to +100 relative to the 5' splice site of the retained intron; or (b) the region −16 to −100 relative to the 3' splice site of the retained intron. In some embodiments, the antisense oligomer targets a portion of the RIC pre-mRNA that is within the region about 100 nucleotides downstream of the 5' splice site of the at least one retained intron, to about 100 nucleotides upstream of the 3' splice site of the at least one retained intron. In some embodiments, the targeted portion of the RIC pre-mRNA is within: (a) the region +2e to −4e in the exon flanking the 5' splice site of the retained intron; or (b) the region +2e to −4e in the exon flanking the 3' splice site of the retained intron. In some embodiments, the RIC pre-mRNA is encoded by a genetic sequence with at least about 80%, 85%, 90%, 95%, 96%, 97%, 98%, 99% or 100% sequence identity to SEQ ID NO: 1. In some embodiments, the RIC pre-mRNA comprises a sequence with at least about 80%, 85%, 90%, 95%, 96%, 97%, 98%, 99% or 100% sequence identity to any one of SEQ ID NO: 2. In some embodiments, the antisense oligomer does not increase the amount of target protein or functional RNA by modulating alternative splicing of the pre-mRNA transcribed from a gene encoding the target protein or functional RNA. In some embodiments, the antisense oligomer does not increase the amount of the functional RNA or functional protein by modulating aberrant splicing resulting from mutation of the gene encoding the target protein or functional RNA. In some embodiments, the RIC pre-mRNA was produced by partial splicing from a full-length pre-mRNA or a wild-type pre-mRNA. In some embodiments, the mRNA encoding the target protein or functional RNA is a full-length mature mRNA, or a wild-type mature mRNA. In some embodiments, the target protein produced is full-length protein, or wild-type protein. In some embodiments, the retained intron is a rate-limiting intron. In some embodiments, the retained intron is the most abundant retained intron in the RIC pre-mRNA. In some embodiments, the retained intron is the second most abundant retained intron in the RIC pre-mRNA. In some embodiments, the antisense oligomer comprises a backbone modification comprising a phosphorothioate linkage or a phosphorodiamidate linkage. In some embodiments, the antisense oligomer is an antisense oligonucleotide. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, each sugar moiety is a modified sugar moiety. In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or is 100% complementary to the targeted portion of the RIC pre-mRNA encoding the protein. In some embodiments, the antisense oligomer binds to a targeted portion of a JAG1 RIC pre-mRNA, wherein the targeted portion is in a sequence selected from SEQ ID NOs 437-439. In some embodiments, the antisense oligomer comprises a nucleotide sequence that is at least about 80%, 85%, 90%, 91%, 92%, 93%, 94%, 95%, 96%, 97%, 98%, or 99% sequence identity to any one of SEQ ID NOs: 3-436. In some embodiments, the antisense oligomer comprises a nucleotide sequence selected from SEQ ID NOs: 3-436.

Disclosed herein, in certain embodiments, is a pharmaceutical composition comprising the antisense oligomer of any of the compositions described above, and an excipient. In some embodiments, also described herein is a method of treating a subject in need thereof by administering the pharmaceutical composition by intraperitoneal injection, intramuscular injection, subcutaneous injection, or intravenous injection.

Disclosed herein, in certain embodiments, is a pharmaceutical composition comprising: an antisense oligomer that hybridizes to a target sequence of a deficient JAG1 mRNA transcript, wherein the deficient JAG1 mRNA transcript comprises a retained intron, wherein the antisense oligomer induces splicing out of the retained intron from the deficient JAG1 mRNA transcript; and a pharmaceutical acceptable excipient. In some embodiments, the deficient JAG1 mRNA transcript is a JAG1 RIC pre-mRNA transcript. In some embodiments, the targeted portion of the JAG1 RIC pre-mRNA transcript is in the retained intron within the region +6 relative to the 5' splice site of the retained intron to −16 relative to the 3' spliced site of the retained intron. In some embodiments, the JAG1 RIC pre-mRNA transcript is encoded by a genetic sequence with at least about 80%, 85%, 90%, 95%, 96%, 97%, 98%, 99% or 100% sequence identity to SEQ ID NO: 1. In some embodiments, the JAG1 RIC pre-mRNA transcript comprises a sequence with at least about 80%, 85%, 90%, 95%, 96%, 97%, 98%, 99% or 100% sequence identity to any one of SEQ ID NO: 2. In some embodiments, the antisense oligomer comprises a backbone modification comprising a phosphorothioate linkage or a phosphorodiamidate linkage. In some embodiments, the antisense oligomer is an antisense oligonucleotide. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, the antisense oligomer comprises from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or is 100% complementary to a targeted portion of the JAG1 RIC pre-mRNA transcript. In some embodiments, the targeted portion of the JAG1 RIC pre-mRNA transcript is within a sequence selected from SEQ ID NOs: 437-439. In some embodiments, the antisense oligomer comprises a nucleotide sequence that is at least about 80%, 85%, 90%, 91%, 92%, 93%, 94%, 95%, 96%, 97%, 98%, or 99% sequence identity to any one of SEQ ID NOs: 3-436. In some embodiments, the antisense oligomer comprises a nucleotide sequence selected from SEQ ID NOs: 3-436. In some embodiments, the pharmaceutical composition is formulated for intrathecal injection, intracerebroventricular injection, intraperitoneal injection, intramuscular injection, subcutaneous injection, or intravenous injection.

Disclosed herein, in certain embodiments, is a method of inducing processing of a deficient JAG1 mRNA transcript to facilitate removal of a retained intron to produce a fully processed JAG1 mRNA transcript that encodes a functional form of a tuberin protein, the method comprising: (a) contacting an antisense oligomer to a target cell of a subject; (b) hybridizing the antisense oligomer to the deficient JAG1 mRNA transcript, wherein the deficient JAG1 mRNA transcript is capable of encoding the functional form of tuberin protein and comprises at least one retained intron; (c) removing the at least one retained intron from the deficient JAG1 mRNA transcript to produce the fully processed JAG1 mRNA transcript that encodes the functional form of tuberin protein; and (d) translating the functional form of tuberin protein from the fully processed JAG1 mRNA transcript. In some embodiments, the retained intron is an entire retained intron. In some embodiments, the deficient JAG1 mRNA transcript is a JAG1 RIC pre-mRNA transcript.

Disclosed herein, in certain embodiments, is a method of treating a subject having a condition caused by a deficient amount or activity of JAG1 protein comprising: administering to the subject an antisense oligomer comprising a nucleotide sequence with at least about 80%, 85%, 90%, 91%, 92%, 93%, 94%, 95%, 96%, 97%, 98%, or 99% sequence identity to any one of SEQ ID NOs: 3-436.

The invention provides compositions and methods for treating tuberous sclerosis complex, including antisense oligomers (ASOs) that promote constitutive splicing at intron splice sites of a TSC2 retained-intron-containing pre-mRNA (RIC pre-mRNA). The invention further provides compositions and methods for increasing production of mature TSC2 mRNA and, in turn, TSC2 protein, in cells of a subject in need thereof, for example, a subject that can benefit from increased production of TSC2 protein. The described methods may be used to treat subjects having tuberous sclerosis complex caused by mutations in the TSC2 gene, including missense, splicing, frameshift and nonsense mutations, as well as whole gene deletions that result in deficient tuberin protein production.

Disclosed herein, in certain embodiments, is a method of treating tuberous sclerosis complex in a subject in need thereof, by increasing the expression of a target protein or functional RNA by cells of the subject, wherein the cells have a retained-intron-containing pre-mRNA (RIC pre-mRNA), the RIC pre-mRNA comprising a retained intron, an exon flanking the 5' splice site, an exon flanking the 3' splice site, and wherein the RIC pre-mRNA encodes the target protein or functional RNA, the method comprising contacting the cells of the subject with an antisense oligomer (ASO) complementary to a targeted portion of the RIC pre-mRNA encoding the target protein or functional RNA, whereby the retained intron is constitutively spliced from the RIC pre-mRNA encoding the target protein or functional RNA, thereby increasing the level of mRNA encoding the target protein or functional RNA, and increasing the expression of the target protein or functional RNA in the cells of the subject. In some embodiments, also described herein is a method of increasing expression of a target protein, wherein the target protein is tuberin, by cells having a retained-intron-containing pre-mRNA (RIC pre-mRNA), the RIC pre-mRNA comprising a retained intron, an exon flanking the 5' splice site of the retained intron, an exon flanking the 3' splice site of the retained intron, and wherein the RIC pre-mRNA encodes tuberin protein, the method comprising contacting the cells with an antisense oligomer (ASO) complementary to a targeted portion of the RIC pre-mRNA encoding tuberin protein, whereby the retained intron is constitutively spliced from the RIC pre-mRNA encoding tuberin protein, thereby increasing the level of mRNA encoding tuberin protein, and increasing the expression of tuberin protein in the cells. In some embodiments, the target protein is tuberin. In some embodiments, the target protein or the functional RNA is a compensating protein or a compensating functional RNA that functionally augments or replaces a target protein or functional RNA that is deficient in amount or activity in the subject. In some embodiments, the cells are in or from a subject having a condition caused by a deficient amount or activity of tuberin protein. In some embodiments, the deficient amount of the target protein is caused by haploinsufficiency of the target protein, wherein the subject has a first allele encoding a functional target protein, and a second allele from which the target protein is not produced, or a second allele encoding a nonfunctional target protein, and wherein the antisense oligomer binds to a targeted portion of a RIC pre-mRNA transcribed from the first allele. In some embodiments, the subject has a condition caused by a disorder resulting from a deficiency in the amount or function of the target protein, wherein the subject has (a) a first mutant allele from which (i) the target protein is produced at a reduced level compared to production from a wild-type allele, (ii) the target protein is produced in a form having reduced function compared to an equivalent wild-type protein, or (iii) the target protein is not produced, and (b) a second mutant allele from which (i) the target protein is produced at a reduced level compared to production from a wild-type allele, (ii) the target protein is produced in a form having reduced function compared to an equivalent wild-type protein, or (iii) the target protein is not produced, and wherein when the subject has a first mutant allele a.iii., the second mutant allele is b.i. or b.ii., and wherein when the subject has a second mutant allele b.iii., the first mutant allele is a.i. or a.ii., and wherein the RIC pre-mRNA is transcribed from either the first mutant allele that is a.i. or a.ii., and/or the second allele that is b.i. or b.ii. In some embodiments, the target protein is produced in a form having reduced function compared to the equivalent wild-type protein. In some embodiments, the target protein is produced in a form that is fully-functional compared to the equivalent wild-type protein. In some embodiments, the targeted portion of the RIC pre-mRNA is in the retained intron within the region +6 relative to the 5' splice site of the retained intron to −16 relative to the 3' splice site of the retained intron. In some embodiments, the targeted portion of the RIC pre-mRNA is in the retained intron within the region +500 relative to the 5' splice site of the retained intron to −500 relative to the 3' splice site of the retained intron. In some embodiments, the targeted portion of the RIC pre-mRNA is in the retained intron within: (a) the region +6 to +500, +6 to +495, or +6 to +100 relative to the 5' splice site of the retained intron; or (b) the region −16 to −500, −16 to −400, or −16 to −100 relative to the 3' splice site of the retained intron. In some embodiments, the targeted portion of the RIC pre-mRNA is within: (a) the region +2e to −4e in the exon flanking the 5' splice site of the retained intron; or (b) the region +2e to −4e in the exon flanking the 3' splice site of the retained intron. In some embodiments, the RIC pre-mRNA is encoded by a genetic sequence with at least about 80%, 85%, 90%, 95%, 96%, 97%, 98%, 99% or 100% sequence identity to SEQ ID NO: 440. In some embodiments, the RIC pre-mRNA comprises a sequence with at least about 80%, 85%, 90%, 95%, 96%, 97%, 98%, 99% or 100% sequence identity to any one of SEQ ID NOs: 441-447. In some embodiments, the antisense oligomer does not increase the amount of the target protein or the functional RNA by modulating alternative splicing of pre-mRNA transcribed from a gene encoding the functional RNA or target protein. In some embodiments, the antisense oligomer does not increase the amount of the target protein or the functional RNA by modulating aberrant splicing resulting from mutation of the gene encoding the target protein or the functional RNA. In some embodiments, the RIC pre-mRNA was produced by partial splicing of a full-length pre-mRNA or partial splicing of a wild-type pre-mRNA. In some embodiments, the mRNA encoding the target protein or functional RNA is a full-length mature mRNA, or a wild-type mature mRNA. In some embodiments, the target protein produced is full-length protein, or wild-type protein. In some embodiments, the total amount of the mRNA encoding the target protein or functional RNA produced in the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of the mRNA encoding the target protein or functional RNA produced in a control cell. In some embodiments, the total amount of target protein produced by the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of target protein produced by a control cell. In some embodiments, the antisense oligomer comprises a backbone modification comprising a phosphorothioate linkage or a phosphorodiamidate linkage. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, each sugar moiety is a modified sugar moiety. In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or 100%, complementary to the targeted portion of the RIC pre-mRNA encoding the protein. In some embodiments, the targeted portion of the RIC pre-mRNA is within a sequence selected from SEQ ID NOs: 5536-5544. In some embodiments, the antisense oligomer comprises a nucleotide sequence that is at least about 80%, 85%, 90%, 91%, 92%, 93%, 94%, 95%, 96%, 97%, 98%, or 99% sequence identity to any one of SEQ ID NOs: 448-5535. In some embodiments, the antisense oligomer comprises a nucleotide sequence selected from SEQ ID NOs: 448-5535. In some embodiments, the cell comprises a population of RIC pre-mRNAs transcribed from the gene encoding the target protein or functional RNA, wherein the population of RIC pre-mRNAs comprises two or more retained introns, and wherein the antisense oligomer binds to the most abundant retained intron in the population of RIC pre-mRNAs. In some embodiments, the binding of the antisense oligomer to the most abundant retained intron induces splicing out of the two or more retained introns from the population of RIC pre-mRNAs to produce mRNA encoding the target protein or functional RNA. In some embodiments, the cell comprises a population of RIC pre-mRNAs transcribed from the gene encoding the target protein or functional RNA, wherein the population of RIC pre-mRNAs comprises two or more retained introns, and wherein the antisense oligomer binds to the second most abundant retained intron in the population of RIC pre-mRNAs. In some embodiments, the binding of the antisense oligomer to the second most abundant retained intron induces splicing out of the two or more retained introns from the population of RIC pre-mRNAs to produce mRNA encoding the target protein or functional RNA. In some embodiments, the condition is a disease or disorder. In some embodiments, the disease or disorder is tuberous sclerosis complex. In some embodiments, the target protein and the RIC pre-mRNA are encoded by the TSC2 gene. In some embodiments, the method further comprises assessing TSC2 protein expression. In some embodiments, the antisense oligomer binds to a targeted portion of a tuberin RIC pre-mRNA, wherein the targeted portion is within a sequence selected from SEQ ID NOS: 488, 489, 490, 491, 492, 493, 494, 495, and 496. In some embodiments, the subject is a human. In some embodiments, the subject is a non-human animal. In some embodiments, the subject is a fetus, an embryo, or a child. In some embodiments, the cells are ex vivo. In some embodiments, the antisense oligomer is administered by topical application to the skin, pulmonary delivery to the lung, intrathecal injection, intracerebroventricular injection, intraperitoneal injection, intramuscular injection, subcutaneous injection, or intravenous injection of the subject. In some embodiments, the 9 nucleotides at −3e to −1e of the exon flanking the 5' splice site and +1 to +6 of the retained intron, are identical to the corresponding wild-type sequence. In some embodiments, the 16 nucleotides at −15 to −1 of the retained intron and +1e of the exon flanking the 3' splice site are identical to the corresponding wild-type sequence.

Disclosed herein, in certain embodiments, is an antisense oligomer as used in a method described above.

Disclosed herein, in certain embodiments, is an antisense oligomer comprising a sequence with at least about 80%, 85%, 90%, 95%, 97%, or 100% sequence identity to any one of SEQ ID NOs: 448-5535.

Disclosed herein, in certain embodiments, is a pharmaceutical composition comprising the antisense oligomer described above, and an excipient. In some embodiments, also described herein is a method of treating a subject in need thereof, by administering the pharmaceutical composition by topical application to the skin, pulmonary delivery to the lung, intrathecal injection, intracerebroventricular injection, intraperitoneal injection, intramuscular injection, subcutaneous injection, or intravenous injection.

Disclosed herein, in certain embodiments, is a composition comprising an antisense oligomer for use in a method of increasing expression of a target protein or a functional RNA by cells to treat tuberous sclerosis complex in a subject in need thereof, associated with a deficient protein or deficient functional RNA, wherein the deficient protein or deficient functional RNA is deficient in amount or activity in the subject, wherein the antisense oligomer enhances constitutive splicing of a retained intron-containing pre-mRNA (RIC pre-mRNA) encoding the target protein or the functional RNA, wherein the target protein is: (a) the deficient protein; or (b) a compensating protein which functionally augments or replaces the deficient protein or in the subject; and wherein the functional RNA is: (a) the deficient RNA; or (b) a compensating functional RNA which functionally augments or replaces the deficient functional RNA in the subject; wherein the RIC pre-mRNA comprises a retained intron, an exon flanking the 5' splice site and an exon flanking the 3' splice site, and wherein the retained intron is spliced from the RIC pre-mRNA encoding the target protein or the functional RNA, thereby increasing production or activity of the target protein or the functional RNA in the subject. In some embodiments, also disclosed herein is a composition comprising an antisense oligomer for use in a method of treating a condition associated with tuberin protein in a subject in need thereof, the method comprising the step of increasing expression of tuberin protein by cells of the subject, wherein the cells have a retained-intron-containing pre-mRNA (RIC pre-mRNA) comprising a retained intron, an exon flanking the 5' splice site of the retained intron, an exon flanking the 3' splice site of the retained intron, and wherein the RIC pre-mRNA encodes the tuberin protein, the method comprising contacting the cells with the antisense oligomer, whereby the retained intron is constitutively spliced from the RIC pre-mRNA transcripts encoding tuberin protein, thereby increasing the level of mRNA encoding the tuberin protein, and increasing the expression of tuberin protein, in the cells of the subject. In some embodiments, the condition is a disease or disorder. In some embodiments, the disease or disorder is tuberous sclerosis complex. In some embodiments, the target protein and RIC pre-mRNA are encoded by the TSC2 gene. In some embodiments, the antisense oligomer targets a portion of the RIC pre-mRNA that is in the retained intron within the region +6 relative to the 5' splice site of the retained intron to −16 relative to the 3' splice site of the retained intron. In some embodiments, the antisense oligomer targets a portion of the RIC pre-mRNA that is in the retained intron within: (a) the region +6 to +100 relative to the 5' splice site of the retained intron; or (b) the region −16 to −100 relative to the 3' splice site of the retained intron. In some embodiments, the antisense oligomer targets a portion of the RIC pre-mRNA that is within the region about 500, 400, 300, 200, or 100 nucleotides downstream of the 5' splice site of the at least one retained intron, to about 100, 200, 300, 400, or 500 nucleotides upstream of the 3' splice site of the at least one retained intron. In some embodiments, the targeted portion of the RIC pre-mRNA is within: (a) the region +2e to −4e in the exon flanking the 5' splice site of the retained intron; or (b) the region +2e to −4e in the exon flanking the 3' splice site of the retained intron. In some embodiments, the RIC pre-mRNA is encoded by a genetic sequence with at least about 80%, 85%, 90%, 95%, 96%, 97%, 98%, 99% or 100% sequence identity to SEQ ID NO: 440. In some embodiments, the RIC pre-mRNA comprises a sequence with at least about 80%, 85%, 90%, 95%, 96%, 97%, 98%, 99% or 100% sequence identity to any one of SEQ ID NOs: 441-447. In some embodiments, the antisense oligomer does not increase the amount of target protein or functional RNA by modulating alternative splicing of the pre-mRNA transcribed from a gene encoding the target protein or functional RNA. In some embodiments, the antisense oligomer does not increase the amount of the functional RNA or functional protein by modulating aberrant splicing resulting from mutation of the gene encoding the target protein or functional RNA. In some embodiments, the RIC pre-mRNA was produced by partial splicing from a full-length pre-mRNA or a wild-type pre-mRNA. In some embodiments, the mRNA encoding the target protein or functional RNA is a full-length mature mRNA, or a wild-type mature mRNA. In some embodiments, the target protein produced is full-length protein, or wild-type protein. In some embodiments, the retained intron is a rate-limiting intron. In some embodiments, said retained intron is the most abundant retained intron in said RIC pre-mRNA. In some embodiments, the retained intron is the second most abundant retained intron in said RIC pre-mRNA. In some embodiments, the antisense oligomer comprises a backbone modification comprising a phosphorothioate linkage or a phosphorodiamidate linkage. In some embodiments, said antisense oligomer is an antisense oligonucleotide. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, each sugar moiety is a modified sugar moiety. In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or is 100% complementary to the targeted portion of the RIC pre-mRNA encoding the protein. In some embodiments, the antisense oligomer binds to a targeted portion of a tuberin RIC pre-mRNA, wherein the targeted portion is within a sequence selected from SEQ ID NOs: 5536-5544. In some embodiments, the antisense oligomer comprises a nucleotide sequence that is at least about 80%, 85%, 90%, 91%, 92%, 93%, 94%, 95%, 96%, 97%, 98%, or 99% sequence identity to any one of SEQ ID NOs: 448-5535. In some embodiments, the antisense oligomer comprises a nucleotide sequence selected from SEQ ID NOs: 448-5535.

Disclosed herein, in certain embodiments, is a pharmaceutical composition comprising the antisense oligomer described above, and an excipient. In some embodiments, also described herein is a method of treating a subject in need thereof, by administering the pharmaceutical composition by topical application to the skin, pulmonary delivery to the lung, intrathecal injection, intracerebroventricular injection, intraperitoneal injection, intramuscular injection, subcutaneous injection, or intravenous injection.

Disclosed herein, in certain embodiments, is a pharmaceutical composition comprising: an antisense oligomer that hybridizes to a target sequence of a deficient TSC2 mRNA transcript, wherein the deficient TSC2 mRNA transcript comprises a retained intron, wherein the antisense oligomer induces splicing out of the retained intron from the deficient TSC2 mRNA transcript; and a pharmaceutical acceptable excipient. In some embodiments, the deficient TSC2 mRNA transcript is a TSC2 RIC pre-mRNA transcript. In some embodiments, the targeted portion of the TSC2 RIC pre-mRNA transcript is in the retained intron within the region +500 relative to the 5' splice site of the retained intron to −500 relative to the 3' spliced site of the retained intron. In some embodiments, the TSC2 RIC pre-mRNA transcript is encoded by a genetic sequence with at least about 80%, 85%, 90%, 95%, 96%, 97%, 98%, 99% or 100% sequence identity to SEQ ID NO: 440. In some embodiments, the TSC2 RIC pre-mRNA transcript comprises a sequence with at least about 80%, 85%, 90%, 95%, 96%, 97%, 98%, 99% or 100% sequence identity to any one of SEQ ID NOs: 2-8. In some embodiments, the antisense oligomer comprises a backbone modification comprising a phosphorothioate linkage or a phosphorodiamidate linkage. In some embodiments, the antisense oligomer is an antisense oligonucleotide. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, the antisense oligomer comprises from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or is 100% complementary to a targeted portion of the TSC2 RIC pre-mRNA transcript. In some embodiments, the targeted portion of the TSC2 RIC pre-mRNA transcript is within a sequence selected from SEQ ID NOs: 5536-5544. In some embodiments, the antisense oligomer comprises a nucleotide sequence that is at least about 80%, 85%, 90%, 91%, 92%, 93%, 94%, 95%, 96%, 97%, 98%, or 99% sequence identity to any one of SEQ ID NOs: 448-5535. In some embodiments, the antisense oligomer comprises a nucleotide sequence selected from SEQ ID NOs: 448-5535. In some embodiments, the pharmaceutical composition is formulated for intrathecal injection, intracerebroventricular injection, intraperitoneal injection, intramuscular injection, subcutaneous injection, or intravenous injection.

Disclosed herein, in certain embodiments, is a method of inducing processing of a deficient TSC2 mRNA transcript to facilitate removal of a retained intron to produce a fully processed TSC2 mRNA transcript that encodes a functional form of a tuberin protein, the method comprising: (a) contacting an antisense oligomer to a target cell of a subject; (b) hybridizing the antisense oligomer to the deficient TSC2 mRNA transcript, wherein the deficient TSC2 mRNA transcript is capable of encoding the functional form of tuberin protein and comprises at least one retained intron; (c) removing the at least one retained intron from the deficient TSC2 mRNA transcript to produce the fully processed TSC2 mRNA transcript that encodes the functional form of tuberin protein; and (d) translating the functional form of tuberin protein from the fully processed TSC2 mRNA transcript. In some embodiments, the retained intron is an entire retained intron. In some embodiments, the deficient TSC2 mRNA transcript is a TSC2 RIC pre-mRNA transcript.

Disclosed herein, in certain embodiments, is a method of treating a subject having a condition caused by a deficient amount or activity of tuberin protein comprising: administering to the subject an antisense oligomer comprising a nucleotide sequence with at least about 80%, 85%, 90%, 91%, 92%, 93%, 94%, 95%, 96%, 97%, 98%, or 99% sequence identity to any one of SEQ ID NOs: 448-5535.

Disclosed herein, in some embodiments, are methods of treating Polycystic Kidney Disease in a subject in need thereof, by increasing the expression of a target protein or functional RNA by cells of the subject, wherein the cells have a retained-intron-containing pre-mRNA (RIC pre-mRNA), the RIC pre-mRNA comprising a retained intron, an exon flanking the 5' splice site, an exon flanking the 3' splice site, and wherein the RIC pre-mRNA encodes the target protein or functional RNA, the method comprising contacting the cells of the subject with an antisense oligomer (ASO) complementary to a targeted portion of the RIC pre-mRNA encoding the target protein or functional RNA, whereby the retained intron is constitutively spliced from the RIC pre-mRNA encoding the target protein or functional RNA, thereby increasing the level of mRNA encoding the target protein or functional RNA, and increasing the expression of the target protein or functional RNA in the cells of the subject.

Also disclosed herein, in some embodiments, are methods of increasing expression of a target protein, wherein the target protein is PC-2, by cells having a retained-intron-containing pre-mRNA (RIC pre-mRNA), the RIC pre-mRNA comprising a retained intron, an exon flanking the 5' splice site of the retained intron, an exon flanking the 3' splice site of the retained intron, and wherein the RIC pre-mRNA encodes PC-2 protein, the method comprising contacting the cells with an antisense oligomer (ASO) complementary to a targeted portion of the RIC pre-mRNA encoding PC-2 protein, whereby the retained intron is constitutively spliced from the RIC pre-mRNA encoding PC-2 protein, thereby increasing the level of mRNA encoding PC-2 protein, and increasing the expression of PC-2 protein in the cells.

In some embodiments of any of the aforementioned methods, the target protein is PC-2. In some embodiments, the target protein or the functional RNA is a compensating protein or a compensating functional RNA that functionally augments or replaces a target protein or functional RNA that is deficient in amount or activity in the subject. In some embodiments, the cells are in or from a subject having a condition caused by a deficient amount or activity of PC-2 protein.

In some embodiments of any of the aforementioned methods, the deficient amount of the target protein is caused by haploinsufficiency of the target protein, wherein the subject has a first allele encoding a functional target protein, and a second allele from which the target protein is not produced, or a second allele encoding a nonfunctional target protein, and wherein the antisense oligomer binds to a targeted portion of a RIC pre-mRNA transcribed from the first allele. In some embodiments, the subject has a condition caused by a disorder resulting from a deficiency in the amount or function of the target protein, wherein the subject has (a) a first mutant allele from which (i) the target protein is produced at a reduced level compared to production from a wild-type allele, (ii) the target protein is produced in a form having reduced function compared to an equivalent wild-type protein, or (iii) the target protein is not produced, and (b) a second mutant allele from which (i) the target protein is produced at a reduced level compared to production from a wild-type allele, (ii) the target protein is produced in a form having reduced function compared to an equivalent wild-type protein, or (iii) the target protein is not produced, and wherein when the subject has a first mutant allele (a)(iii), the second mutant allele is (b)(i) or (b)(ii), and wherein when the subject has a second mutant allele (b)(iii), the first mutant allele is (a)(i) or (a)(ii), and wherein the RIC pre-mRNA is transcribed from either the first mutant allele that is (a)(i) or (a)(ii), and/or the second allele that is (b)(i) or (b)(ii). In some embodiments, the target protein is produced in a form having reduced function compared to the equivalent wild-type protein. In some embodiments, the target protein is produced in a form that is fully-functional compared to the equivalent wild-type protein.

In some embodiments of any of the aforementioned methods, the targeted portion of the RIC pre-mRNA is in the retained intron within the region +6 relative to the 5' splice site of the retained intron to −16 relative to the 3' splice site of the retained intron. In some embodiments, the targeted portion of the RIC pre-mRNA is in the retained intron within: (a) the region +6 to +497 relative to the 5' splice site of the retained intron; or (b) the region −16 to −496 relative to the 3' splice site of the retained intron. In some embodiments, the targeted portion of the RIC pre-mRNA is within: (a) the region +2e to −4e in the exon flanking the 5' splice site of the retained intron; or (b) the region +2e to −4e in the exon flanking the 3' splice site of the retained intron. In some embodiments, the targeted portion of the RIC pre-mRNA is in the retained intron within: (a) the region −4e to −1,054e relative to the 5' splice site of the retained intron; (b) the region +6 to +499 relative to the 5' splice site of the retained intron; (c) the region −16 to −496 relative to the 3' splice site of the retained intron; or (d) the region +2e to +1,912e relative to the 3' splice site of the retained intron. In some embodiments, the target protein is PC-2.

In some embodiments of any of the aforementioned methods, the RIC pre-mRNA comprises a sequence with at least about 80%, 85%, 90%, 95%, 97%, or 100% sequence identity to SEQ ID NO: 5546. In some embodiments, the RIC pre-mRNA is encoded by a genetic sequence with at least about 80%, 85%, 90%, 95%, 97%, or 100% sequence identity to SEQ ID NO: 5545. In some embodiments, the targeted portion of the RIC pre-mRNA comprises a sequence with at least 80%, 85%, 90%, 95%, 97%, or 100% sequence identity to a region comprising at least 8 contiguous nucleic acids of SEQ ID NO: 5825. In some embodiments, the ASO comprises a sequence that is at least about 80%, 85%, 90%, 95%, 97%, or 100% complimentary to any one of SEQ ID NOs: 5547-5824. In some embodiments, the targeted portion of the RIC pre-mRNA is within the region −204e to +497 relative to the 5' splice site of the retained intron 5 or within the region −496 to +212e relative to the 3' splice site of the retained intron 5. In some embodiments, the ASO comprises a sequence that is at least about 80%, 85%, 90%, 95%, 97%, or 100% complimentary to any one of SEQ ID NOs: 5547-5824. In some embodiments, the targeted portion of the RIC pre-mRNA is in exon 5 within the region −204e to −4e relative to the 5' splice site of the retained intron 5. In some embodiments, the ASO comprises a sequence that is at least about 80%, 85%, 90%, 95%, 97%, or 100% complimentary to any one of SEQ ID NOs: 5547-5587. In some embodiments, the targeted portion of the RIC pre-mRNA is in retained intron 5 within the region +6 to +497 relative to the 5' splice site of the retained intron. In some embodiments, the ASO comprises a sequence that is at least about 80%, 85%, 90%, 95%, 97%, or 100% complimentary to any one of SEQ ID NOs: 5588-5684. In some embodiments, the targeted portion of the RIC pre-mRNA is in retained intron 5 within the region −16 to −496 relative to the 3' splice site of the retained intron. In some embodiments, the ASO comprises a sequence that is at least about 80%, 85%, 90%, 95%, 97%, or 100% complimentary to any one of SEQ ID NOs: 5685-5781. In some embodiments, the targeted portion of the RIC pre-mRNA is in exon 6 within the region +2e to +212e relative to the 3' splice site of the retained intron 5. In some embodiments, the ASO comprises a sequence that is at least about 80%, 85%, 90%, 95%, 97%, or 100% complimentary to any one of SEQ ID NOs: 238-280.

In some embodiments of any of the aforementioned methods, the antisense oligomer does not increase the amount of the target protein or the functional RNA by modulating alternative splicing of pre-mRNA transcribed from a gene encoding the functional RNA or target protein. In some embodiments, the antisense oligomer does not increase the amount of the target protein or the functional RNA by modulating aberrant splicing resulting from mutation of the gene encoding the target protein or the functional RNA. In some embodiments, the RIC pre-mRNA was produced by partial splicing of a full-length pre-mRNA or partial splicing of a wild-type pre-mRNA. In some embodiments, the mRNA encoding the target protein or functional RNA is a full-length mature mRNA, or a wild-type mature mRNA. In some embodiments, the target protein produced is full-length protein, or wild-type protein. In some embodiments, the total amount of the mRNA encoding the target protein or functional RNA produced in the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of the mRNA encoding the target protein or functional RNA produced in a control cell. In some embodiments, the total amount of target protein produced by the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of target protein produced by a control cell.

In some embodiments of any of the aforementioned methods, the antisense oligomer comprises a backbone modification comprising a phosphorothioate linkage or a phosphorodiamidate linkage. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, each sugar moiety is a modified sugar moiety. In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or 100%, complementary to the targeted portion of the RIC pre-mRNA encoding the protein.

In some embodiments of any of the aforementioned methods, the cell comprises a population of RIC pre-mRNAs transcribed from the gene encoding the target protein or functional RNA, wherein the population of RIC pre-mRNAs comprises at least one retained intron, and wherein the antisense oligomer binds to the most abundant retained intron in the population of RIC pre-mRNAs. In some embodiments, the binding of the antisense oligomer to the most abundant retained intron induces splicing out of the at least one retained intron from the population of RIC pre-mRNAs to produce mRNA encoding the target protein or functional RNA. In some embodiments, the cell comprises a population of RIC pre-mRNAs transcribed from the gene encoding the target protein or functional RNA, wherein the population of RIC pre-mRNAs comprises two or more retained introns, and wherein the antisense oligomer binds to the second most abundant retained intron in the population of RIC pre-mRNAs. In some embodiments, the binding of the antisense oligomer to the second most abundant retained intron induces splicing out of the two or more retained introns from the population of RIC pre-mRNAs to produce mRNA encoding the target protein or functional RNA. In some embodiments, the method further comprises assessing PC-2 protein expression.

In some embodiments of any of the aforementioned methods, the antisense oligomer binds to a targeted portion of a PKD2 RIC pre-mRNA, wherein the targeted portion is in a sequence selected from SEQ ID NOs: 5547-5824. In some embodiments, the subject is a human. In some embodiments, the subject is a non-human animal. In some embodiments, the subject is a fetus, an embryo, or a child. In some embodiments, the cells are ex vivo. In some embodiments, the antisense oligomer is administered by intraperitoneal injection, intramuscular injection, subcutaneous injection, or intravenous injection of the subject. In some embodiments, the 9 nucleotides at −3e to −1e of the exon flanking the 5' splice site and +1 to +6 of the retained intron, are identical to the corresponding wild-type sequence. In some embodiments, the 16 nucleotides at −15 to −1 of the retained intron and +1e of the exon flanking the 3' splice site are identical to the corresponding wild-type sequence. Disclosed herein, in some embodiments, are antisense oligomers as described in any of the aforementioned methods.

Disclosed herein, in some embodiments, are antisense oligomers comprising a sequence with at least about 80%, 85%, 90%, 95%, 97%, or 100% sequence identity to any one of SEQ ID NOs: 5547-5824.

Also disclosed herein, in some embodiments, are pharmaceutical compositions comprising any of the aforementioned antisense oligomers and an excipient.

Disclosed herein, in some embodiments, are methods of treating a subject in need thereof, by administering any of the aforementioned pharmaceutical compositions by intraperitoneal injection, intramuscular injection, subcutaneous injection, or intravenous injection.

Disclosed herein, in some embodiments, are compositions comprising an antisense oligomer for use in a method of increasing expression of a target protein or a functional RNA by cells to treat Polycystic Kidney Disease in a subject in need thereof, associated with a deficient protein or deficient functional RNA, wherein the deficient protein or deficient functional RNA is deficient in amount or activity in the subject, wherein the antisense oligomer enhances constitutive splicing of a retained intron-containing pre-mRNA (RIC pre-mRNA) encoding the target protein or the functional RNA, wherein the target protein is: (a) the deficient protein; or (b) a compensating protein which functionally augments or replaces the deficient protein or in the subject; and wherein the functional RNA is: (c) the deficient RNA; or (d) a compensating functional RNA which functionally augments or replaces the deficient functional RNA in the subject; wherein the RIC pre-mRNA comprises a retained intron, an exon flanking the 5' splice site and an exon flanking the 3' splice site, and wherein the retained intron is spliced from the RIC pre-mRNA encoding the target protein or the functional RNA, thereby increasing production or activity of the target protein or the functional RNA in the subject.

Disclosed herein, in some embodiments, are compositions comprising an antisense oligomer for use in a method of treating a condition associated with PC-2 protein in a subject in need thereof, the method comprising the step of increasing expression of PC-2 protein by cells of the subject, wherein the cells have a retained-intron-containing pre-mRNA (RIC pre-mRNA) comprising a retained intron, an exon flanking the 5' splice site of the retained intron, an exon flanking the 3' splice site of the retained intron, and wherein the RIC pre-mRNA encodes the PC-2 protein, the method comprising contacting the cells with the antisense oligomer, whereby the retained intron is constitutively spliced from the RIC pre-mRNA transcripts encoding PC-2 protein, thereby increasing the level of mRNA encoding the PC-2 protein, and increasing the expression of PC-2 protein, in the cells of the subject. In some embodiments, the condition is a disease or disorder. In some embodiments, the disease or disorder is Polycystic Kidney Disease. In some embodiments, the target protein and RIC pre-mRNA are encoded by the PKD2 gene.

In some embodiments of any of the aforementioned compositions, the antisense oligomer targets a portion of the RIC pre-mRNA that is in the retained intron within the region +6 relative to the 5' splice site of the retained intron to −16 relative to the 3' splice site of the retained intron. In some embodiments, the antisense oligomer targets a portion of the RIC pre-mRNA that is in the retained intron within: (a) the region +6 to +497 relative to the 5' splice site of the retained intron; or (b) the region −16 to −496 relative to the 3' splice site of the retained intron. In some embodiments, the antisense oligomer targets a portion of the RIC pre-mRNA that is within the region about 100 nucleotides downstream of the 5' splice site of the at least one retained intron, to about 100 nucleotides upstream of the 3' splice site of the at least one retained intron. In some embodiments, the targeted portion of the RIC pre-mRNA is within: (a) the region +2e to −4e in the exon flanking the 5' splice site of the retained intron; or (b) the region +2e to −4e in the exon flanking the 3' splice site of the retained intron. In some embodiments, the targeted portion of the RIC pre-mRNA is within: (a) the region −4e to −1,054e relative to the 5' splice site of the retained intron; (b) the region +6 to +499 relative to the 5' splice site of the retained intron; (c) the region −16 to −496 relative to the 3' splice site of the retained intron; or (d) the region +2e to +1,912e relative to the 3' splice site of the retained intron. In some embodiments, the target protein is PC-2. In some embodiments, the RIC pre-mRNA comprises a sequence with at least about 80%, 85%, 90%, 95%, 97%, or 100% sequence identity to SEQ ID NO: 5546. In some embodiments, the RIC pre-mRNA is encoded by a genetic sequence with at least about 80%, 85%, 90%, 95%, 97%, or 100% sequence identity to SEQ ID NO: 5545. In some embodiments, the targeted portion of the RIC pre-mRNA comprises a sequence with at least 80%, 85%, 90%, 95%, 97%, or 100% sequence identity to a region comprising at least 8 contiguous nucleic acids of SEQ ID NO: 5825. In some embodiments, the ASO comprises a sequence that is at least about 80%, 85%, 90%, 95%, 97%, or 100% complimentary to any one of SEQ ID NOs: 5547-5824. In some embodiments, the targeted portion of the RIC pre-mRNA is within the region −204e to +497 relative to the 5' splice site of the retained intron 5 or within the region −496 to +212e relative to the 3' splice site of the retained intron 5. In some embodiments, the ASO comprises a sequence that is at least about 80%, 85%, 90%, 95%, 97%, or 100% complimentary to any one of SEQ ID NOs: 5547-5824. In some embodiments, the targeted portion of the RIC pre-mRNA is in exon 5 within the region −204e to −4e relative to the 5' splice site of the retained intron 5. In some embodiments, the ASO comprises a sequence that is at least about 80%, 85%, 90%, 95%, 97%, or 100% complimentary to any one of SEQ ID NOs: 5547-5587. In some embodiments, the targeted portion of the RIC pre-mRNA is in retained intron 5 within the region +6 to +497 relative to the 5' splice site of the retained intron. In some embodiments, the ASO comprises a sequence that is at least about 80%, 85%, 90%, 95%, 97%, or 100% complimentary to any one of SEQ ID NOs:5588-5684. In some embodiments, the targeted portion of the RIC pre-mRNA is in retained intron 5 within the region −16 to −496 relative to the 3' splice site of the retained intron. In some embodiments, the ASO comprises a sequence that is at least about 80%, 85%, 90%, 95%, 97%, or 100% complimentary to any one of SEQ ID NOs: 5685-5781. In some embodiments, the targeted portion of the RIC pre-mRNA is in exon 6 within the region +2e to +212e relative to the 3' splice site of the retained intron 5. In some embodiments, the ASO comprises a sequence that is at least about 80%, 85%, 90%, 95%, 97%, or 100% complimentary to any one of SEQ ID NOs: 5782-5824.

In some embodiments of any of the aforementioned compositions, the antisense oligomer does not increase the amount of target protein or functional RNA by modulating alternative splicing of the pre-mRNA transcribed from a gene encoding the target protein or functional RNA. In some embodiments, the antisense oligomer does not increase the amount of the functional RNA or functional protein by modulating aberrant splicing resulting from mutation of the gene encoding the target protein or functional RNA. In some embodiments, the RIC pre-mRNA was produced by partial splicing from a full-length pre-mRNA or a wild-type pre-mRNA. In some embodiments, the mRNA encoding the target protein or functional RNA is a full-length mature mRNA, or a wild-type mature mRNA. In some embodiments, the target protein produced is full-length protein, or wild-type protein. In some embodiments, the retained intron is a rate-limiting intron. In some embodiments, the retained intron is the most abundant retained intron in said RIC pre-mRNA. In some embodiments, the retained intron is the second most abundant retained intron in said RIC pre-mRNA.

In some embodiments of any of the aforementioned compositions, the antisense oligomer comprises a backbone modification comprising a phosphorothioate linkage or a phosphorodiamidate linkage. In some embodiments, the antisense oligomer is an antisense oligonucleotide. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, each sugar moiety is a modified sugar moiety. In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

Disclosed herein, in some embodiments, are pharmaceutical compositions comprising any of the aforementioned antisense oligomers and an excipient. Disclosed herein, in some embodiments, are methods of treating a subject in need thereof, by administering the aforementioned pharmaceutical compositions by intraperitoneal injection, intramuscular injection, subcutaneous injection, or intravenous injection.

Disclosed herein, in some embodiments, are pharmaceutical compositions comprising: an antisense oligomer that hybridizes to a target sequence of a deficient PKD2 mRNA transcript, wherein the deficient PKD2 mRNA transcript comprises a retained intron, wherein the antisense oligomer induces splicing out of the retained intron from the deficient PKD2 mRNA transcript; and a pharmaceutical acceptable excipient. In some embodiments, the deficient PKD2 mRNA transcript is a PKD2 RIC pre-mRNA transcript. In some embodiments, the targeted portion of the PKD2 RIC pre-mRNA transcript is in the retained intron within the region +500 relative to the 5' splice site of the retained intron to −500 relative to the 3' spliced site of the retained intron. In some embodiments, the PKD2 RIC pre-mRNA transcript is encoded by a genetic sequence with at least about 80%, 85%, 90%, 95%, 96%, 97%, 98%, 99% or 100% sequence identity to SEQ ID NO: 5545. In some embodiments, the PKD2 RIC pre-mRNA transcript comprises a sequence with at least about 80%, 85%, 90%, 95%, 96%, 97%, 98%, 99% or 100% sequence identity to SEQ ID NO: 5546. In some embodiments, the antisense oligomer comprises a backbone modification comprising a phosphorothioate linkage or a phosphorodiamidate linkage. In some embodiments, the antisense oligomer is an antisense oligonucleotide. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, the antisense oligomer comprises from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or is 100% complementary to a targeted portion of the PKD2 RIC pre-mRNA transcript. In some embodiments, the targeted portion of the PKD2 RIC pre-mRNA transcript is within SEQ ID NO: 5825. In some embodiments, the antisense oligomer comprises a nucleotide sequence that is at least about 80%, 85%, 90%, 91%, 92%, 93%, 94%, 95%, 96%, 97%, 98%, or 99% sequence identity to any one of SEQ ID NOs: 5547-5824. In some embodiments, the antisense oligomer comprises a nucleotide sequence selected from SEQ ID NOs: 5547-5824. In some embodiments, the pharmaceutical composition is formulated for intrathecal injection, intracerebroventricular injection, intraperitoneal injection, intramuscular injection, subcutaneous injection, or intravenous injection.

Disclosed herein, in some embodiments, are methods of inducing processing of a deficient PKD2 mRNA transcript to facilitate removal of a retained intron to produce a fully processed PKD2 mRNA transcript that encodes a functional form of a PC-2 protein, the method comprising: (a) contacting an antisense oligomer to a target cell of a subject; (b) hybridizing the antisense oligomer to the deficient PKD2 mRNA transcript, wherein the deficient PKD2 mRNA transcript is capable of encoding the functional form of a PC-2 protein and comprises at least one retained intron; (c) removing the at least one retained intron from the deficient PKD2 mRNA transcript to produce the fully processed PKD2 mRNA transcript that encodes the functional form of PC-2 protein; and (d) translating the functional form of PC-2 protein from the fully processed PKD2 mRNA transcript. In some embodiments, the retained intron is an entire retained intron. In some embodiments, the deficient PKD2 mRNA transcript is a PKD2 pre-mRNA transcript.

Disclosed herein, in some embodiments, are methods of treating a subject having a condition caused by a deficient amount or activity of PC-2 protein comprising administering to the subject an antisense oligomer comprising a nucleotide sequence with at least about 80%, 85%, 90%, 91%, 92%, 93%, 94%, 95%, 96%, 97%, 98%, or 99% sequence identity to any one of SEQ ID NOs: 5547-5824.

Disclosed herein, in some embodiments, are methods of treating Retinitis Pigmentosa 18 (RP18) or Retinitis Pigmentosa 13 (RP13) in a subject in need thereof, by increasing the expression of a target protein or functional RNA by cells of the subject, wherein the cells have a retained-intron-containing pre-mRNA (RIC pre-mRNA), the RIC pre-mRNA comprising a retained intron, an exon flanking the 5' splice site, an exon flanking the 3' splice site, and wherein the RIC pre-mRNA encodes the target protein or functional RNA, the method comprising contacting the cells of the subject with an antisense oligomer (ASO) complementary to a targeted portion of the RIC pre-mRNA encoding the target protein or functional RNA, whereby the retained intron is constitutively spliced from the RIC pre-mRNA encoding the target protein or functional RNA, thereby increasing the level of mRNA encoding the target protein or functional RNA, and increasing the expression of the target protein or functional RNA in the cells of the subject.

Also disclosed herein are methods of increasing expression of a target protein, wherein the target protein is PRPF3 or PRPF8, by cells having a retained-intron-containing pre-mRNA (RIC pre-mRNA), the RIC pre-mRNA comprising a retained intron, an exon flanking the 5' splice site of the retained intron, an exon flanking the 3' splice site of the retained intron, and wherein the RIC pre-mRNA encodes PRPF3 or PRPF8protein, the method comprising contacting the cells with an antisense oligomer (ASO) complementary to a targeted portion of the RIC pre-mRNA encoding PRPF3 or PRPF8 protein, whereby the retained intron is constitutively spliced from the RIC pre-mRNA encoding PRPF3 or PRPF8 protein, thereby increasing the level of mRNA encoding PRPF3 or PRPF8 protein, and increasing the expression of PRPF3 or PRPF8 protein in the cells.

In some embodiments of any of the aforementioned methods, when the method is a method of treating RP18 the target protein is PRPF3. In some embodiments of any of the aforementioned methods, when the method is a method of treating RP13 the target protein is PRPF8. In some embodiments, the target protein or the functional RNA is a compensating protein or a compensating functional RNA that functionally augments or replaces a target protein or functional RNA that is deficient in amount or activity in the subject. In some embodiments, the cells are in or from a subject having a condition caused by a deficient amount or activity of PRPF3 or PRPF8 protein.

In some embodiments of any of the aforementioned methods, the deficient amount of the target protein is caused by haploinsufficiency of the target protein, wherein the subject has a first allele encoding a functional target protein, and a second allele from which the target protein is not produced, or a second allele encoding a nonfunctional target protein, and wherein the antisense oligomer binds to a targeted portion of a RIC pre-mRNA transcribed from the first allele. In some embodiments, the subject has a condition caused by a disorder resulting from a deficiency in the amount or function of the target protein, wherein the subject has (a) a first mutant allele from which (i) the target protein is produced at a reduced level compared to production from a wild-type allele, (ii) the target protein is produced in a form having reduced function compared to an equivalent wild-type protein, or (iii) the target protein is not produced, and (b) a second mutant allele from which (i) the target protein is produced at a reduced level compared to production from a wild-type allele, (ii) the target protein is produced in a form having reduced function compared to an equivalent wild-type protein, or (iii) the target protein is not produced, and wherein when the subject has a first mutant allele a(iii), the second mutant allele is b(i) or b(ii), and wherein when the subject has a second mutant allele b(iii), the first mutant allele is a(i) or a(ii), and wherein the RIC pre-mRNA is transcribed from either the first mutant allele that is a(i) or a(ii), and/or the second allele that is b(i) or b(ii). In some embodiments, the target protein is produced in a form having reduced function compared to the equivalent wild-type protein. In some embodiments, the target protein is produced in a form that is fully-functional compared to the equivalent wild-type protein.

In some embodiments of any of the aforementioned methods, the targeted portion of the RIC pre-mRNA is in the retained intron within the region +6 relative to the 5' splice site of the retained intron to −16 relative to the 3' splice site of the retained intron. In some embodiments, the targeted portion of the RIC pre-mRNA is in the retained intron within the region +498 relative to the 5' splice site of the retained intron to −496 relative to the 3' splice site of the retained intron. In some embodiments, the targeted portion of the RIC pre-mRNA is in the retained intron within the region +498 relative to the 5' splice site of the retained intron to −496 relative to the 3' splice site of the retained intron.

In some embodiments of any of the aforementioned methods, the target protein is PRPF3. In some embodiments, the targeted portion of the RIC pre-mRNA comprises a sequence that is at least about 80%, 85%, 90%, 95%, 97%, or 100% complimentary to any one of SEQ ID NOs 5830-6148. In some embodiments, the in the targeted portion of the RIC pre-mRNA comprises a sequence with at least 80%, 85%, 90%, 95%, 97%, or 100% sequence identity to a region comprising at least 8 contiguous nucleic acids of SEQ ID NO 6272 or SEQ ID NO 6271. In some embodiments, the ASO comprises a sequence with at least about 80%, 85%, 90%, 95%, 97%, or 100% sequence identity to any one of SEQ ID NOs 5830-6148. In some embodiments, the RIC pre-mRNA comprises a sequence with at least about 80%, 85%, 90%, 95%, 97%, or 100% sequence identity to SEQ ID NO 5828. In some embodiments, the RIC pre-mRNA is encoded by a genetic sequence with at least about 80%, 85%, 90%, 95%, 97%, or 100% sequence identity to SEQ ID NO 5826.

In some embodiments, the target protein is PRPF8. In some embodiments, the targeted portion of the RIC pre-mRNA is in the retained intron within the region +156 relative to the 5' splice site of the retained intron to −156 relative to the 3' splice site of the retained intron. In some embodiments, the targeted portion of the RIC pre-mRNA comprises a sequence that is at least about 80%, 85%, 90%, 95%, 97%, or 100% complimentary to any one of SEQ ID NOs 6149-6270. In some embodiments, the targeted portion of the RIC pre-mRNA comprises a sequence with at least 80%, 85%, 90%, 95%, 97%, or 100% sequence identity to a region comprising at least 8 contiguous nucleic acids of SEQ ID NO 6273. In some embodiments, the ASO comprises a sequence with at least about 80%, 85%, 90%, 95%, 97%, or 100% sequence identity to any one of SEQ ID NOs 6149-6270. In some embodiments, the RIC pre-mRNA comprises a sequence with at least about 80%, 85%, 90%, 95%, 97%, or 100% sequence identity to SEQ ID NO 5829. In some embodiments, the RIC pre-mRNA is encoded by a genetic sequence with at least about 80%, 85%, 90%, 95%, 97%, or 100% sequence identity to SEQ ID NO 5827.

In some embodiments of any of the aforementioned methods, the targeted portion of the RIC pre-mRNA is in the retained intron within: (a) the region +6 to +100 relative to the 5' splice site of the retained intron; or (b) the region −16 tTable 6o −100 relative to the 3' splice site of the retained intron. In some embodiments, the antisense oligomer targets a portion of the RIC pre-mRNA that is within the region about 100 nucleotides downstream of the 5' splice site of the at least one retained intron, to about 100 nucleotides upstream of the 3' splice site of the at least one retained intron. In some embodiments, the targeted portion of the RIC pre-mRNA is the retained intron within the: (a) the region +2e to −4e in the exon flanking the 5' splice site of the retained intron; or (b) the region +2e to −4e in the exon flanking the 3' splice site of the retained intron.

In some embodiments of any of the aforementioned methods, the antisense oligomer does not increase the amount of the target protein or the functional RNA by modulating alternative splicing of pre-mRNA transcribed from a gene encoding the functional RNA or target protein. In some embodiments, the antisense oligomer does not increase the amount of the target protein or the functional RNA by modulating aberrant splicing resulting from mutation of the gene encoding the target protein or the functional RNA. In some embodiments, the RIC pre-mRNA was produced by partial splicing of a full-length pre-mRNA or partial splicing of a wild-type pre-mRNA. In some embodiments, the mRNA encoding the target protein or functional RNA is a full-length mature mRNA, or a wild-type mature mRNA. In some embodiments, the target protein produced is full-length protein, or wild-type protein. In some embodiments, the total amount of the mRNA encoding the target protein or functional RNA produced in the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of the mRNA encoding the target protein or functional RNA produced in a control cell. In some embodiments, the total amount of target protein produced by the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of target protein produced by a control cell.

In some embodiments of any of the aforementioned methods, the antisense oligomer comprises a backbone modification comprising a phosphorothioate linkage or a phosphorodiamidate linkage. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, each sugar moiety is a modified sugar moiety. In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or 100%, complementary to the targeted portion of the RIC pre-mRNA encoding the protein.

In some embodiments of any of the aforementioned methods, the cell comprises a population of RIC pre-mRNAs transcribed from the gene encoding the target protein or functional RNA, wherein the population of RIC pre-mRNAs comprises two or more retained introns, and wherein the antisense oligomer binds to the most abundant retained intron in the population of RIC pre-mRNAs. In some embodiments, the binding of the antisense oligomer to the most abundant retained intron induces splicing out of the two or more retained introns from the population of RIC pre-mRNAs to produce mRNA encoding the target protein or functional RNA. In some embodiments, the cell comprises a population of RIC pre-mRNAs transcribed from the gene encoding the target protein or functional RNA, wherein the population of RIC pre-mRNAs comprises two or more retained introns, and wherein the antisense oligomer binds to the second most abundant retained intron in the population of RIC pre-mRNAs. In some embodiments, the binding of the antisense oligomer to the second most abundant retained intron induces splicing out of the two or more retained introns from the population of RIC pre-mRNAs to produce mRNA encoding the target protein or functional RNA. In some embodiments, the condition is a disease or disorder. In some embodiments, the disease or disorder is RP18 or RP13. In some embodiments, the target protein and the RIC pre-mRNA are encoded by the PRPF3 gene or PRPF8 gene. In some embodiments, the method further comprises assessing protein expression. In some embodiments, the subject is a human. In some embodiments, the subject is a non-human animal. In some embodiments, the subject is a fetus, an embryo, or a child. In some embodiments, the cells are ex vivo. In some embodiments, the antisense oligomer is administered by intravitreal injection, subretinal injection, topical application, implantation, intraperitoneal injection, intramuscular injection, subcutaneous injection, or intravenous injection of the subject. In some embodiments, the 9 nucleotides at −3e to −1e of the exon flanking the 5' splice site and +1 to +6 of the retained intron, are identical to the corresponding wild-type sequence. In some embodiments, the 16 nucleotides at −15 to −1 of the retained intron and +1e of the exon flanking the 3' splice site are identical to the corresponding wild-type sequence.

Disclosed herein, in some embodiments, are antisense oligomers as used in the methods described herein. In some embodiments, the antisense oligomer comprises a sequence with at least about 80%, 85%, 90%, 95%, 97%, or 100% sequence identity to any one of SEQ ID NOs 5830-6270.

Also disclosed herein, in some embodiments, are pharmaceutical compositions comprising any of the aforementioned antisense oligomers and an excipient.

Disclosed herein, in some embodiments, are methods of treating a subject in need thereof, by administering any of the aforementioned pharmaceutical compositions by intravitreal injection, subretinal injection, topical application, implantation, intraperitoneal injection, intramuscular injection, subcutaneous injection, or intravenous injection.

Disclosed herein, in some embodiments, are compositions comprising an antisense oligomer for use in a method of increasing expression of a target protein or a functional RNA by cells to treat RP18 or RP13 in a subject in need thereof, associated with a deficient protein or deficient functional RNA, wherein the deficient protein or deficient functional RNA is deficient in amount or activity in the subject, wherein the antisense oligomer enhances constitutive splicing of a retained intron-containing pre-mRNA (RIC pre-mRNA) encoding the target protein or the functional RNA, wherein the target protein is: the deficient protein; or a compensating protein which functionally augments or replaces the deficient protein or in the subject; and wherein the function RNA is: the deficient RNA; or a compensating functional RNA which functionally augments or replaces the deficient functional RNA in the subject; wherein the RIC pre-mRNA comprises a retained intron, an exon flanking the 5' splice site and an exon flanking the 3' splice site, and wherein the retained intron is spliced from the RIC pre-mRNA encoding the target protein or the functional RNA, thereby increasing production or activity of the target protein or the functional RNA in the subject.

Disclosed herein, in some embodiments, are compositions comprising an antisense oligomer for use in a method of treating a condition associated with PRPF3 or PRPF8 protein in a subject in need thereof, the method comprising the step of increasing expression of PRPF3 or PRPF8 protein by cells of the subject, wherein the cells have a retained-intron-containing pre-mRNA (RIC pre-mRNA) comprising a retained intron, an exon flanking the 5' splice site of the retained intron, an exon flanking the 3' splice site of the retained intron, and wherein the RIC pre-mRNA encodes the PRPF3 or PRPF8 protein, the method comprising contacting the cells with the antisense oligomer, whereby the retained intron is constitutively spliced from the RIC pre-mRNA transcripts encoding PRPF3 or PRPF8 protein, thereby increasing the level of mRNA encoding PRPF3 or PRPF8 protein, and increasing the expression of PRPF3 or PRPF8 protein, in the cells of the subject. In some embodiments, the target protein PRPF3 is encoded by the sequence at NM_004698 or PRPF8 or encoded by the sequence at NM_006445. In some embodiments, the condition is a disease or disorder. In some embodiments, the disease or disorder is RP18 or RP13. In some embodiments, the target protein and RIC pre-mRNA are encoded by the PRPF3 or PRPF8 gene. In some embodiments, the antisense oligomer targets a portion of the RIC pre-mRNA that is in the retained intron within the region +6 relative to the 5' splice site of the retained intron to −16 relative to the 3' splice site of the retained intron. In some embodiments, the targeted portion of the RIC pre-mRNA is in the retained intron within the region +498 relative to the 5' splice site of the retained intron to −496 relative to the 3' splice site of the retained intron. In some embodiments, the target protein in PRPF3. In some embodiments, the targeted portion of the RIC pre-mRNA is in the retained intron within the region +498 relative to the 5' splice site of the retained intron to −496 relative to the 3' splice site of the retained intron. In some embodiments, the targeted portion of the RIC pre-mRNA comprises a sequence that is at least about 80%, 85%, 90%, 95%, 97%, or 100% complimentary to any one of SEQ ID NOs 5830-6148. In some embodiments, the targeted portion of the RIC pre-mRNA comprises a sequence with at least 80%, 85%, 90%, 95%, 97%, or 100% sequence identity to a region comprising at least 8 contiguous nucleic acids of SEQ ID NO 6272 or SEQ ID NO 6271. In some embodiments, the ASO comprises a sequence with at least about 80%, 85%, 90%, 95%, 97%, or 100% sequence identity to any one of SEQ ID NOs 5830-6148. In some embodiments, the RIC pre-mRNA comprises a sequence with at least about 80%, 85%, 90%, 95%, 97%, or 100% sequence identity to SEQ ID NO 5828. In some embodiments, the RIC pre-mRNA is encoded by a genetic sequence with at least about 80%, 85%, 90%, 95%, 97%, or 100% sequence identity to SEQ ID NO 5826. In some embodiments, the target protein is PRPF8. In some embodiments, the targeted portion of the RIC pre-mRNA is in the retained intron within the region +156 relative to the 5' splice site of the retained intron to −156 relative to the 3' splice site of the retained intron. In some embodiments, the targeted portion of the RIC pre-mRNA comprises a sequence that is at least about 80%, 85%, 90%, 95%, 97%, or 100% complimentary to any one of SEQ ID NOs 6149-6270. In some embodiments, the targeted portion of the RIC pre-mRNA comprises a sequence with at least 80%, 85%, 90%, 95%, 97%, or 100% sequence identity to a region comprising at least 8 contiguous nucleic acids of SEQ ID NO 6273. In some embodiments, the ASO comprises a sequence with at least about 80%, 85%, 90%, 95%, 97%, or 100% sequence identity to any one of SEQ ID NOs 6149-6270. In some embodiments, the RIC pre-mRNA comprises a sequence with at least about 80%, 85%, 90%, 95%, 97%, or 100% sequence identity to SEQ ID NO 5829. In some embodiments, the RIC premRNA is encoded by a genetic sequence with at least about 80%, 85%, 90%, 95%, 97%, or 100% sequence identity to SEQ ID NO 5827. In some embodiments, the antisense oligomer targets a portion of the RIC pre-mRNA that is in the retained intron within: (a) the region +6 to +100 relative to the 5' splice site of the retained intron; or (b) the region −16 to −100 relative to the 3' splice site of the retained intron. In some embodiments, the antisense oligomer targets a portion of the RIC pre-mRNA that is within the region about 100 nucleotides downstream of the 5' splice site of the at least one retained intron, to about 100 nucleotides upstream of the 3' splice site of the at least one retained intron. In some embodiments, the targeted portion of the RIC pre-mRNA is within: (a) the region +2e to −4e in the exon flanking the 5' splice site of the retained intron; or (b) the region +2e to −4e in the exon flanking the 3' splice site of the retained intron.

In some embodiments of any of the aforementioned compositions, the antisense oligomer does not increase the amount of target protein or functional RNA by modulating alternative splicing of the pre-mRNA transcribed from a gene encoding the target protein or functional RNA. In some embodiments, the antisense oligomer does not increase the amount of the functional RNA or functional protein by modulating aberrant splicing resulting from mutation of the gene encoding the target protein or functional RNA. In some embodiments, the RIC pre-mRNA was produced by partial splicing from a full-length pre-mRNA or a wild-type pre-mRNA. In some embodiments, the mRNA encoding the target protein or functional RNA is a full-length mature mRNA, or a wild-type mature mRNA. In some embodiments, the target protein produced is full-length protein, or wild-type protein. In some embodiments, the retained intron is a rate-limiting intron. In some embodiments, the retained intron is the most abundant retained intron in the RIC pre-mRNA. In some embodiments, the retained intron is the second most abundant retained intron in the RIC pre-mRNA.

In some embodiments of any of the aforementioned compositions, the antisense oligomer comprises a backbone modification comprising a phosphorothioate linkage or a phosphorodiamidate linkage. In some embodiments, the antisense oligomer is an antisense oligonucleotide. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, each sugar moiety is a modified sugar moiety. In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, n the antisense oligomer is at least 80%, at least 85%, at least 90%, at least 95%, at least 98%, at least 99%, or is 100% complementary to the targeted portion of the RIC pre-mRNA encoding the protein.

Disclosed herein, in some embodiments, are pharmaceutical compositions comprising the antisense oligomer of any of the aforementioned compositions and an excipient.

Disclosed herein, in some embodiments, are methods of treating a subject in need thereof, by administering any of the aforementioned pharmaceutical compositions by intravitreal injection, subretinal injection, topical application, implantation, intraperitoneal injection, intramuscular injection, subcutaneous injection, or intravenous injection of the subject.

Disclosed herein, in some embodiments, are pharmaceutical compositions comprising: an antisense oligomer that hybridizes to a target sequence of a deficient PRPF3 mRNA transcript, wherein the deficient PRPF3 mRNA transcript comprises a retained intron, wherein the antisense oligomer induces splicing out of the retained intron from the deficient PRPF3 mRNA transcript; and a pharmaceutical acceptable excipient. In some embodiments, the deficient PRPF3 mRNA transcript is a PRPF3 RIC pre-mRNA transcript. In some embodiments, the targeted portion of the PRPF3 RIC pre-mRNA transcript is in the retained intron within the region +500 relative to the 5' splice site of the retained intron to −500 relative to the 3' spliced site of the retained intron. In some embodiments, the PRPF3 RIC pre-mRNA transcript is encoded by a genetic sequence with at least about 80%, 85%, 90%, 95%, 96%, 97%, 98%, 99% or 100% sequence identity to SEQ ID NO: 5826. In some embodiments, the PRPF3 RIC pre-mRNA transcript comprises a sequence with at least about 80%, 85%, 90%, 95%, 96%, 97%, 98%, 99% or 100% sequence identity to any one of SEQ ID NOs: 5828-5829. In some embodiments, the antisense oligomer comprises a backbone modification comprising a phosphorothioate linkage or a phosphorodiamidate linkage. In some embodiments, the antisense oligomer is an antisense oligonucleotide. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, the antisense oligomer comprises from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or is 100% complementary to a targeted portion of the PRPF3 RIC pre-mRNA transcript. In some embodiments, the targeted portion of the PRPF3 RIC pre-mRNA transcript is within a sequence selected from SEQ ID NOs: 6271-6272. In some embodiments, the antisense oligomer comprises a nucleotide sequence that is at least about 80%, 85%, 90%, 91%, 92%, 93%, 94%, 95%, 96%, 97%, 98%, or 99% sequence identity to any one of SEQ ID NOs: 5830-6148. In some embodiments, the antisense oligomer comprises a nucleotide sequence selected from SEQ ID NOs: 5830-6148. In some embodiments, the pharmaceutical composition is formulated for intrathecal injection, intracerebroventricular injection, intraperitoneal injection, intramuscular injection, subcutaneous injection, or intravenous injection.

Disclosed herein, in some embodiments, are pharmaceutical compositions comprising: an antisense oligomer that hybridizes to a target sequence of a deficient PRPF8 mRNA transcript, wherein the deficient PRPF8 mRNA transcript comprises a retained intron, wherein the antisense oligomer induces splicing out of the retained intron from the deficient PRPF8 mRNA transcript; and a pharmaceutical acceptable excipient. In some embodiments, the deficient PRPF8 mRNA transcript is a PRPF8 RIC pre-mRNA transcript. In some embodiments, the targeted portion of the PRPF8 RIC pre-mRNA transcript is in the retained intron within the region +500 relative to the 5' splice site of the retained intron to −500 relative to the 3' spliced site of the retained intron. In some embodiments, the PRPF8 RIC pre-mRNA transcript is encoded by a genetic sequence with at least about 80%, 85%, 90%, 95%, 96%, 97%, 98%, 99% or 100% sequence identity to SEQ ID NO: 5827. In some embodiments, the PRPF8 RIC pre-mRNA transcript comprises a sequence with at least about 80%, 85%, 90%, 95%, 96%, 97%, 98%, 99% or 100% sequence identity to any one of SEQ ID NOs: 5828-5829. In some embodiments, the antisense oligomer comprises a backbone modification comprising a phosphorothioate linkage or a phosphorodiamidate linkage. In some embodiments, the antisense oligomer is an antisense oligonucleotide. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, the antisense oligomer comprises from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or is 100% complementary to a targeted portion of the PRPF8 RIC pre-mRNA transcript. In some embodiments, the targeted portion of the PRPF8 RIC pre-mRNA transcript is within a sequence selected from SEQ ID NOs: 6273. In some embodiments, the antisense oligomer comprises a nucleotide sequence that is at least about 80%, 85%, 90%, 91%, 92%, 93%, 94%, 95%, 96%, 97%, 98%, or 99% sequence identity to any one of SEQ ID NOs: 6149-6270. In some embodiments, the antisense oligomer comprises a nucleotide sequence selected from SEQ ID NOs: 6149-6270. In some embodiments, the pharmaceutical composition is formulated for intravitreal injection, subretinal injection, topical application, implantation, intraperitoneal injection, intramuscular injection, subcutaneous injection, or intravenous injection.

Disclosed herein, in some embodiments, are methods of inducing processing of a deficient PRPF3 mRNA transcript to facilitate removal of a retained intron to produce a fully processed PRPF3 mRNA transcript that encodes a functional form of a PRPF3 protein, the method comprising: (a) contacting an antisense oligomer to a target cell of a subject; (b) hybridizing the antisense oligomer to the deficient PRPF3 mRNA transcript, wherein the deficient PRPF3 mRNA transcript is capable of encoding the functional form of a PRPF3 protein and comprises at least one retained intron; (c) removing the at least one retained intron from the deficient PRPF3 mRNA transcript to produce the fully processed PRPF3 mRNA transcript that encodes the functional form of PRPF3 protein; and (d) translating the functional form of PRPF3 protein from the fully processed PRPF3 mRNA transcript. In some embodiments, the retained intron is an entire retained intron. In some embodiments, the deficient PRPF3 mRNA transcript is a PRPF3 RIC pre-mRNA transcript.

Disclosed herein, in some embodiments, are methods of treating a subject having a condition caused by a deficient amount or activity of PRPF3 protein comprising administering to the subject an antisense oligomer comprising a nucleotide sequence with at least about 80%, 85%, 90%, 91%, 92%, 93%, 94%, 95%, 96%, 97%, 98%, or 99% sequence identity to any one of SEQ ID NOs: 5830-6148.

Disclosed herein, in some embodiments, are methods of inducing processing of a deficient PRPF8 mRNA transcript to facilitate removal of a retained intron to produce a fully processed PRPF8 mRNA transcript that encodes a functional form of a PRPF8 protein, the method comprising: (a) contacting an antisense oligomer to a target cell of a subject; (b) hybridizing the antisense oligomer to the deficient PRPF8 mRNA transcript, wherein the deficient PRPF8 mRNA transcript is capable of encoding the functional form of a PRPF8 protein and comprises at least one retained intron; (c) removing the at least one retained intron from the deficient PRPF8 mRNA transcript to produce the fully processed PRPF8 mRNA transcript that encodes the functional form of PRPF8 protein; and (d) translating the functional form of PRPF8 protein from the fully processed PRPF8 mRNA transcript. In some embodiments, the retained intron is an entire retained intron. In some embodiments, the deficient PRPF8 mRNA transcript is a PRPF8 RIC pre-mRNA transcript.

Disclosed herein, in some embodiments, are methods of treating a subject having a condition caused by a deficient amount or activity of PRPF8 protein comprising administering to the subject an antisense oligomer comprising a nucleotide sequence with at least about 80%, 85%, 90%, 91%, 92%, 93%, 94%, 95%, 96%, 97%, 98%, or 99% sequence identity to any one of SEQ ID NOs: 6149-6270.

The invention provides compositions and methods for treating a central nervous system (CNS) disease or conditions, including antisense oligomers (ASOs) that promote constitutive splicing at intron splice sites of a retained-intron-containing pre-mRNA (RIC pre-mRNA) encoding a gene product that is deficient in the central nervous system disease or condition. The invention further provides compositions and methods for increasing production of mature mRNA encoding a gene product, wherein either the gene product is deficient in a CNS disease or condition, or wherein increased expression of the gene product could provide benefit in a subject having a CNS disease or condition. Increasing the production of the mature mRNA results in increased production of the encoded protein in cells of a subject in need thereof, for example, any subject that can benefit from increased production of the gene product. The described methods may be used to treat subjects having a CNS disease or condition caused by a gene mutation(s), including missense, splicing, frameshift and nonsense mutations, as well as whole gene deletions that result in deficient protein production.

Disclosed herein, in certain embodiments, is a method of treating a CNS disease in a subject in need thereof by increasing the expression of a target protein or functional RNA by cells of the subject, wherein the cells have a retained-intron-containing pre-mRNA (RIC pre-mRNA), the RIC pre-mRNA comprising a retained intron, an exon flanking the 5' splice site, an exon flanking the 3' splice site, and wherein the RIC pre-mRNA encodes the target protein or functional RNA, the method comprising contacting the cells of the subject with an antisense oligomer (ASO) complementary to a targeted portion of the RIC pre-mRNA encoding the target protein or functional RNA, whereby the retained intron is constitutively spliced from the RIC pre-mRNA encoding the target protein or functional RNA, thereby increasing the level of mRNA encoding the target protein or functional RNA, and increasing the expression of the target protein or functional RNA in the cells of the subject. In some embodiments, the CNS disease is Familial hemiplegic migraine-2, Familial Basilar migraine, Alternating hemiplegia of childhood, Episodic ataxia type 2, Familial hemiplegic migraine, Spinocerebellar ataxia type 6, Mental retardation-23, 3p25 microdeletion syndrome, Phelan-McDermid syndrome, Schizophrenia-15, Neurofibromatosis, type 2, Meningioma, NF2-related, Schwannomatosis 1, Hereditary sensory neuropathy type IE, Autosomal dominant cerebellar ataxia, deafness, and narcolepsy, Pitt-hopkins syndrome, Smith-magenis syndrome, peroxisome biogenesis disorder 1a, Heimler syndrome-1, Metachromatic Leukodystrophy, Leukoencephalopathy with vanishing white matter, Niemann-Pick disease type C1 and Niemann-Pick disease type D, Aicardi-Goutieres syndrome-6, early infantile epileptic encephalopathy-4, progressive myoclonic epilepsy 5, familial infantile convulsion with paroxysmal choreoathetosis, episodic kinesigenic dyskinesia 1, benign familial infantile seizuers-2, or generalized Epilepsy with febrile seizures plus type 9. In some embodiments, also described herein is a method of increasing expression of a target protein, wherein the target protein is ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, MFSD8, IDUA, or STX1B expression by improving splicing efficiency of ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, MFSD8, IDUA, or STX1B, by cells having a retained-intron-containing pre-mRNA (RIC pre-mRNA), the RIC pre-mRNA comprising a retained intron, an exon flanking the 5' splice site of the retained intron, an exon flanking the 3' splice site of the retained intron, and wherein the RIC pre-mRNA encodes ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, MFSD8, IDUA, or STX1B expression by improving splicing efficiency of ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, MFSD8, IDUA, or STX1B protein, the method comprising contacting the cells with an antisense oligomer (ASO) complementary to a targeted portion of the RIC pre-mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, MFSD8, IDUA, or STX1B expression by improving splicing efficiency of ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, MFSD8, IDUA, or STX1B protein, whereby the retained intron is constitutively spliced from the RIC pre-mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, MFSD8, IDUA, or STX1B expression by improving splicing efficiency of ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, MFSD8, IDUA, or STX1B protein, thereby increasing the level of mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, MFSD8, IDUA, or STX1B protein, and increasing the expression of ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, MFSD8, IDUA, or STX1B expression by improving splicing efficiency of ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, MFSD8, IDUA, or STX1B protein in the cells. In some embodiments, the target protein is ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B. In some embodiments, the target protein is ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B. In some embodiments, the target protein or the functional RNA is a compensating protein or a compensating functional RNA that functionally augments or replaces a target protein or functional RNA that is deficient in amount or activity in the subject. In some embodiments, the cells are in or from a subject having a condition caused by a deficient amount or activity of ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B protein. In some embodiments, the cells are in or from a subject having a condition caused by a deficient amount or activity of ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B protein. In some embodiments, the deficient amount of the target protein is caused by haploinsufficiency of the target protein, wherein the subject has a first allele encoding a functional target protein, and a second allele from which the target protein is not produced, or a second allele encoding a nonfunctional target protein, and wherein the antisense oligomer binds to a targeted portion of a RIC pre-mRNA transcribed from the first allele. In some embodiments, the subject has a condition caused by a disorder resulting from a deficiency in the amount or function of the target protein, wherein the subject has (a) a first mutant allele from which (i) the target protein is produced at a reduced level compared to production from a wild-type allele, (ii) the target protein is produced in a form having reduced function compared to an equivalent wild-type protein, or (iii) the target protein is not produced, and (b) a second mutant allele from which (i) the target protein is produced at a reduced level compared to production from a wild-type allele, (ii) the target protein is produced in a form having reduced function compared to an equivalent wild-type protein, or (iii) the target protein is not produced, and wherein when the subject has a first mutant allele a(iii), the second mutant allele is b(i) or b(ii), and wherein when the subject has a second mutant allele b(iii), the first mutant allele is a(i) or a(ii), and wherein the RIC pre-mRNA is transcribed from either the first mutant allele that is a(i) or a(ii), and/or the second allele that is b(i) or b(ii). In some embodiments, the target protein is produced in a form having reduced function compared to the equivalent wild-type protein. In some embodiments, the target protein is produced in a form that is fully-functional compared to the equivalent wild-type protein. In some embodiments, the targeted portion of the RIC pre-mRNA is in the retained intron within the region +6 relative to the 5' splice site of the retained intron to −16 relative to the 3' splice site of the retained intron. In some embodiments, the targeted portion of the RIC pre-mRNA is in the retained intron within: (a) the region +6 to +4000, +6 to +3000, +6 to +2000 or +6 to +100 relative to the 5' splice site of the retained intron; or (b) the region −16 to −4000, −16 to −2000, −16 to −1000, −16 to −500 or −16 to −100 relative to the 3' splice site of the retained intron. In some embodiments, the targeted portion of the RIC pre-mRNA is within: (a) the region +2e to −4e in the exon flanking the 5' splice site of the retained intron; or (b) the region +2e to −4e in the exon flanking the 3' splice site of the retained intron. In some embodiments, the RIC pre-mRNA is encoded by a genetic sequence with at least about 80%, 85%, 90%, 95%, 96%, 97%, 98%, 99% or 100% sequence identity to SEQ ID NOs: 6274-6292. In some embodiments, the RIC pre-mRNA comprises a sequence with at least about 80%, 85%, 90%, 95%, 96%, 97%, 98%, 99% or 100% sequence identity to any one of SEQ ID NOs: 6293-6353. In some embodiments, the antisense oligomer does not increase the amount of the target protein or the functional RNA by modulating alternative splicing of pre-mRNA transcribed from a gene encoding the functional RNA or target protein. In some embodiments, the antisense oligomer does not increase the amount of the target protein or the functional RNA by modulating aberrant splicing resulting from mutation of the gene encoding the target protein or the functional RNA. In some embodiments, the RIC pre-mRNA was produced by partial splicing of a full-length pre-mRNA or partial splicing of a wild-type pre-mRNA. In some embodiments, the mRNA encoding the target protein or functional RNA is a full-length mature mRNA, or a wild-type mature mRNA. In some embodiments, the target protein produced is full-length protein, or wild-type protein. In some embodiments, the total amount of the mRNA encoding the target protein or functional RNA produced in the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of the mRNA encoding the target protein or functional RNA produced in a control cell. In some embodiments, the total amount of target protein produced by the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of target protein produced by a control cell. In some embodiments, the antisense oligomer comprises a backbone modification comprising a phosphorothioate linkage or a phosphorodiamidate linkage. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, each sugar moiety is a modified sugar moiety. In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or 100%, complementary to the targeted portion of the RIC pre-mRNA encoding the protein. In some embodiments, the targeted portion of the RIC pre-mRNA is within a sequence selected from SEQ ID NOs: 30624-30627, 30629-30651, 30653-30659, or 34788-34789. In some embodiments, the antisense oligomer comprises a nucleotide sequence that is at least about 80%, 85%, 90%, 91%, 92%, 93%, 94%, 95%, 96%, 97%, 98%, or 99% sequence identity to any one of SEQ ID NOs: 6354-8948, 8949-9575, 9576-9825, 9826-10067, 10068-10305, 10306-12684, 12685-14026, 14027-14237, 14238-14326, 14327-15605, 15606-15873, 15874-16076, 30660-34787, 19965-20033, 20034-22187, 22188-23203, 23204-29620, 29621-29808, or 29809-30623. In some embodiments, the antisense oligomer comprises a nucleotide sequence selected from SEQ ID NOs: 6354-8948, 8949-9575, 9576-9825, 9826-10067, 10068-10305, 10306-12684, 12685-14026, 14027-14237, 14238-14326, 14327-15605, 15606-15873, 15874-16076, 30660-34787, 19965-20033, 20034-22187, 22188-23203, 23204-29620, 29621-29808, or 29809-30623. In some embodiments, the cell comprises a population of RIC pre-mRNAs transcribed from the gene encoding the target protein or functional RNA, wherein the population of RIC pre-mRNAs comprises two or more retained introns, and wherein the antisense oligomer binds to the most abundant retained intron in the population of RIC pre-mRNAs. In some embodiments, the binding of the antisense oligomer to the most abundant retained intron induces splicing out of the two or more retained introns from the population of RIC pre-mRNAs to produce mRNA encoding the target protein or functional RNA. In some embodiments, the cell comprises a population of RIC pre-mRNAs transcribed from the gene encoding the target protein or functional RNA, wherein the population of RIC pre-mRNAs comprises two or more retained introns, and wherein the antisense oligomer binds to the second most abundant retained intron in the population of RIC pre-mRNAs. In some embodiments, the binding of the antisense oligomer to the second most abundant retained intron induces splicing out of the two or more retained introns from the population of RIC pre-mRNAs to produce mRNA encoding the target protein or functional RNA. In some embodiments, the condition is a disease or disorder. In some embodiments, the disease or disorder is Familial hemiplegic migraine-2, Familial Basilar migraine, Alternating hemiplegia of childhood, Episodic ataxia type 2, Familial hemiplegic migraine, Spinocerebellar ataxia type 6, Mental retardation-23, 3p25 microdeletion syndrome, Phelan-McDermid syndrome, Schizophrenia-15, Neurofibromatosis, type 2, Meningioma, NF2-related, Schwannomatosis 1, Hereditary sensory neuropathy type IE, Autosomal dominant cerebellar ataxia, deafness, and narcolepsy, Pitt-hopkins syndrome, Smith-magenis syndrome, peroxisome biogenesis disorder 1a, Heimler syndrome-1, Metachromatic Leukodystrophy, Leukoencephalopathy with vanishing white matter, Niemann-Pick disease type C1 and Niemann-Pick disease type D, Aicardi-Goutieres syndrome-6, early infantile epileptic encephalopathy-4, progressive myoclonic epilepsy 5, familial infantile convulsion with paroxysmal choreoathetosis, episodic kinesigenic dyskinesia 1, benign familial infantile seizuers-2, or generalized Epilepsy with febrile seizures plus type 9. In some embodiments, the target protein and the RIC pre-mRNA are encoded by the ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B gene. In some embodiments, the method further comprises assessing protein expression. In some embodiments, the antisense oligomer binds to a targeted portion of a ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B RIC pre-mRNA. In some embodiments, the subject is a human. In some embodiments, the subject is a non-human animal. In some embodiments, the subject is a fetus, an embryo, or a child. In some embodiments, the cells are ex vivo. In some embodiments, the antisense oligomer is administered by intrathecal injection, intracerebroventricular injection, intraperitoneal injection, intramuscular injection, subcutaneous injection, or intravenous injection of the subject. In some embodiments, the 9 nucleotides at −3e to −1e of the exon flanking the 5' splice site and +1 to +6 of the retained intron, are identical to the corresponding wild-type sequence. In some embodiments, the 16 nucleotides at −15 to −1 of the retained intron and +1e of the exon flanking the 3' splice site are identical to the corresponding wild-type sequence.

Described herein, in certain embodiments, is an antisense oligomer as used in a method described above.

Described herein, in certain embodiments, is an antisense oligomer comprising a sequence with at least about 80%, 85%, 90%, 95%, 97%, or 100% sequence identity to any one of SEQ ID NOs: 6354-8948, 8949-9575, 9576-9825, 9826-10067, 10068-10305, 10306-12684, 12685-14026, 14027-14237, 14238-14326, 14327-15605, 15606-15873, 15874-16076, 30660-34787, 19965-20033, 20034-22187, 22188-23203, 23204-29620, 29621-29808, and 29809-30623.

Disclosed herein, in certain embodiments, is a pharmaceutical composition comprising the antisense oligomer described above, and an excipient. In some embodiments, also described herein is a method of treating a subject in need thereof by administering the pharmaceutical composition by intrathecal injection, intracerebroventricular injection, intraperitoneal injection, intramuscular injection, subcutaneous injection, or intravenous injection.

Disclosed herein, in certain embodiments, is a composition comprising an antisense oligomer for use in a method of increasing expression of a target protein or a functional RNA by cells to treat Familial hemiplegic migraine-2, Familial Basilar migraine, Alternating hemiplegia of childhood, Episodic ataxia type 2, Familial hemiplegic migraine, Spinocerebellar ataxia type 6, Mental retardation-23, 3p25 microdeletion syndrome, Phelan-McDermid syndrome, Schizophrenia-15, Neurofibromatosis, type 2, Meningioma, NF2-related, Schwannomatosis 1, Hereditary sensory neuropathy type IE, Autosomal dominant cerebellar ataxia, deafness, and narcolepsy, Pitt-hopkins syndrome, Smith-magenis syndrome, peroxisome biogenesis disorder 1a, Heimler syndrome-1, Metachromatic Leukodystrophy, Leukoencephalopathy with vanishing white matter, Niemann-Pick disease type C1 and Niemann-Pick disease type D, Aicardi-Goutieres syndrome-6, early infantile epileptic encephalopathy-4, progressive myoclonic epilepsy 5, familial infantile convulsion with paroxysmal choreoathetosis, episodic kinesigenic dyskinesia 1, benign familial infantile seizuers-2, or generalized Epilepsy with febrile seizures plus type 9 in a subject in need thereof associated with a deficient protein or deficient functional RNA, wherein the deficient protein or deficient functional RNA is deficient in amount or activity in the subject, wherein the antisense oligomer enhances constitutive splicing of a retained intron-containing pre-mRNA (RIC pre-mRNA) encoding the target protein or the functional RNA, wherein the target protein is: (a) the deficient protein; or (b) a compensating protein which functionally augments or replaces the deficient protein or in the subject; and wherein the functional RNA is: (a) the deficient RNA; or (b) a compensating functional RNA which functionally augments or replaces the deficient functional RNA in the subject; wherein the RIC pre-mRNA comprises a retained intron, an exon flanking the 5' splice site and an exon flanking the 3' splice site, and wherein the retained intron is spliced from the RIC pre-mRNA encoding the target protein or the functional RNA, thereby increasing production or activity of the target protein or the functional RNA in the subject. In some embodiments, also described herein is a composition comprising an antisense oligomer for use in a method of treating a condition associated with ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein in a subject in need thereof, the method comprising the step of increasing expression of ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein by cells of the subject, wherein the cells have a retained-intron-containing pre-mRNA (RIC pre-mRNA) comprising a retained intron, an exon flanking the 5' splice site of the retained intron, an exon flanking the 3' splice site of the retained intron, and wherein the RIC pre-mRNA encodes the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, the method comprising contacting the cells with the antisense oligomer, whereby the retained intron is constitutively spliced from the RIC pre-mRNA transcripts encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, thereby increasing the level of mRNA encoding the target protein or functional RNA, and increasing the expression of ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, in the cells of the subject. In some embodiments, the target protein is ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B. In some embodiments, the target protein is ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B. In some embodiments, the condition is a disease or disorder. In some embodiments, the disease or disorder is Familial hemiplegic migraine-2, Familial Basilar migraine, Alternating hemiplegia of childhood, Episodic ataxia type 2, Familial hemiplegic migraine, Spinocerebellar ataxia type 6, Mental retardation-23, 3p25 microdeletion syndrome, Phelan-McDermid syndrome, Schizophrenia-15, Neurofibromatosis, type 2, Meningioma, NF2-related, Schwannomatosis 1, Hereditary sensory neuropathy type IE, Autosomal dominant cerebellar ataxia, deafness, and narcolepsy, Pitt-hopkins syndrome, Smith-magenis syndrome, peroxisome biogenesis disorder 1a, Heimler syndrome-1, Metachromatic Leukodystrophy, Leukoencephalopathy with vanishing white matter, Niemann-Pick disease type C1 and Niemann-Pick disease type D, Aicardi-Goutieres syndrome-6, early infantile epileptic encephalopathy-4, progressive myoclonic epilepsy 5, familial infantile convulsion with paroxysmal choreoathetosis, episodic kinesigenic dyskinesia 1, benign familial infantile seizuers-2, or generalized Epilepsy with febrile seizures plus type 9. In some embodiments, the target protein and RIC pre-mRNA are encoded by the ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B gene. In some embodiments, the target protein and RIC pre-mRNA are encoded by the ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B gene. In some embodiments, the antisense oligomer targets a portion of the RIC pre-mRNA that is in the retained intron within the region +6 relative to the 5' splice site of the retained intron to −16 relative to the 3' splice site of the retained intron. In some embodiments, the antisense oligomer targets a portion of the RIC pre-mRNA that is in the retained intron within: (a) the region +6 to +100 relative to the 5' splice site of the retained intron; or (b) the region −16 to −100 relative to the 3' splice site of the retained intron. In some embodiments, the antisense oligomer targets a portion of the RIC pre-mRNA that is within the region about 100 nucleotides downstream of the 5' splice site of the at least one retained intron, to about 100 nucleotides upstream of the 3' splice site of the at least one retained intron. In some embodiments, the targeted portion of the RIC pre-mRNA is within: (a) the region +2e to −4e in the exon flanking the 5' splice site of the retained intron; or (b) the region +2e to −4e in the exon flanking the 3' splice site of the retained intron. In some embodiments, the RIC pre-mRNA is encoded by a genetic sequence with at least about 80%, 85%, 90%, 95%, 96%, 97%, 98%, 99% or 100% sequence identity to SEQ ID NOs: 6274-6292. In some embodiments, the RIC pre-mRNA comprises a sequence with at least about 80%, 85%, 90%, 95%, 96%, 97%, 98%, 99% or 100% sequence identity to any one of SEQ ID NOs: 6293-6353. In some embodiments, the antisense oligomer does not increase the amount of target protein or functional RNA by modulating alternative splicing of the pre-mRNA transcribed from a gene encoding the target protein or functional RNA. In some embodiments, the antisense oligomer does not increase the amount of the functional RNA or functional protein by modulating aberrant splicing resulting from mutation of the gene encoding the target protein or functional RNA. In some embodiments, the RIC pre-mRNA was produced by partial splicing from a full-length pre-mRNA or a wild-type pre-mRNA. In some embodiments, the mRNA encoding the target protein or functional RNA is a full-length mature mRNA, or a wild-type mature mRNA. In some embodiments, the target protein produced is full-length protein, or wild-type protein. In some embodiments, the retained intron is a rate-limiting intron. In some embodiments, said retained intron is the most abundant retained intron in said RIC pre-mRNA. In some embodiments, the retained intron is the second most abundant retained intron in said RIC pre-mRNA. In some embodiments, the antisense oligomer comprises a backbone modification comprising a phosphorothioate linkage or a phosphorodiamidate linkage. In some embodiments, said antisense oligomer is an antisense oligonucleotide. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, each sugar moiety is a modified sugar moiety. In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or is 100% complementary to the targeted portion of the RIC pre-mRNA encoding the protein. In some embodiments, the antisense oligomer binds to a targeted portion of a tuberin RIC pre-mRNA, wherein the targeted portion of the RIC pre-mRNA is within a sequence selected from SEQ ID NOs: 30624-30627, 30629-30651, 30653-30659, or 34788-34789. In some embodiments, the antisense oligomer comprises a nucleotide sequence that is at least about 80%, 85%, 90%, 91%, 92%, 93%, 94%, 95%, 96%, 97%, 98%, or 99% sequence identity to any one of SEQ ID NOs: 6354-8948, 8949-9575, 9576-9825, 9826-10067, 10068-10305, 10306-12684, 12685-14026, 14027-14237, 14238-14326, 14327-15605, 15606-15873, 15874-16076, 30660-34787, 19965-20033, 20034-22187, 22188-23203, 23204-29620, 29621-29808, or 29809-30623. In some embodiments, the antisense oligomer comprises a nucleotide sequence selected from SEQ ID NOs: 6354-8948, 8949-9575, 9576-9825, 9826-10067, 10068-10305, 10306-12684, 12685-14026, 14027-14237, 14238-14326, 14327-15605, 15606-15873, 15874-16076, 30660-34787, 19965-20033, 20034-22187, 22188-23203, 23204-29620, 29621-29808, or 29809-30623. In some embodiments, the antisense oligomer binds to a targeted portion of a ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B RIC pre-mRNA. In some embodiments, the antisense oligomer binds to a targeted portion of a ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B RIC pre-mRNA.

Disclosed herein, in certain embodiments, is a pharmaceutical composition comprising the antisense oligomer of any of the compositions described above, and an excipient. In some embodiments, also described herein is a method of treating a subject in need thereof by administering the pharmaceutical composition by intrathecal injection, intracerebroventricular injection, intraperitoneal injection, intramuscular injection, subcutaneous injection, or intravenous injection.

Disclosed herein, in certain embodiments, is a pharmaceutical composition comprising: an antisense oligomer that hybridizes to a target sequence of a deficient ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, MFSD8, IDUA, or STX1B mRNA transcript, wherein the deficient ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, MFSD8, IDUA, or STX1B mRNA transcript comprises a retained intron, wherein the antisense oligomer induces splicing out of the retained intron from the deficient ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, MFSD8, IDUA, or STX1B mRNA transcript; and a pharmaceutical acceptable excipient. In some embodiments, the antisense oligomer hybridizes to a target sequence of a deficient ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B mRNA transcript. In some embodiments, the deficient ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B mRNA transcript is a ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B RIC pre-mRNA transcript. In some embodiments, the antisense oligomer hybridizes to a target sequence of a deficient ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B mRNA transcript. In some embodiments, the deficient ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B mRNA transcript is a ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B RIC pre-mRNA transcript. In some embodiments, the targeted portion of the RIC pre-mRNA transcript is in the retained intron within the region +4000 relative to the 5' splice site of the retained intron to −2000 relative to the 3' spliced site of the retained intron. In some embodiments, the RIC pre-mRNA transcript is encoded by a genetic sequence with at least about 80%, 85%, 90%, 95%, 96%, 97%, 98%, 99% or 100% sequence identity to SEQ ID NOs: 6274-6292. In some embodiments, the RIC pre-mRNA transcript comprises a sequence with at least about 80%, 85%, 90%, 95%, 96%, 97%, 98%, 99% or 100% sequence identity to any one of SEQ ID NOs: 6293-6353. In some embodiments, the antisense oligomer comprises a backbone modification comprising a phosphorothioate linkage or a phosphorodiamidate linkage. In some embodiments, the antisense oligomer is an antisense oligonucleotide. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, the antisense oligomer comprises from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or is 100% complementary to a targeted portion of the RIC pre-mRNA transcript. In some embodiments, the targeted portion of the RIC pre-mRNA transcript is within a sequence selected from SEQ ID NOs: 30624-30627, 30629-30651, 30653-30659, or 34788-34789. In some embodiments, the antisense oligomer comprises a nucleotide sequence that is at least about 80%, 85%, 90%, 91%, 92%, 93%, 94%, 95%, 96%, 97%, 98%, or 99% sequence identity to any one of SEQ ID NOs: 6354-8948, 8949-9575, 9576-9825, 9826-10067, 10068-10305, 10306-12684, 12685-14026, 14027-14237, 14238-14326, 14327-15605, 15606-15873, 15874-16076, 30660-34787, 19965-20033, 20034-22187, 22188-23203, 23204-29620, 29621-29808, or 29809-30623. In some embodiments, the antisense oligomer comprises a nucleotide sequence selected from SEQ ID NOs: 6354-8948, 8949-9575, 9576-9825, 9826-10067, 10068-10305, 10306-12684, 12685-14026, 14027-14237, 14238-14326, 14327-15605, 15606-15873, 15874-16076, 30660-34787, 19965-20033, 20034-22187, 22188-23203, 23204-29620, 29621-29808, or 29809-30623. In some embodiments, the pharmaceutical composition is formulated for intrathecal injection, intracerebroventricular injection, intraperitoneal injection, intramuscular injection, subcutaneous injection, or intravenous injection.

Disclosed herein, in certain embodiments, is a method of inducing processing of a mRNA transcript to facilitate removal of a retained intron to produce a fully processed mRNA transcript that encodes a functional form of a target protein, the method comprising: (a) contacting an antisense oligomer to a target cell of a subject; (b) hybridizing the antisense oligomer to the mRNA transcript, wherein the mRNA transcript is capable of encoding the functional form of the target protein and comprises at least one retained intron; (c) removing the at least one retained intron from the mRNA transcript to produce the fully processed mRNA transcript that encodes the functional form of the target protein; and (d) translating the functional form of the target protein from the fully processed mRNA transcript; wherein the mRNA transcript is selected from ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, MFSD8, IDUA, or STX1B mRNA transcript. In some embodiments, the retained intron is an entire retained intron. In some embodiments, the mRNA transcript is a RIC pre-mRNA transcript. In some embodiments, the mRNA transcript is selected from ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B mRNA transcript. In some embodiments, the mRNA transcript is selected from ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B mRNA transcript.

Disclosed herein, in certain embodiments, is a method of treating a subject having a condition caused by a deficient amount or activity of a target protein comprising: administering to the subject an antisense oligomer comprising a nucleotide sequence with at least about 80%, 85%, 90%, 91%, 92%, 93%, 94%, 95%, 96%, 97%, 98%, or 99% sequence identity to any one of SEQ ID NOs: 6354-8948, 8949-9575, 9576-9825, 9826-10067, 10068-10305, 10306-12684, 12685-14026, 14027-14237, 14238-14326, 14327-15605, 15606-15873, 15874-16076, 30660-34787, 19965-20033, 20034-22187, 22188-23203, 23204-29620, 29621-29808, or 29809-30623.

Disclosed herein, in some embodiments, are methods of treating an eye disease in a subject in need thereof by increasing the expression of a target protein or functional RNA by cells of the subject, wherein the cells have a retained-intron-containing pre-mRNA (RIC pre-mRNA), the RIC pre-mRNA comprising a retained intron, an exon flanking the 5' splice site, an exon flanking the 3' splice site, and wherein the RIC pre-mRNA encodes the target protein or functional RNA, the method comprising contacting the cells of the subject with an antisense oligomer (ASO) complementary to a targeted portion of the RIC pre-mRNA encoding the target protein or functional RNA, whereby the retained intron is constitutively spliced from the RIC pre-mRNA encoding the target protein or functional RNA, thereby increasing the level of mRNA encoding the target protein or functional RNA, and increasing the expression of the target protein or functional RNA in the cells of the subject. In some embodiments, the eye disease is Retinitis pigmentosa-7, Sveinsson chorioretinal atrophy, Fundus Albipunctatus, Retinitis pigmentosa 37, Aniridia, Coloboma of the optic nerve, Ocular coloboma, Foveal hypoplasia-1, Bilateral optic nerve hypoplasia, Cone-rod dystrophy-2, Leber congenital amaurosis-7, Retinitis Pigmentosa 30, Stargardt disease-1, Retinitis pigmentosa-19, Age-related macular degeneration-2, Cone-rod dystrophy-3, Primary open angle glaucoma, Fuchs endothelial corneal dystrophy-3, Macular dystrophy with central cone involvement, Ocular nonnephropathic cystinosis, Leber congenital amaurosis, Primary open angle glaucoma, Amyotrophic lateral sclerosis 12, Bothnia retinal dystrophy, Fundus albipunctatus, Retinitis punctata albescens, Leber congenital amaurosis 2, Retinitis pigmentosa 20, Leber congenital amaurosis 14, Retinitis pigmentosa, Eye diseases with slow clearance or accumulation of all-trans retinal (e.g. STGD1), Leber congenital amaurosis13, Retinitis pigmentosa 44, Achromatopsia-2, Jet lag, Alstrom syndrome, Attenuated MPS-1 (Hurler-scheie syndrome and Scheie syndrome) or Bardet-biedl syndrome.

Also disclosed herein are methods of increasing expression of a target protein, wherein the target protein is ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA expression by improving splicing efficiency of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA, by cells having a retained-intron-containing pre-mRNA (RIC pre-mRNA), the RIC pre-mRNA comprising a retained intron, an exon flanking the 5' splice site of the retained intron, an exon flanking the 3' splice site of the retained intron, and wherein the RIC pre-mRNA encodes ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA expression by improving splicing efficiency of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, the method comprising contacting the cells with an antisense oligomer (ASO) complementary to a targeted portion of the RIC pre-mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA expression by improving splicing efficiency of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, whereby the retained intron is constitutively spliced from the RIC pre-mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA expression by improving splicing efficiency of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, thereby increasing the level of mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, and increasing the expression of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA expression by improving splicing efficiency of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein in the cells, wherein the target protein is ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA.

In some embodiments of any of the aforementioned methods, the target protein is ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA. In some embodiments, the target protein or the functional RNA is a compensating protein or a compensating functional RNA that functionally augments or replaces a target protein or functional RNA that is deficient in amount or activity in the subject. In some embodiments, the cells are in or from a subject having a condition caused by a deficient amount or activity of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein.

In some embodiments of any of the aforementioned methods, the deficient amount of the target protein is caused by haploinsufficiency of the target protein, wherein the subject has a first allele encoding a functional target protein, and a second allele from which the target protein is not produced, or a second allele encoding a nonfunctional target protein, and wherein the antisense oligomer binds to a targeted portion of a RIC pre-mRNA transcribed from the first allele. In some embodiments, the subject has a condition caused by a disorder resulting from a deficiency in the amount or function of the target protein, wherein the subject has (a) a first mutant allele from which (i) the target protein is produced at a reduced level compared to production from a wild-type allele, (ii) the target protein is produced in a form having reduced function compared to an equivalent wild-type protein, or (iii) the target protein is not produced, and (b) a second mutant allele from which (i) the target protein is produced at a reduced level compared to production from a wild-type allele, (ii) the target protein is produced in a form having reduced function compared to an equivalent wild type protein, or (iii) the target protein is not produced, and wherein when the subject has a first mutant allele a(iii), the second mutant allele is b(i) or b(ii), and wherein when the subject has a second mutant allele b(iii), the first mutant allele is a(i) or a(ii), and wherein the RIC pre-mRNA is transcribed from either the first mutant allele that is a(i) or a(ii), and/or the second allele that is b(i) or b(ii). In some embodiments, the target protein is produced in a form having reduced function compared to the equivalent wild-type protein. In some embodiments, the target protein is produced in a form that is fully-functional compared to the equivalent wild-type protein.

In some embodiments of any of the aforementioned methods, the targeted portion of the RIC pre-mRNA is in the retained intron within the region +6 relative to the 5' splice site of the retained intron to −16 relative to the 3' splice site of the retained intron. In some embodiments, the targeted portion of the RIC pre-mRNA is in the retained intron within the region +69 relative to the 5' splice site of the retained intron to −79 relative to the 3' splice site of the retained intron.

In some embodiments of any of the aforementioned methods, the target protein is (a) ABCA4, (b) RPE65, (c) MYOC, (d) CNGA3, (e) MFSD8, (f) IDUA, (g) LRAT, (h) OPTN, (i) RGR, (j) TEAD1, (k) PAX6, (l) ROM1, (m) RDH5, (n) RDH12, (o) NR2E3, (p) RLBP1, (q) CTNS, (r) PER1, (s) FSCN2, (t) TCF4, (u) RDH8, (v) NXNL1, or (w) CRX. In some embodiments, the targeted portion of the RIC pre-mRNA comprises a sequence that is at least about 80%, 85%, 90%, 95%, 97%, or 100% complimentary to (a) any one of SEQ ID NOs 34873-35915, (b) any one of SEQ ID NOs 35916-36317, (c) any one of SEQ ID NOs 36318-37107, (d) any one of SEQ ID NOs 37108-37559, (e) any one of SEQ ID NOs 37560-38420, (f) any one of SEQ ID NOs 38421-39232, (g) any one of SEQ ID NOs 39233-41436, (h) any one of SEQ ID NOs 41437-42368, (i) any one of SEQ ID NOs 42369-43747, (j) any one of SEQ ID NOs 43748-43952, (k) any one of SEQ ID NOs 43953-49968, (l) any one of SEQ ID NOs 49969-50275, (m) any one of SEQ ID NOs 50276-50991, (n) any one of SEQ ID NOs 50992-51247, (o) any one of SEQ 5ID NOs 51248-52998, (p) any one of SEQ ID NOs 52999-53428, (q) any one of SEQ ID NOs 53429-54323, (r) any one of SEQ ID NOs 54324-54634, (s) any one of SEQ ID NOs 54634-55638, (t) any one of SEQ ID NOs 55639-59526, (u) any one of SEQ ID NOs 59527-59662, (v) any one of SEQ ID NOs 59663-25231, or (w) any one of SEQ ID NOs 60020-61443. In some embodiments, the targeted portion of the RIC pre-mRNA comprises a sequence with at least 80%, 85%, 90%, 95%, 97%, or 100% sequence identity to a region comprising at least 8 contiguous nucleic acids of (a) SEQ ID NO 61463, SEQ ID NO, SEQ ID NO 61445, SEQ ID NO 61470, or SEQ ID NO 61453, (b) SEQ ID NO 61480 or SEQ ID NO 61460, (c) SEQ ID NO 61458 or SEQ ID NO 61485, (d) SEQ ID NO 61500, (e) SEQ ID NO 61492 or SEQ ID NO 61497, (0 SEQ ID NO 61457, SEQ ID NO 61468, SEQ ID NO 61489, SEQ ID NO 61444, or SEQ ID NO 61452, (g) SEQ ID NO 61474, (h) SEQ ID NO 61503, (i) SEQ ID NO 61446, SEQ ID NO 61476, or SEQ ID NO 61472, (j) SEQ ID NO 61461, (k) SEQ ID NO 61486, SEQ ID NO 61466, SEQ ID NO 61496, SEQ ID NO 61467, SEQ ID NO 61502, SEQ ID NO 61483, or SEQ ID NO 61448, (1) SEQ ID NO 61454, (m) SEQ ID NO 61493, SEQ ID NO 61455, SEQ ID NO 61498, or SEQ ID NO 61473, (n) SEQ ID NO 61482, (o) SEQ ID NO 61491, SEQ ID NO 61449, SEQ ID NO 61494, SEQ ID NO 61487, SEQ ID NO 61447, SEQ ID NO 61465, SEQ ID NO 61501SEQ ID NO 61490, (p) SEQ ID NO 61462 or SEQ ID NO 61456, (q) SEQ ID NO 61479, or SEQ ID NO 61481, (r) SEQ ID NO 61471 or SEQ ID NO 61499, (s) SEQ ID NO 61459, SEQ ID NO 61451, or SEQ ID NO 61450, (t) SEQ ID NO 61477, or SEQ ID NO 61478, (u) SEQ ID NO 61469, (v) SEQ ID NO 61488, or (w) SEQ ID NO 61484, or SEQ ID NO 61475. In some embodiments, the ASO comprises a sequence with at least about 80%, 85%, 90%, 95%, 97%, or 100% sequence identity to (a) any one of SEQ ID NOs 34873-35915, (b) any one of SEQ ID NOs 35916-36317, (c) any one of SEQ ID NOs 36318-37107, (d) any one of SEQ ID NOs 37108-37559, (e) any one of SEQ ID NOs 37560-38420, (0 any one of SEQ ID NOs 38421-39232, (g) any one of SEQ ID NOs 39233-41436, (h) any one of SEQ ID NOs 41437-42368, (i) any one of SEQ ID NOs 42369-43747, (j) any one of SEQ ID NOs 43748-43952, (k) any one of SEQ ID NOs 43953-49968, (l) any one of SEQ ID NOs 49969-50275, (m) any one of SEQ ID NOs 50276-50991, (n) any one of SEQ ID NOs 50992-51247, (o) any one of SEQ ID NOs 51248-52998, (p) any one of SEQ ID NOs 52999-53427, (q) any one of SEQ ID NOs 53428-54323, (r) any one of SEQ ID NOs 54324-54634, (s) any one of SEQ ID NOs 54635-55638, (t) any one of SEQ ID NOs 55639-59526, (u) any one of SEQ ID NOs 59527-59662, (v) any one of SEQ ID NOs 59663-60020, or (w) any one of SEQ ID NOs 60021-61443. In some embodiments, the RIC pre-mRNA comprises a sequence with at least about 80%, 85%, 90%, 95%, 97%, or 100% sequence identity to (a) SEQ ID NO 34813, (b) SEQ ID NO 34814, (c) SEQ ID NO 34815, (d) SEQ ID NO 34816 or SEQ ID NO 34817, (e) SEQ ID NO 34818, (0 SEQ ID NO 34819 or SEQ ID NO 34820, (g) SEQ ID NO 34821 or SEQ ID NO 34822, (h) SEQ ID NO 34823, SEQ ID NO 34824, SEQ ID NO 34825, or SEQ ID NO 34826, (i) SEQ ID NO 34827, SEQ ID NO 34828, or SEQ ID NO 34829, (j) SEQ ID NO 34830, (k) SEQ ID NO 34831, SEQ ID NO 34832, SEQ ID NO 34833, SEQ ID NO 34834, SEQ ID NO 34835, SEQ ID NO 34836, SEQ ID NO 34837, SEQ ID NO 34838, SEQ ID NO 34839, SEQ ID NO 34840, or SEQ ID NO 34841, (l) SEQ ID NO 34842, (m) SEQ ID NO 34843 or SEQ ID NO 34844, (n) SEQ ID NO 34845, (o) SEQ ID NO 34846 or SEQ ID NO 34847, (p) SEQ ID NO 34848, (q) SEQ ID NO 34849 or SEQ ID NO 34850, (r) SEQ ID NO 34851, (s) SEQ ID NO 34852 or SEQ ID NO 34853, (t) SEQ ID NO 34854, SEQ ID NO 34855, SEQ ID NO 34856, SEQ ID NO 34857, SEQ ID NO 34858, SEQ ID NO 34859, SEQ ID NO 34860, SEQ ID NO 34861, SEQ ID NO 34862, SEQ ID NO 34863, SEQ ID NO 34864, SEQ ID NO 34865, SEQ ID NO 34866, SEQ ID NO 34867, SEQ ID NO 34868, or SEQ ID NO 34869, (u) SEQ ID NO 34870, (v) SEQ ID NO 34871, or (w) SEQ ID NO 34872. In some embodiments, the RIC pre-mRNA is encoded by a genetic sequence with at least about 80%, 85%, 90%, 95%, 97%, or 100% sequence identity to (a) SEQ ID NO 34790, (b) SEQ ID NO 34791, (c) SEQ ID NO 34792, (d) SEQ ID NO 34793, (e) SEQ ID NO 34794, (0 SEQ ID NO 34795, (g) SEQ ID NO 34796, (h) SEQ ID NO 34797, (i) SEQ ID NO 34798, (j) SEQ ID NO 34799, (k) SEQ ID NO 34800, (1) SEQ ID NO 34801, (m) SEQ ID NO 34802, (n) SEQ ID NO 34803, (o) SEQ ID NO 34804, (p) SEQ ID NO 34805, (q) SEQ ID NO 34806, (r) SEQ ID NO 34807, (s) SEQ ID NO 34808, (t) SEQ ID NO 34809, (u) SEQ ID NO 34810, (v) SEQ ID NO 34811, (w) SEQ ID NO 34812.

In some embodiments of any of the aforementioned methods, the targeted portion of the RIC pre-mRNA is in the retained intron within: (a) the region +6 to +100 relative to the 5' splice site of the retained intron; or (b) the region −16 to −100 relative to the 3' splice site of the retained intron. In some embodiments, the antisense oligomer targets a portion of the RIC pre-mRNA that is within the region about 100 nucleotides downstream of the 5' splice site of the at least one retained intron, to about 100 nucleotides upstream of the 3' splice site of the at least one retained intron. In some embodiments, the targeted portion of the RIC pre-mRNA is within: (a) the region +2e to −4e in the exon flanking the 5' splice site of the retained intron; or (b) the region +2e to −4e in the exon flanking the 3' splice site of the retained intron.

In some embodiments of any of the aforementioned methods, the antisense oligomer does not increase the amount of the target protein or the functional RNA by modulating alternative splicing of pre-mRNA transcribed from a gene encoding the functional RNA or target protein. In some embodiments, the antisense oligomer does not increase the amount of the target protein or the functional RNA by modulating aberrant splicing resulting from mutation of the gene encoding the target protein or the functional RNA. In some embodiments, the RIC pre-mRNA was produced by partial splicing of a full-length pre-mRNA or partial splicing of a wild-type pre-mRNA. In some embodiments, the mRNA encoding the target protein or functional RNA is a full-length mature mRNA, or a wild-type mature mRNA. In some embodiments, the target protein produced is full-length protein, or wild-type protein. In some embodiments, the total amount of the mRNA encoding the target protein or functional RNA produced in the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of the mRNA encoding the target protein or functional RNA produced in a control cell. In some embodiments, the total amount of target protein produced by the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of target protein produced by a control cell.

In some embodiments, of any of the aforementioned methods, the antisense oligomer comprises a backbone modification comprising a phosphorothioate linkage or a phosphorodiamidate linkage. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, each sugar moiety is a modified sugar moiety. In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or 100%, complementary to the targeted portion of the RIC pre-mRNA encoding the protein.

In some embodiments of any of the aforementioned methods, the cell comprises a population of RIC pre-mRNAs transcribed from the gene encoding the target protein or functional RNA, wherein the population of RIC pre-mRNAs comprises two or more retained introns, and wherein the antisense oligomer binds to the most abundant retained intron in the population of RIC pre-mRNAs. In some embodiments, the binding of the antisense oligomer to the most abundant retained intron induces splicing out of the two or more retained introns from the population of RIC pre-mRNAs to produce mRNA encoding the target protein or functional RNA. In some embodiments, the cell comprises a population of RIC pre-mRNAs transcribed from the gene encoding the target protein or functional RNA, wherein the population of RIC pre-mRNAs comprises two or more retained introns, and wherein the antisense oligomer binds to the second most abundant retained intron in the population of RIC pre-mRNAs. In some embodiments, the binding of the antisense oligomer to the second most abundant retained intron induces splicing out of the two or more retained introns from the population of RIC pre-mRNAs to produce mRNA encoding the target protein or functional RNA. In some embodiments, the condition is a disease or disorder. In some embodiments, the disease or disorder is Retinitis pigmentosa-7, Sveinsson chorioretinal atrophy, Fundus Albipunctatus, Retinitis pigmentosa 37, Aniridia, Coloboma of the optic nerve, Ocular coloboma, Foveal hypoplasia-1, Bilateral optic nerve hypoplasia, Cone-rod dystrophy-2, Leber congenital amaurosis-7, Retinitis Pigmentosa 30, Stargardt disease-1, Retinitis pigmentosa-19, Age-related macular degeneration-2, Cone-rod dystrophy-3, Primary open angle glaucoma, Fuchs endothelial corneal dystrophy-3, Macular dystrophy with central cone involvement, Ocular nonnephropathic cystinosis, Leber congenital amaurosis, Primary open angle glaucoma, Amyotrophic lateral sclerosis 12, Bothnia retinal dystrophy, Fundus albipunctatus, Retinitis punctata albescens, Leber congenital amaurosis 2, Retinitis pigmentosa 20, Leber congenital amaurosis 14, Retinitis pigmentosa, Eye diseases with slow clearance or accumulation of all-trans retinal (e.g. STGD1), Leber congenital amaurosis13, Retinitis pigmentosa 44, Achromatopsia-2, Jet lag, Alstrom syndrome, Attenuated MPS-1 (Hurler-scheie syndrome and Scheie syndrome) or Bardet-biedl syndrome. In some embodiments, the target protein and the RIC pre-mRNA are encoded by the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA gene. In some embodiments, the method further comprises assessing protein expression. In some embodiments, the antisense oligomer binds to a targeted portion of a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA. In some embodiments, the subject is a human. In some embodiments, the subject is a non-human animal. In some embodiments, the subject is a fetus, an embryo, or a child. In some embodiments, the cells are ex vivo. In some embodiments, the antisense oligomer is administered by intravitreal injection, subretinal injection, topical application, implantation, intraperitoneal injection, intramuscular injection, subcutaneous injection, or intravenous injection of the subject. In some embodiments, the 9 nucleotides at −3e to −1e of the exon flanking the 5′ splice site and +1 to +6 of the retained intron, are identical to the corresponding wild-type sequence. In some embodiments, the 16 nucleotides at −15 to −1 of the retained intron and +1e of the exon flanking the 3′ splice site are identical to the corresponding wild-type sequence.

Disclosed herein, in some embodiments, are antisense oligomers as used in the methods described herein. In some embodiments, the antisense oligomer comprises a sequence with at least about 80%, 85%, 90%, 95%, 97%, or 100% sequence identity to any one of SEQ ID NOs 34873-61443.

Also disclosed herein, in some embodiments, are pharmaceutical compositions comprising any of the aforementioned antisense oligomers and an excipient.

Disclosed herein, in some embodiments, are methods of treating a subject in need thereof by administering any of the aforementioned pharmaceutical compositions by intravitreal injection, subretinal injection, topical application, implantation, intraperitoneal injection, intramuscular injection, subcutaneous injection, or intravenous injection.

Disclosed herein, in some embodiments, are compositions comprising an antisense oligomer for use in a method of increasing expression of a target protein or a functional RNA by cells to treat Retinitis pigmentosa-7, Sveinsson chorioretinal atrophy, Fundus Albipunctatus, Retinitis pigmentosa 37, Aniridia, Coloboma of the optic nerve, Ocular coloboma, Foveal hypoplasia-1, Bilateral optic nerve hypoplasia, Cone-rod dystrophy-2, Leber congenital amaurosis-7, Retinitis Pigmentosa 30, Stargardt disease-1, Retinitis pigmentosa-19, Age-related macular degeneration-2, Cone-rod dystrophy-3, Primary open angle glaucoma, Fuchs endothelial corneal dystrophy-3, Macular dystrophy with central cone involvement, Ocular nonnephropathic cystinosis, Leber congenital amaurosis, Primary open angle glaucoma, Amyotrophic lateral sclerosis 12, Bothnia retinal dystrophy, Fundus albipunctatus, Retinitis punctata albescens, Leber congenital amaurosis 2, Retinitis pigmentosa 20, Leber congenital amaurosis 14, Retinitis pigmentosa, Eye diseases with slow clearance or accumulation of all-trans retinal (e.g. STGD1), Leber congenital amaurosis13, Retinitis pigmentosa 44, Achromatopsia-2, Jet lag, Alstrom syndrome, Attenuated MPS-1 (Hurler-scheie syndrome and Scheie syndrome) or Bardet-biedl syndrome in a subject in need thereof associated with a deficient protein or deficient functional RNA, wherein the deficient protein or deficient functional RNA is deficient in amount or activity in the subject, wherein the antisense oligomer enhances constitutive splicing of a retained intron-containing pre-mRNA (RIC pre-mRNA) encoding the target protein or the functional RNA, wherein the target protein is: (a) the deficient protein; or (b) a compensating protein which functionally augments or replaces the deficient protein or in the subject; and wherein the functional RNA is: (a) he deficient RNA; or (b) a compensating functional RNA which functionally augments or replaces the deficient functional RNA in the subject; wherein the RIC pre-mRNA comprises a retained intron, an exon flanking the 5′ splice site and an exon flanking the 3′ splice site, and wherein the retained intron is spliced from the RIC pre-mRNA encoding the target protein or the functional RNA, thereby increasing production or activity of the target protein or the functional RNA in the subject.

Disclosed herein, in some embodiments, are compositions comprising an antisense oligomer for use in a method of treating a condition associated with ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein in a subject in need thereof, the method comprising the step of increasing expression of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein by cells of the subject, wherein the cells have a retained-intron-containing pre-mRNA (RIC pre-mRNA) comprising a retained intron, an exon flanking the 5′ splice site of the retained intron, an exon flanking the 3′ splice site of the retained intron, and wherein the RIC pre-mRNA encodes the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, the method comprising contacting the cells with the antisense oligomer, whereby the retained intron is constitutively spliced from the RIC pre-mRNA transcripts encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, thereby increasing the level of mRNA encoding the target protein or functional RNA, and increasing the expression of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, in the cells of the subject. In some embodiments, the target protein is ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA. In some embodiments, the condition is a disease or disorder. In some embodiments, the disease or disorder is Retinitis pigmentosa-7, Sveinsson chorioretinal atrophy, Fundus Albipunctatus, Retinitis pigmentosa 37, Aniridia, Coloboma of the optic nerve, Ocular coloboma, Foveal hypoplasia-1, Bilateral optic nerve hypoplasia, Cone-rod dystrophy-2, Leber congenital amaurosis-7, Retinitis Pigmentosa 30, Stargardt disease-1, Retinitis pigmentosa-19, Age-related macular degeneration-2, Cone-rod dystrophy-3, Primary open angle glaucoma, Fuchs endothelial corneal dystrophy-3, Macular dystrophy with central cone involvement, Ocular nonnephropathic cystinosis, Leber congenital amaurosis, Primary open angle glaucoma, Amyotrophic lateral sclerosis 12, Bothnia retinal dystrophy, Fundus albipunctatus, Retinitis punctata albescens, Leber congenital amaurosis 2, Retinitis pigmentosa 20, Leber congenital amaurosis 14, Retinitis pigmentosa, Eye diseases with slow clearance or accumulation of all-trans retinal (e.g. STGD1), Leber congenital amaurosis13, Retinitis pigmentosa 44, Achromatopsia-2, Jet lag, Alstrom syndrome, Attenuated MPS-1 (Hurler-scheie syndrome and Scheie syndrome) or Bardet-biedl syndrome. In some embodiments, the target protein and RIC pre-mRNA are encoded by the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA gene. In some embodiments, the antisense oligomer targets a portion of the RIC pre-mRNA that is in the retained intron within the region +6 relative to the 5' splice site of the retained intron to −16 relative to the 3' splice site of the retained intron. In some embodiments, the targeted portion of the RIC pre-mRNA is in the retained intron within the region +69 relative to the 5' splice site of the retained intron to −79 relative to the 3' splice site of the retained intron. In some embodiments, the target protein is (a) ABCA4, (b) RPE65, (c) MYOC, (d) CNGA3, (e) MFSD8, (f) IDUA, (g) LRAT, (h) OPTN, (i) RGR, (j) TEAD1, (k) PAX6, (l) ROM1, (m) RDH5, (n) RDH12, (o) NR2E3, (p) RLBP1, (q) CTNS, (r) PER1, (s) FSCN2, (t) TCF4, (u) RDH8, (v) NXNL1, or (w) CRX. In some embodiments, the targeted portion of the RIC pre-mRNA comprises a sequence that is at least about 80%, 85%, 90%, 95%, 97%, or 100% complimentary to (a) any one of SEQ ID NOs 34873-35915, (b) any one of SEQ ID NOs 35916-36317, (c) any one of SEQ ID NOs 36318-37107, (d) any one of SEQ ID NOs 37108-37559, (e) any one of SEQ ID NOs 37560-38420, (0 any one of SEQ ID NOs 38421-39232, (g) any one of SEQ ID NOs 39233-41436, (h) any one of SEQ ID NOs 41437-42368, (i) any one of SEQ ID NOs 42369-43747, (j) any one of SEQ ID NOs 43748-43952, (k) any one of SEQ ID NOs 43953-49968, (l) any one of SEQ ID NOs 49969-50275, (m) any one of SEQ ID NOs 50276-50991, (n) any one of SEQ ID NOs 50992-51247, (o) any one of SEQ ID NOs 51248-52998, (p) any one of SEQ ID NOs 52999-53427, (q) any one of SEQ ID NOs 53428-54323, (r) any one of SEQ ID NOs 54324-54634, (s) any one of SEQ ID NOs 54635-55638, (t) any one of SEQ ID NOs 55639-59526, (u) any one of SEQ ID NOs 59527-59662, (v) any one of SEQ ID NOs 59663-60020, or (w) any one of SEQ ID NOs 60021-61443. In some embodiments, the targeted portion of the RIC pre-mRNA comprises a sequence with at least 80%, 85%, 90%, 95%, 97%, or 100% sequence identity to a region comprising at least 8 contiguous nucleic acids of (a) SEQ ID NO 61463, SEQ ID NO 61495, SEQ ID NO 26656, SEQ ID NO 61470, or SEQ ID NO 61453, (b) SEQ ID NO 61480, or SEQ ID NO 61460, (c) SEQ ID NO 61458 or SEQ ID NO 61485, (d) SEQ ID NO 61500, (e) SEQ ID NO 61492, or SEQ ID NO 61497, (0 SEQ ID NO 61457, SEQ ID NO 61468, SEQ ID NO 61489, SEQ ID NO 61444, or SEQ ID NO 61452, (g) SEQ ID NO 61474, (h) SEQ ID NO 61503, (i) SEQ ID NO 61446, SEQ ID NO 61476, or SEQ ID NO 61472, (j) SEQ ID NO 61461, (k) SEQ ID NO 61486, SEQ ID NO 61466, SEQ ID NO 61496, SEQ ID NO 61467, SEQ ID NO 61502, SEQ ID NO 61483, or SEQ ID NO 61448, (1) SEQ ID NO 61454, (m) SEQ ID NO 61493, SEQ ID NO 61455, SEQ ID NO 61498, or SEQ ID NO 61473, (n) SEQ ID NO 61482, (o) SEQ ID NO 61491, SEQ ID NO 61449, SEQ ID NO 61494, SEQ ID NO 61487, SEQ ID NO 61447, SEQ ID NO 61465, SEQ ID NO 61501, or SEQ ID NO 61490, (p) SEQ ID NO 61462, or SEQ ID NO 61456, (q) SEQ ID NO 61479 or SEQ ID NO 61481, (r) SEQ ID NO 61471 or SEQ ID NO 61499, (s) SEQ ID NO 61459, SEQ ID NO 61451, or SEQ ID NO 61450, (t) SEQ ID NO 61477 or SEQ ID NO 61478, (u) SEQ ID NO 61469, (v) SEQ ID NO 61488, or (w) SEQ ID NO 61484 or SEQ ID NO 61475. In some embodiments, the ASO comprises a sequence with at least about 80%, 85%, 90%, 95%, 97%, or 100% sequence identity to (a) any one of SEQ ID NOs 34873-35915, (b) any one of SEQ ID NOs 35916-36317, (c) any one of SEQ ID NOs 36318-37107, (d) any one of SEQ ID NOs 37108-37559, (e) any one of SEQ ID NOs 37560-38420, (0 any one of SEQ ID NOs 38421-39232, (g) any one of SEQ ID NOs 39233-41436, (h) any one of SEQ ID NOs 41437-42368, (i) any one of SEQ ID NOs 42369-43747, (j) any one of SEQ ID NOs 43748-43952, (k) any one of SEQ ID NOs 43953-49968, (l) any one of SEQ ID NOs 49969-50275, (m) any one of SEQ ID NOs 50276-50991, (n) any one of SEQ ID NOs 50992-51247, (o) any one of SEQ ID NOs 51248-52998, (p) any one of SEQ ID NOs 52999-53427, (q) any one of SEQ ID NOs 53428-54323, (r) any one of SEQ ID NOs 54324-54634, (s) any one of SEQ ID NOs 54635-55638, (t) any one of SEQ ID NOs 55639-59526, (u) any one of SEQ ID NOs 59527-59662, (v) any one of SEQ ID NOs 59663-60020, or (w) any one of SEQ ID NOs 60021-61443. In some embodiments, the RIC pre-mRNA comprises a sequence with at least about 80%, 85%, 90%, 95%, 97%, or 100% sequence identity to (a) SEQ ID NO 34813, (b) SEQ ID NO 34814, (c) SEQ ID NO 34815, (d) SEQ ID NO 34816 or SEQ ID NO 34817, (e) SEQ ID NO 34818, (0 SEQ ID NO 34819 or SEQ ID NO 34820, (g) SEQ ID NO 34821 or SEQ ID NO 34822, (h) SEQ ID NO 34823, SEQ ID NO 34824, SEQ ID NO 34825, or SEQ ID NO 34826, (i) SEQ ID NO 34827, SEQ ID NO 34828, or SEQ ID NO 34829, (j) SEQ ID NO 34830, (k) SEQ ID NO 34831, SEQ ID NO 34832, SEQ ID NO 34833, SEQ ID NO 34834, SEQ ID NO 34835, SEQ ID NO 34836, SEQ ID NO 34837, SEQ ID NO 34838, SEQ ID NO 34839, SEQ ID NO 34840, or SEQ ID NO 34841, (1) SEQ ID NO 34842, (m) SEQ ID NO 34843 or SEQ ID NO 34844, (n) SEQ ID NO 34845, (o) SEQ ID NO 34846 or SEQ ID NO 34847, (p) SEQ ID NO 34848, (q) SEQ ID NO 34849 or SEQ ID NO 34850, (r) SEQ ID NO 34851, (s) SEQ ID NO 34852 or SEQ ID NO 34853, (t) SEQ ID NO 34854, SEQ ID NO 34855, SEQ ID NO 34856, SEQ ID NO 34857, SEQ ID NO 34858, SEQ ID NO 34859, SEQ ID NO 34860, SEQ ID NO 34861, SEQ ID NO 34862, SEQ ID NO 34863, SEQ ID NO 34864, SEQ ID NO 34865, SEQ ID NO 34866, SEQ ID NO 34867, SEQ ID NO 34868, or SEQ ID NO 34869, (u) SEQ ID NO 34870, (v) SEQ ID NO 34871, or (w) SEQ ID NO 34872. In some embodiments, the RIC pre-mRNA is encoded by a genetic sequence with at least about 80%, 85%, 90%, 95%, 97%, or 100% sequence identity to (a) SEQ ID NO 34790, (b) SEQ ID NO 34791, (c) SEQ ID NO 34792, (d) SEQ ID NO 34793, (e) SEQ ID NO 34794, (0 SEQ ID NO 34795, (g) SEQ ID NO 34796, (h) SEQ ID NO 34797, (i) SEQ ID NO 34798, (j) SEQ ID NO 34799, (k) SEQ ID NO 34800, (1) SEQ ID NO 34801, (m) SEQ ID NO 34802, (n) SEQ ID NO 34803, (o) SEQ ID NO 34804, (p) SEQ ID NO 34805, (q) SEQ ID NO 34806, (r) SEQ ID NO 34807, (s) SEQ ID NO 34808, (t) SEQ ID NO 34809, (u) SEQ ID NO 34810, (v) SEQ ID NO 34811, (w) SEQ ID NO 34812. In some embodiments, the antisense oligomer targets a portion of the RIC pre-mRNA that is in the retained intron within: (a) the region +6 to +100 relative to the 5' splice site of the retained intron; or (b) the region −16 to −100 relative to the 3' splice site of the retained intron. In some embodiments, the antisense oligomer targets a portion of the RIC pre-mRNA that is within the region about 100 nucleotides downstream of the 5' splice site of the at least one retained intron, to about 100 nucleotides upstream of the 3' splice site of the at least one retained intron. In some embodiments, the targeted portion of the RIC pre-mRNA is within: (a) the region +2e to −4e in the exon flanking the 5' splice site of the retained intron; or (b) the region +2e to −4e in the exon flanking the 3' splice site of the retained intron.

Disclosed herein, in some embodiments, the antisense oligomer does not increase the amount of target protein or functional RNA by modulating alternative splicing of the pre-mRNA transcribed from a gene encoding the target protein or functional RNA. In some embodiments, the antisense oligomer does not increase the amount of the functional RNA or functional protein by modulating aberrant splicing resulting from mutation of the gene encoding the target protein or functional RNA. In some embodiments, the RIC pre-mRNA was produced by partial splicing from a full-length pre-mRNA or a wild-type pre-mRNA. In some embodiments, the mRNA encoding the target protein or functional RNA is a full-length mature mRNA, or a wild-type mature mRNA. In some embodiments, the target protein produced is full-length protein, or wild-type protein. In some embodiments, the retained intron is a rate-limiting intron. In some embodiments, the retained intron is the most abundant retained intron in the RIC pre-mRNA. In some embodiments, the retained intron is the second most abundant retained intron in the RIC pre-mRNA.

In some embodiments of any of the aforementioned compositions, the antisense oligomer comprises a backbone modification comprising a phosphorothioate linkage or a phosphorodiamidate linkage. In some embodiments, the antisense oligomer is an antisense oligonucleotide. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, each sugar moiety is a modified sugar moiety. In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or is 100% complementary to the targeted portion of the RIC pre-mRNA encoding the protein. In some embodiments, the antisense oligomer binds to a targeted portion of a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA.

Disclosed herein, in some embodiments, are pharmaceutical compositions comprising the antisense oligomer of any of the aforementioned compositions and an excipient.

Disclosed herein, in some embodiments, are methods of treating a subject in need thereof by administering any of the aforementioned pharmaceutical compositions by intravitreal injection, subretinal injection, topical application, implantation, intraperitoneal injection, intramuscular injection, subcutaneous injection, or intravenous injection.

Disclosed herein, in some embodiments, are pharmaceutical compositions comprising: an antisense oligomer that hybridizes to a target sequence of a deficient ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA mRNA transcript, wherein the deficient ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA mRNA transcript comprises a retained intron, wherein the antisense oligomer induces splicing out of the retained intron from the deficient ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA mRNA transcript; and a pharmaceutical acceptable excipient. In some embodiments, the deficient ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA transcript. In some embodiments, the targeted portion of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA transcript is in the retained intron within the region +500 relative to the 5' splice site of the retained intron to −500 relative to the 3' spliced site of the retained intron. In some embodiments, the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA transcript is encoded by a genetic sequence with at least about 80%, 85%, 90%, 95%, 96%, 97%, 98%, 99% or 100% sequence identity to any one of SEQ ID NOs: 34790-34812. In some embodiments, the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA transcript comprises a sequence with at least about 80%, 85%, 90%, 95%, 96%, 97%, 98%, 99% or 100% sequence identity to any one of SEQ ID NOs: 34813-34872. In some embodiments, the antisense oligomer comprises a backbone modification comprising a phosphorothioate linkage or a phosphorodiamidate linkage. In some embodiments, the antisense oligomer is an antisense oligonucleotide. In some embodiments, the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the antisense oligomer comprises at least one modified sugar moiety. In some embodiments, the antisense oligomer comprises from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the antisense oligomer is at least 80%, at least 85%, at least 90%, at least 95%, at least 98%, at least 99%, or is 100% complementary to a targeted portion of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA transcript. In some embodiments, the targeted portion of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA transcript is within a sequence selected from SEQ ID NOs: 61443-61503. In some embodiments, the antisense oligomer comprises a nucleotide sequence that is at least about 80%, 85%, 90%, 91%, 92%, 93%, 94%, 95%, 96%, 97%, 98%, or 99% sequence identity to any one of SEQ ID NOs: 34873-61443. In some embodiments, the antisense oligomer comprises a nucleotide sequence selected from SEQ ID NOs: 34873-61443. In some embodiments, the pharmaceutical composition is formulated for intrathecal injection, intracerebroventricular injection, intraperitoneal injection, intramuscular injection, subcutaneous injection, or intravenous injection.

Disclosed herein, in some embodiments, are methods of inducing processing of a deficient ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA mRNA transcript to facilitate removal of a retained intron to produce a fully processed ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA mRNA transcript that encodes a functional form of a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, the method comprising: (a) contacting an antisense oligomer to a target cell of a subject; (b) hybridizing the antisense oligomer to the deficient ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA mRNA transcript, wherein the deficient ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA mRNA transcript is capable of encoding the functional form of a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein and comprises at least one retained intron; (c) removing the at least one retained intron from the deficient ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA mRNA transcript to produce the fully processed ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA mRNA transcript that encodes the functional form of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein; and (d) translating the functional form of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein from the fully processed ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA mRNA transcript. In some embodiments, the retained intron is an entire retained intron. In some embodiments, the deficient ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA mRNA transcript is a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA transcript.

Disclosed herein, in some embodiments, are methods of treating a subject having a condition caused by a deficient amount or activity of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein comprising administering to the subject an antisense oligomer comprising a nucleotide sequence with at least about 80%, 85%, 90%, 91%, 92%, 93%, 94%, 95%, 96%, 97%, 98%, or 99% sequence identity to any one of SEQ ID NOs: 34873-61443.

In one aspect, provided herein is a method of treating a liver disease in a subject in need thereof by increasing the expression of a target protein or functional RNA by cells of the subject, wherein the cells have a retained-intron-containing pre-mRNA (RIC pre-mRNA), the RIC pre-mRNA comprising a retained intron, an exon flanking the 5' splice site, an exon flanking the 3' splice site, and wherein the RIC pre-mRNA encodes the target protein or functional RNA, the method comprising contacting the cells of the subject with an antisense oligomer (ASO) complementary to a targeted portion of the RIC pre-mRNA encoding the target protein or functional RNA, whereby the retained intron is constitutively spliced from the RIC pre-mRNA encoding the target protein or functional RNA, thereby increasing the level of mRNA encoding the target protein or functional RNA, and increasing the expression of the target protein or functional RNA in the cells of the subject.

In some embodiments, the liver disease is glycine encephalopathy, Zellweger syndrome, Heimler syndrome, Adenosine Deaminase deficiency, porphyria variegate, porphyria cutanea tarda, acute intermittent porphyria, very long chain acyl-CoA dehydrogenase deficiency, pyruvate carboxylase deficiency, isovaleric academia, hyperchylomicronemia, hypertriglyceridemia, galactosemia, hypercholesterolemia, maturity-onset diabetes of the young type 1, maturity-onset diabetes of the young type 2, maturity-onset diabetes of the young type 3, noninsulin-dependent diabetes mellitus, insulin-dependent diabetes mellitus 1, insulin-dependent diabetes mellitus 20, Falconi renotubular syndrome 4 with maturity-onset diabetes of the young, hyperinsulemic hypoglycemia familial 3, permanent neonatal diabetes mellitus, hepatic adenoma, Dowling-Degos disease 4, SHORT syndrome, immunodeficiency 36, agammaglobulinemia 7, lipid metabolism deficiency, liver inflammation, hemochromatosis type 2B, thrombocytopenia, non-alcoholic fatty liver disease, Wilson disease, tyrosinemia type I, argininosuccinate lyase deficiency, hemochromatosis type I, Alstrom syndrome, congenital bile acid synthesis defect 1, steatohepatitis, insulin resistance, glucose intolerance, type II diabetes or liver cancer.

In one aspect, provided herein is a method of increasing expression of a target protein by cells having a retained-intron-containing pre-mRNA (RIC pre-mRNA), the RIC pre-mRNA comprising a retained intron, an exon flanking the 5' splice site of the retained intron, an exon flanking the 3' splice site of the retained intron, and wherein the RIC pre-mRNA encodes the target protein, the method comprising contacting the cells with an antisense oligomer (ASO) complementary to a targeted portion of the RIC pre-mRNA encoding the target protein, whereby the retained intron is constitutively spliced from the RIC pre-mRNA encoding the target protein, thereby increasing the level of mRNA encoding the target protein, and increasing the expression of the target protein in the cells, wherein the target protein is aminomethyltransferase, adenosine deaminase, protoporphyrinogen oxidase, uroporphyrinogen decarboxylase, hydroxymethylbilane synthase, very long chain acyl-CoA dehydrogenase, pyruvate carboxylase isovaleryl-CoA dehydrogenase, apolipoprotein A-V, galactose-1-phosphate uridylyltransferase, low density lipoprotein receptor adaptor protein 1, hepatocyte nuclear factor 4-alpha, glucokinase, hepatic nuclear factor-1-alpha albumin proximal factor, 0-glucosyltransferase 1, phosphatidylinositol 3-kinase regulatory subunit 1, Tribbles-1, transforming growth factor beta-1, hemochromatosis type 2B, thrombopoietin, patatin-like phospholipase domain-containing protein 3, copper-transporting ATPase 2, fumarylacetoacetase, argininosuccinate lyase, hereditary hemochromatosis protein, alstrom syndrome protein 1, 3 beta-hydroxysteroid dehydrogenase type 7, peroxisome proliferator activated receptor delta, interleukin 6, ceramide synthase 2 or nuclear receptor coactivator 5.

In some embodiments, the target protein is aminomethyltransferase, adenosine deaminase, protoporphyrinogen oxidase, uroporphyrinogen decarboxylase, hydroxymethylbilane synthase, very long chain acyl-CoA dehydrogenase, pyruvate carboxylase isovaleryl-CoA dehydrogenase, apolipoprotein A-V, galactose-1-phosphate uridylyltransferase, low density lipoprotein receptor adaptor protein 1, hepatocyte nuclear factor 4-alpha, glucokinase, hepatic nuclear factor-1-alpha albumin proximal factor, protein O-glucosyltransferase 1, phosphatidylinositol 3-kinase regulatory subunit 1, Tribbles-1, transforming growth factor beta-1, hemochromatosis type 2B, thrombopoietin, patatin-like phospholipase domain-containing protein 3, copper-transporting ATPase 2, fumarylacetoacetase, argininosuccinate lyase, hereditary hemochromatosis protein, alstrom syndrome protein 1, 3 beta-hydroxysteroid dehydrogenase type 7, peroxisome proliferator activated receptor delta, interleukin 6, ceramide synthase 2 or nuclear receptor coactivator 5.

In some embodiments, the target protein or the functional RNA is a compensating protein or a compensating functional RNA that functionally augments or replaces a target protein or functional RNA that is deficient in amount or activity in the subject.

In some embodiments, the cells are in or from a subject having a condition caused by a deficient amount or activity of the target protein.

In some embodiments, the deficient amount of the target protein is caused by haploinsufficiency of the target protein, wherein the subject has a first allele encoding a functional target protein, and a second allele from which the target protein is not produced, or a second allele encoding a nonfunctional target protein, and wherein the antisense oligomer binds to a targeted portion of a RIC pre-mRNA transcribed from the first allele.

In some embodiments, the subject has a condition caused by a disorder resulting from a deficiency in the amount or function of the target protein, wherein the subject has a first mutant allele from which the target protein is produced at a reduced level compared to production from a wild-type allele, the target protein is produced in a form having reduced function compared to an equivalent wild-type protein, or the target protein is not produced, and a second mutant allele from which the target protein is produced at a reduced level compared to production from a wild-type allele, the target protein is produced in a form having reduced function compared to an equivalent wild-type protein, or the target protein is not produced, and wherein when the subject has a first mutant allele a(iii), the second mutant allele is b(i) or b(ii), and wherein when the subject has a second mutant allele b(iii), the first mutant allele is a(i) or a(ii), and wherein the RIC pre-mRNA is transcribed from either the first mutant allele that is a(i) or a(ii), and/or the second allele that is b(i) or b(ii)

In some embodiments, the target protein is produced in a form having reduced function compared to the equivalent wild-type protein.

In some embodiments, the target protein is produced in a form that is fully-functional compared to the equivalent wild-type protein.

In some embodiments, the targeted portion of the RIC pre-mRNA is in the retained intron within the region +6 relative to the 5' splice site of the retained intron to −16 relative to the 3' splice site of the retained intron.

In some embodiments, the targeted portion of the RIC pre-mRNA is in the retained intron within the region +69 relative to the 5' splice site of the retained intron to −79 relative to the 3' splice site of the retained intron.

In some embodiments, the targeted portion of the RIC pre-mRNA is in the retained intron within: the region +6 to +100 relative to the 5' splice site of the retained intron; or the region −16 to −100 relative to the 3' splice site of the retained intron.

In some embodiments, the targeted portion of the RIC pre-mRNA is within: the region +2e to −4e in the exon flanking the 5' splice site of the retained intron; or the region +2e to −4e in the exon flanking the 3' splice site of the retained intron.

In some embodiments, the antisense oligomer targets a portion of the RIC pre-mRNA that is within the region about 500 nucleotides downstream of the 5' splice site of the at least one retained intron, to about 500 nucleotides upstream of the 3' splice site of the at least one retained intron.

In some embodiments, the antisense oligomer targets a portion of the RIC pre-mRNA that is within the region about 100 nucleotides downstream of the 5' splice site of the at least one retained intron, to about 100 nucleotides upstream of the 3' splice site of the at least one retained intron.

In some embodiments, the target protein is (a) AMT, (b) ADA, (c) PPDX, (d) UROD, (e) HMBS, (f) ACADVL, (g) PC, (h) IVD, (i) APOA5, (j) GALT, (k) LDLRAP1, (l) HNF4A, (m) GCK, (n) POGLUT1, (o) PIK3R1, (p) HNF1A, (q) TRIB1, (r) TGFB1, (s) HAMP, (t) THPO, (u) PNPLA3, (v) ATP7B, (w) FAH, (x) ASL, (y) HFE, (z) ALMS1, (aa) PPARD, (bb) IL6, (cc) HSD3B7, (dd) CERS2, or (ee) NCOA5.

In some embodiments, the targeted portion of the RIC pre-mRNA comprises a sequence that is at least about 80%, 85%, 90%, 95%, 97%, or 100% complimentary to (a) any one of SEQ ID NOs 64316-65413, (b) any one of SEQ ID NOs 127350-128784, (c) any one of SEQ ID NOs 63403-64102, (d) any one of SEQ ID NOs 62429-63282, (e) any one of SEQ ID NOs 98986-99547, (0 any one of SEQ ID NOs 110926-111472, (g) any one of SEQ ID NOs 97403-97795, (h) any one of SEQ ID NOs 106129-108516, (i) any one of SEQ ID NOs 97796-98985, (j) any one of SEQ ID NOs 96024-97402, (k) any one of SEQ ID NOs 61634-62428, (l) any one of SEQ ID NOs 120461-127349 or 129035-138877, (m) any one of SEQ ID NOs 86561-92479, (n) any one of SEQ ID NOs 65414-66767, (o) any one of SEQ ID NOs 75976-76379, (p) any one of SEQ ID NOs 99548-103608, (q) any one of SEQ ID NOs 93972-96023, (r) any one of SEQ ID NOs 113475-113528, (s) any one of SEQ ID NOs 113173-113474, (t) any one of SEQ ID NOs 66768-75975, (u) any one of SEQ ID NOs 138878-139851, (v) any one of SEQ ID NOs 103609-105873, (w) any one of SEQ ID NOs 105874-106128, (x) any one of SEQ ID NOs 92480-93971, (y) any one of SEQ ID NOs 83313-84988, (z) any one of SEQ ID NOs 64103-64315, (aa) any one of SEQ ID NOs 76380-83312, (bb) any one of SEQ ID NOs 84989-86560, (cc) any one of SEQ ID NOs 108517-110925, (dd) any one of SEQ ID NOs 63283-63402, or any one of SEQ ID NOs 128785-129034.

In some embodiments, the targeted portion of the RIC pre-mRNA comprises a sequence with at least 80%, 85%, 90%, 95%, 97%, or 100% sequence identity to a region comprising at least 8 contiguous nucleic acids of (a) SEQ ID NO 139986, 139968 or 139937; (b) SEQ ID NO 139888, 139985 or 139872; (c) SEQ ID NO 139964, 139976, 139983 or 139924; (d) SEQ ID NO 139913, 139889, 139914, 139963 or 139966; (e) SEQ ID NO 139858, 139970 or 139957; (0 SEQ ID NO 139870, 139879, 139943, 139951, 139980, 139988, 139999, 139925 or 139915; (g) SEQ ID NO 139998, (h) SEQ ID NO 139967, 139878 or 139883; (i) SEQ ID NO 139910, 140002, 139923, 139875 or 139900; (j) SEQ ID NO 139992, 139919, 139919, 139855, 139938, 139996, 139926, 139940 or 139952; (k) SEQ ID NO 139857 or 139962; (1) SEQ ID NO 139944, 139895, 139959, 139931, 139994, 140004, 139863, 139932, 139861, 139867, 139978, 139894, 139982, 139904, 139876 or 139953; (m) SEQ ID NO 139948, 139984, 139882, 139934, 139972, 139911, 139880, 139920, 139890, 139958, 139987 or 139873; (n) SEQ ID NO 61503, 139853, 139935, 139942 or 139892; (o) SEQ ID NO 139893 or SEQ ID NO 139921, (p) SEQ ID NO 139965, 139971, 139956, 139864, 139866, 139936, 139941, 139933, 139991, 139908, 139995 or 139930; (q) SEQ ID NO 139990, 139989 or 139989; (r) SEQ ID NO 139961, (s) SEQ ID NO 140000 or 139929; (t) SEQ ID NO 139928, 139903, 139896, 139854, 139884, 139869, 139960, 139946, 139865 or 139949; (u) SEQ ID NO 139891, 139905, 139974 or 139859; (v) SEQ ID NO 139930, 139886, 139947 or 139897; (w) SEQ ID NO 139885; (x) SEQ ID NO 139997, 139907, 139874, 139868 or 139856; (y) SEQ ID NO 139922, 139887, 140003, 139927 or 139969; (z) SEQ ID NO 139902, (aa) SEQ ID NO 139917, 139981, 139975, 139862, 139898, 139860, 139877 or 139993; (bb) SEQ ID NO 139939, 139916, 139918, or 139906; (cc) SEQ ID NO 139852, 139973, 140001, 139909, 139945, 139954, 139899, 139912 or 139881; (dd) SEQ ID NO 139950; or SEQ ID NO 139955.

In some embodiments, the ASO comprises a sequence with at least about 80%, 85%, 90%, 95%, 97%, or 100% sequence identity to (a) any one of SEQ ID NOs 64316-65413, (b) any one of SEQ ID NOs 127350-128784, (c) any one of SEQ ID NOs 63403-64102, (d) any one of SEQ ID NOs 62429-63282, (e) any one of SEQ ID NOs 98986-99547, (0 any one of SEQ ID NOs 110926-111472, (g) any one of SEQ ID NOs 97403-97795, (h) any one of SEQ ID NOs 106129-108516, (i) any one of SEQ ID NOs 97796-98985, (j) any one of SEQ ID NOs 96024-97402, (k) any one of SEQ ID NOs 61634-62428, (l) any one of SEQ ID NOs 120461-127349 or 129035-138877, (m) any one of SEQ ID NOs 86561-92479, (n) any one of SEQ ID NOs 65414-66767, (o) any one of SEQ ID NOs 75976-76379, (p) any one of SEQ ID NOs 99548-103608, (q) any one of SEQ ID NOs 93972-96023, (r) any one of SEQ ID NOs 113475-113528, (s) any one of SEQ ID NOs 113173-113474, (t) any one of SEQ ID NOs 66768-75975, (u) any one of SEQ ID NOs 138878-139851, (v) any one of SEQ ID NOs 103609-105873, (w) any one of SEQ ID NOs 105874-106128, (x) any one of SEQ ID NOs 92480-93971, (y) any one of SEQ ID NOs 83313-84988, (z) any one of SEQ ID NOs 64103-64315, (aa) any one of SEQ ID NOs 76380-83312, (bb) any one of SEQ ID NOs 84989-86560, (cc) any one of SEQ ID NOs 108517-110925, (dd) any one of SEQ ID NOs 63283-63402, or any one of SEQ ID NOs 128785-129034.

In some embodiments, the RIC pre-mRNA comprises a sequence with at least about 80%, 85%, 90%, 95%, 96%, 97%, 98%, 99% or 100% sequence identity to any one of (a) SEQ ID NOs 61544-61547, (b) SEQ ID NOs 61531, 61624-61627, (c) SEQ ID NOs 61540 or 61541, (d) SEQ ID NOs 61536 or 61537, (e) SEQ ID NOs 61595-61598, (0 SEQ ID NOs 61612-61615, (g) SEQ ID NOs 61590-61592, (h) SEQ ID NOs 61607 or 61608, (i) SEQ ID NOs 61593 or 61594, (j) SEQ ID NOs 61588 or 61589, (k) SEQ ID NO 61535, (1) SEQ ID NOs 61618-61623 or 61629-61632, (m) SEQ ID NOs 61579-61581, (n) SEQ ID NOs 61548 or 61549, (o) SEQ ID NOs 61560-61563, (p) SEQ ID NOs 61599 or 61600, (q) SEQ ID NOs 61586 or 61587, (r) SEQ ID NO 61617, (s) SEQ ID NO 61726, (t) SEQ ID NOs 61550-61559, (u) SEQ ID NO 61633, (v) SEQ ID NOs 61601-61605, (w) SEQ ID NO 61606, (x) SEQ ID NOs 61583-61585, (y) SEQ ID NOs 61569-61576, (z) SEQ ID NO 61542, (aa) SEQ ID NOs 61564-61568, (bb) SEQ ID NOs 61577 or 61578, (cc) SEQ ID NOs 61609-61611, (dd) SEQ ID NOs 61538 or 61539, or SEQ ID NO 61628.

In some embodiments, the RIC pre-mRNA is encoded by a genetic sequence with at least about 80%, 85%, 90%, 95%, 96%, 97%, 98%, 99% or 100% sequence identity to (a) SEQ ID NO 61509, (b) SEQ ID NO 61531, (c) SEQ ID NO 61507, (d) SEQ ID NO 61505, (e) SEQ ID NO 61522, (0 SEQ ID NO 61528, (g) SEQ ID NO 61520, (h) SEQ ID NO 61526, (i) SEQ ID NO 61521, (j) SEQ ID NO 61519, (k) SEQ ID NO 61504, (1) SEQ ID NO 61533, (m) SEQ ID NO 61516, (n) SEQ ID NO 61510, (o) SEQ ID NO 61512, (p) SEQ ID NO 61523, (q) SEQ ID NO 61518, (r) SEQ ID NO 61530, (s) SEQ ID NO 61529, (t) SEQ ID NO 61511, (u) SEQ ID NO 61534, (v) SEQ ID NO 61524, (w) SEQ ID NO 61525, (x) SEQ ID NO 61517, (y) SEQ ID NO 61514, (z) SEQ ID NO 61508, (aa) SEQ ID NO 61513, (bb) SEQ ID NO 61515, (cc) SEQ ID NO 61527, (dd) SEQ ID NO 61506, or (ee) SEQ ID NO 61532.

In some embodiments, the antisense oligomer does not increase the amount of the target protein or the functional RNA by modulating alternative splicing of pre-mRNA transcribed from a gene encoding the functional RNA or target protein.

In some embodiments, the antisense oligomer does not increase the amount of the target protein or the functional RNA by modulating aberrant splicing resulting from mutation of the gene encoding the target protein or the functional RNA.

In some embodiments, the RIC pre-mRNA was produced by partial splicing of a full-length pre-mRNA or partial splicing of a wild-type pre-mRNA.

In some embodiments, the mRNA encoding the target protein or functional RNA is a full-length mature mRNA, or a wild-type mature mRNA.

In some embodiments, the target protein produced is full-length protein, or wild-type protein.

In some embodiments, the total amount of the mRNA encoding the target protein or functional RNA produced in the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of the mRNA encoding the target protein or functional RNA produced in a control cell.

In some embodiments, the total amount of target protein produced by the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of target protein produced by a control cell.

In some embodiments, the antisense oligomer comprises a backbone modification comprising a phosphorothioate linkage or a phosphorodiamidate linkage.

In some embodiments, the antisense oligomer comprises a phosphorodiamidate morpholino, a locked nucleic acid, a peptide nucleic acid, a 2'-O-methyl, a 2'-Fluoro, or a 2'-O-methoxy ethyl moiety.

In some embodiments, the antisense oligomer comprises at least one modified sugar moiety.

In some embodiments, each sugar moiety is a modified sugar moiety.

In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

In some embodiments, the antisense oligomer is at least 80%, at least 85%, at least 90%, at least 95%, at least 98%, at least 99%, or 100%, complementary to the targeted portion of the RIC pre-mRNA encoding the protein.

In some embodiments, the cell comprises a population of RIC pre-mRNAs transcribed from the gene encoding the target protein or functional RNA, wherein the population of RIC pre-mRNAs comprises two or more retained introns, and wherein the antisense oligomer binds to the most abundant retained intron in the population of RIC pre-mRNAs.

In some embodiments, the binding of the antisense oligomer to the most abundant retained intron induces splicing out of the two or more retained introns from the population of RIC pre-mRNAs to produce mRNA encoding the target protein or functional RNA.

In some embodiments, the cell comprises a population of RIC pre-mRNAs transcribed from the gene encoding the target protein or functional RNA, wherein the population of RIC pre-mRNAs comprises two or more retained introns, and wherein the antisense oligomer binds to the second most abundant retained intron in the population of RIC pre-mRNAs.

In some embodiments, the binding of the antisense oligomer to the second most abundant retained intron induces splicing out of the two or more retained introns from the population of RIC pre-mRNAs to produce mRNA encoding the target protein or functional RNA.

In some embodiments, the condition is a disease or disorder.

In some embodiments, the disease or disorder is a liver disease.

In some embodiments, the liver disease is glycine encephalopathy, Zellweger syndrome, Heimler syndrome, Adenosine Deaminase deficiency, porphyria variegate, porphyria cutanea tarda, acute intermittent porphyria, very long chain acyl-CoA dehydrogenase deficiency, pyruvate carboxylase deficiency, isovaleric academia, hyperchylomicronemia, hypertriglyceridemia, galactosemia, hypercholesterolemia, maturity-onset diabetes of the young type 1, maturity-onset diabetes of the young type 2, maturity-onset diabetes of the young type 3, noninsulin-dependent diabetes mellitus, insulin-dependent diabetes mellitus 1, insulin-dependent diabetes mellitus 20, Falconi renotubular syndrome 4 with maturity-onset diabetes of the young, hyperinsulemic hypoglycemia familial 3, permanent neonatal diabetes mellitus, hepatic adenoma, Dowling-Degos disease 4, SHORT syndrome, immunodeficiency 36, agammaglobulinemia 7, lipid metabolism deficiency, liver inflammation, hemochromatosis type 2B, thrombocytopenia, non-alcoholic fatty liver disease, Wilson disease, tyrosinemia type I, argininosuccinate lyase deficiency, hemochromatosis type I, Alstrom syndrome, congenital bile acid synthesis defect 1, steatohepatitis, insulin resistance, glucose intolerance, type II diabetes or liver cancer.

In some embodiments, the target protein and the RIC pre-mRNA are encoded by a gene, wherein the gene is AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5.

In some embodiments, the method further comprises assessing protein expression.

In some embodiments, the subject is a human.

In some embodiments, the subject is a non-human animal.

In some embodiments, the subject is a fetus, an embryo, or a child.

In some embodiments, the cells are ex vivo.

In some embodiments, the antisense oligomer is administered by intraperitoneal injection, intramuscular injection, subcutaneous injection, or intravenous injection of the subject.

In some embodiments, the 9 nucleotides at −3e to −1e of the exon flanking the 5' splice site and +1 to +6 of the retained intron, are identical to the corresponding wild-type sequence.

In some embodiments, the 16 nucleotides at −15 to −1 of the retained intron and +1e of the exon flanking the 3' splice site are identical to the corresponding wild-type sequence.

In one aspect, provided herein is an antisense oligomer as used in a method described herein.

In one aspect, provided herein is an antisense oligomer comprising a sequence with at least about 80%, 85%, 90%, 95%, 96%, 97%, 98%, 99% or 100% sequence identity to any one of SEQ ID NOs 61634-139851.

In one aspect, provided herein is a pharmaceutical composition comprising an antisense oligomer described herein and an excipient.

In one aspect, provided herein is a method of treating a subject in need thereof by administering a pharmaceutical composition described herein by intraperitoneal injection, intramuscular injection, subcutaneous injection, or intravenous injection.

In one aspect, provided herein is a composition comprising an antisense oligomer for use in a method of increasing expression of a target protein or a functional RNA by cells to treat a liver disease in a subject in need thereof associated with a deficient protein or deficient functional RNA, wherein the deficient protein or deficient functional RNA is deficient in amount or activity in the subject, wherein the antisense oligomer enhances constitutive splicing of a retained intron-containing pre-mRNA (RIC pre-mRNA) encoding the target protein or the functional RNA, wherein the target protein is: the deficient protein; or a compensating protein which functionally augments or replaces the deficient protein or in the subject; and wherein the functional RNA is: the deficient RNA; or a compensating functional RNA which functionally augments or replaces the deficient functional RNA in the subject; wherein the RIC pre-mRNA comprises a retained intron, an exon flanking the 5' splice site and an exon flanking the 3' splice site, and wherein the retained intron is spliced from the RIC pre-mRNA encoding the target protein or the functional RNA, thereby increasing production or activity of the target protein or the functional RNA in the subject.

In some embodiments, the liver disease is glycine encephalopathy, Zellweger syndrome, Heimler syndrome, Adenosine Deaminase deficiency, porphyria variegate, porphyria cutanea tarda, acute intermittent porphyria, very long chain acyl-CoA dehydrogenase deficiency, pyruvate carboxylase deficiency, isovaleric academia, hyperchylomicronemia, hypertriglyceridemia, galactosemia, hypercholesterolemia, maturity-onset diabetes of the young type 1, maturity-onset diabetes of the young type 2, maturity-onset diabetes of the young type 3, noninsulin-dependent diabetes mellitus, insulin-dependent diabetes mellitus 1, insulin-dependent diabetes mellitus 20, Falconi renotubular syndrome 4 with maturity-onset diabetes of the young, hyperinsulemic hypoglycemia familial 3, permanent neonatal diabetes mellitus, hepatic adenoma, Dowling-Degos disease 4, SHORT syndrome, immunodeficiency 36, agammaglobulinemia 7, lipid metabolism deficiency, liver inflammation, hemochromatosis type 2B, thrombocytopenia, non-alcoholic fatty liver disease, Wilson disease, tyrosinemia type I, argininosuccinate lyase deficiency, hemochromatosis type I, Alstrom syndrome, congenital bile acid synthesis defect 1, steatohepatitis, insulin resistance, glucose intolerance, type II diabetes or liver cancer.

In one aspect, provided herein is a composition comprising an antisense oligomer for use in a method of treating a condition associated with a target protein in a subject in need thereof, the method comprising the step of increasing expression of the target protein by cells of the subject, wherein the cells have a retained-intron-containing pre-mRNA (RIC pre-mRNA) comprising a retained intron, an exon flanking the 5' splice site of the retained intron, an exon flanking the 3' splice site of the retained intron, and wherein the RIC pre-mRNA encodes the target protein, the method comprising contacting the cells with the antisense oligomer, whereby the retained intron is constitutively spliced from the RIC pre-mRNA transcripts encoding the target protein, thereby increasing the level of mRNA encoding the target protein or functional RNA, and increasing the expression of the target protein, in the cells of the subject.

In some embodiments, the target protein is aminomethyltransferase, adenosine deaminase, protoporphyrinogen oxidase, uroporphyrinogen decarboxylase, hydroxymethylbilane synthase, very long chain acyl-CoA dehydrogenase, pyruvate carboxylase isovaleryl-CoA dehydrogenase, apolipoprotein A-V, galactose-1-phosphate uridylyltransferase, low density lipoprotein receptor adaptor protein 1, hepatocyte nuclear factor 4-alpha, glucokinase, hepatic nuclear factor-1-alpha albumin proximal factor, protein O-glucosyltransferase 1, phosphatidylinositol 3-kinase regulatory subunit 1, Tribbles-1, transforming growth factor beta-1, hemochromatosis type 2B, thrombopoietin, patatin-like phospholipase domain-containing protein 3, copper-transporting ATPase 2, fumarylacetoacetase, argininosuccinate lyase, hereditary hemochromatosis protein, alstrom syndrome protein 1, 3 beta-hydroxysteroid dehydrogenase type 7, peroxisome proliferator activated receptor delta, interleukin 6, ceramide synthase 2 or nuclear receptor coactivator 5.

In some embodiments, the condition is a disease or disorder.

In some embodiments, the disease or disorder is a liver disease.

In some embodiments, the liver disease is glycine encephalopathy, Zellweger syndrome, Heimler syndrome, Adenosine Deaminase deficiency, porphyria variegate, porphyria cutanea tarda, acute intermittent porphyria, very long chain acyl-CoA dehydrogenase deficiency, pyruvate carboxylase deficiency, isovaleric academia, hyperchylomicronemia, hypertriglyceridemia, galactosemia, hypercholesterolemia, maturity-onset diabetes of the young type 1, maturity-onset diabetes of the young type 2, maturity-onset diabetes of the young type 3, noninsulin-dependent diabetes mellitus, insulin-dependent diabetes mellitus 1, insulin-dependent diabetes mellitus 20, Falconi renotubular syndrome 4 with maturity-onset diabetes of the young, hyperinsulemic hypoglycemia familial 3, permanent neonatal diabetes mellitus, hepatic adenoma, Dowling-Degos disease 4, SHORT syndrome, immunodeficiency 36, agammaglobulinemia 7, lipid metabolism deficiency, liver inflammation, hemochromatosis type 2B, thrombocytopenia, non-alcoholic fatty liver disease, Wilson disease, tyrosinemia type I, argininosuccinate lyase deficiency, hemochromatosis type I, Alstrom syndrome, congenital bile acid synthesis defect 1, steatohepatitis, insulin resistance, glucose intolerance, type II diabetes or liver cancer.

In some embodiments, the target protein and RIC pre-mRNA are encoded by a gene, wherein the gene is AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5.

In some embodiments, the antisense oligomer targets a portion of the RIC pre-mRNA that is in the retained intron within the region +6 relative to the 5' splice site of the retained intron to −16 relative to the 3' splice site of the retained intron.

In some embodiments, the antisense oligomer targets a portion of the RIC pre-mRNA that is in the retained intron within: the region +6 to +100 relative to the 5' splice site of the retained intron; or the region −16 to −100 relative to the 3' splice site of the retained intron.

In some embodiments, the antisense oligomer targets a portion of the RIC pre-mRNA that is within the region about 500 nucleotides downstream of the 5' splice site of the at least one retained intron, to about 500 nucleotides upstream of the 3' splice site of the at least one retained intron.

In some embodiments, the antisense oligomer targets a portion of the RIC pre-mRNA that is within the region about 100 nucleotides downstream of the 5' splice site of the at least one retained intron, to about 100 nucleotides upstream of the 3' splice site of the at least one retained intron.

In some embodiments, the targeted portion of the RIC pre-mRNA is within: the region +2e to −4e in the exon flanking the 5' splice site of the retained intron; or the region +2e to −4e in the exon flanking the 3' splice site of the retained intron.

In some embodiments, the target protein is (a) AMT, (b) ADA, (c) PPDX, (d) UROD, (e) HMBS, (f) ACADVL, (g) PC, (h) IVD, (i) APOA5, (j) GALT, (k) LDLRAP1, (l) HNF4A, (m) GCK, (n) POGLUT1, (o) PIK3R1, (p) HNF1A, (q) TRIB1, (r) TGFB1, (s) HAMP, (t) THPO, (u) PNPLA3, (v) ATP7B, (w) FAH, (x) ASL, (y) HFE, (z) ALMS1, (aa) PPARD, (bb) IL6, (cc) HSD3B7, (dd) CERS2, or (ee) NCOA5.

In some embodiments, the targeted portion of the RIC pre-mRNA comprises a sequence that is at least about 80%, 85%, 90%, 95%, 96%, 97%, 98%, 99% or 100% complimentary to (a) any one of SEQ ID NOs 64316-65413, (b) any one of SEQ ID NOs 127350-128784, (c) any one of SEQ ID NOs 63403-64102, (d) any one of SEQ ID NOs 62429-63282, (e) any one of SEQ ID NOs 98986-99547, (f) any one of SEQ ID NOs 110926-111472, (g) any one of SEQ ID NOs 97403-97795, (h) any one of SEQ ID NOs 106129-108516, (i) any one of SEQ ID NOs 97796-98985, (j) any one of SEQ ID NOs 96024-97402, (k) any one of SEQ ID NOs 61634-62428, (l) any one of SEQ ID NOs 120461-127349 or 129035-138877, (m) any one of SEQ ID NOs 86561-92479, (n) any one of SEQ ID NOs 65414-66767, (o) any one of SEQ ID NOs 75976-76379, (p) any one of SEQ ID NOs 99548-103608, (q) any one of SEQ ID NOs 93972-96023, (r) any one of SEQ ID NOs 113475-113528, (s) any one of SEQ ID NOs 113173-113474, (t) any one of SEQ ID NOs 66768-75975, (u) any one of SEQ ID NOs 138878-139851, (v) any one of SEQ ID NOs 103609-105873, (w) any one of SEQ ID NOs 105874-106128, (x) any one of SEQ ID NOs 92480-93971, (y) any one of SEQ ID NOs 83313-84988, (z) any one of SEQ ID NOs 64103-64315, (aa) any one of SEQ ID NOs 76380-83312, (bb) any one of SEQ ID NOs 84989-86560, (cc) any one of SEQ ID NOs 108517-110925, (dd) any one of SEQ ID NOs 63283-63402, or any one of SEQ ID NOs 128785-129034.

In some embodiments, the targeted portion of the RIC pre-mRNA comprises a sequence with at least 80%, 85%, 90%, 95%, 96%, 97%, 98%, 99% or 100% sequence identity to a region comprising at least 8 contiguous nucleic acids of (a) SEQ ID NO 139986, 139968 or 139937; (b) SEQ ID NO 139888, 139985 or 139872; (c) SEQ ID NO 139964, 139976, 139983 or 139924; (d) SEQ ID NO 139913, 139889, 139914, 139963 or 139966; (e) SEQ ID NO 139858, 139970 or 139957; (0 SEQ ID NO 139870, 139879, 139943, 139951, 139980, 139988, 139999, 139925 or 139915; (g) SEQ ID NO 139998, (h) SEQ ID NO 139967, 139878 or 139883; (i) SEQ ID NO 139910, 140002, 139923, 139875 or 139900; (j) SEQ ID NO 139992, 139919, 139919, 139855, 139938, 139996, 139926, 139940 or 139952; (k) SEQ ID NO 139857 or 139962; (l) SEQ ID NO 139944, 139895, 139959, 139931, 139994, 140004, 139863, 139932, 139861, 139867, 139978, 139894, 139982, 139904, 139876 or 139953; (m) SEQ ID NO 139948, 139984, 139882, 139934, 139972, 139911, 139880, 139920, 139890, 139958, 139987 or 139873; (n) SEQ ID NO 61503, 139853, 139935, 139942 or 139892; (o) SEQ ID NO 139893 or SEQ ID NO 139921, (p) SEQ ID NO 139965, 139971, 139956, 139864, 139866, 139936, 139941, 139933, 139991, 139908, 139995 or 139930; (q) SEQ ID NO 139990, 139989 or 139989; (r) SEQ ID NO 139961, (s) SEQ ID NO 140000 or 139929; (t) SEQ ID NO 139928, 139903, 139896, 139854, 139884, 139869, 139960, 139946, 139865 or 139949; (u) SEQ ID NO 139891, 139905, 139974 or 139859; (v) SEQ ID NO 139930, 139886, 139947 or 139897; (w) SEQ ID NO 139885; (x) SEQ ID NO 139997, 139907, 139874, 139868 or 139856; (y) SEQ ID NO 139922, 139887, 140003, 139927 or 139969; (z) SEQ ID NO 139902, (aa) SEQ ID NO 139917, 139981, 139975, 139862, 139898, 139860, 139877 or 139993; (bb) SEQ ID NO 139939, 139916, 139918, 139901 or 139906; (cc) SEQ ID NO 139852, 139973, 140001, 139909, 139945, 139954, 139899, 139912 or 139881; (dd) SEQ ID NO 139950; or SEQ ID NO 139955.

In some embodiments, the ASO comprises a sequence with at least about 80%, 85%, 90%, 95%, 96%, 97%, 98%, 99% or 100% sequence identity to (a) any one of SEQ ID NOs 64316-65413, (b) any one of SEQ ID NOs 127350-128784, (c) any one of SEQ ID NOs 63403-64102, (d) any one of SEQ ID NOs 62429-63282, (e) any one of SEQ ID NOs 98986-99547, (f) any one of SEQ ID NOs 110926-111472, (g) any one of SEQ ID NOs 97403-97795, (h) any one of SEQ ID NOs 106129-108516, (i) any one of SEQ ID NOs 97796-98985, (j) any one of SEQ ID NOs 96024-97402, (k) any one of SEQ ID NOs 61634-62428, (l) any one of SEQ ID NOs 120461-127349 or 129035-138877, (m) any one of SEQ ID NOs 86561-92479, (n) any one of SEQ ID NOs 65414-66767, (o) any one of SEQ ID NOs 75976-76379, (p) any one of SEQ ID NOs 99548-103608, (q) any one of SEQ ID NOs 93972-96023, (r) any one of SEQ ID NOs 113475-113528, (s) any one of SEQ ID NOs 113173-113474, (t) any one of SEQ ID NOs 66768-75975, (u) any one of SEQ ID NOs 138878-139851, (v) any one of SEQ ID NOs 103609-105873, (w) any one of SEQ ID NOs 105874-106128, (x) any one of SEQ ID NOs 92480-93971, (y) any one of SEQ ID NOs 83313-84988, (z) any one of SEQ ID NOs 64103-64315, (aa) any one of SEQ ID NOs 76380-83312, (bb) any one of SEQ ID NOs 84989-86560, (cc) any one of SEQ ID NOs 108517-110925, (dd) any one of SEQ ID NOs 63283-63402, or any one of SEQ ID NOs 128785-129034.

In some embodiments, the RIC pre-mRNA comprises a sequence with at least about 80%, 85%, 90%, 95%, 96%, 97%, 98%, 99% or 100% sequence identity to any one of (a) SEQ ID NOs 6154441-6154744, (b) SEQ ID NOs 6153128, 61624121-61627124, (c) SEQ ID NOs 6154037 or 6154138, (d) SEQ ID NOs 6153633 or 6153734, (e) SEQ ID NOs 6159592-6159895, (f) SEQ ID NOs 61612109-61615112, (g) SEQ ID NOs 6159087-6159289, (h) SEQ ID NOs 61607104 or 61608105, (i) SEQ ID NOs 6159390 or 6159491, (j) SEQ ID NOs 6158885 or 6158986, (k) SEQ ID NO 6153532, (l) SEQ ID NOs 61618115-61623120 or 61629126-61632129, (m) SEQ ID NOs 6157976-6158178, (n) SEQ ID NOs 6154845 or 6154946, (o) SEQ ID NOs 6156057-6156360, (p) SEQ ID NOs 6159996 or 6160097, (q) SEQ ID NOs 6158683 or 6158784, (r) SEQ ID NO 61617114, (s) SEQ ID NO 61726223, (t) SEQ ID NOs 6155047-6155956, (u) SEQ ID NO 61633130, (v) SEQ ID NOs 6160198-61605102, (w) SEQ ID NO 61606103, (x) SEQ ID NOs 6158380-6158582, (y) SEQ ID NOs 6156966-6157673, (z) SEQ ID NO 6154239, (aa) SEQ ID NOs 6156461-6156865, (bb) SEQ ID NOs 6157774 or 6157875, (cc) SEQ ID NOs 61609106-61611108, (dd) SEQ ID NOs 6153835 or 6153936, or SEQ ID NO 61628125.

In some embodiments, the RIC pre-mRNA is encoded by a genetic sequence with at least about 80%, 85%, 90%, 95%, 96%, 97%, 98%, 99% or 100% sequence identity to (a) SEQ ID NO 61509, (b) SEQ ID NO 61531, (c) SEQ ID NO 61507, (d) SEQ ID NO 61505, (e) SEQ ID NO 61522, (f) SEQ ID NO 61528, (g) SEQ ID NO 61520, (h) SEQ ID NO 61526, (i) SEQ ID NO 61521, (j) SEQ ID NO 61519, (k) SEQ ID NO 61504, (l) SEQ ID NO 61533, (m) SEQ ID NO 61516, (n) SEQ ID NO 61510, (o) SEQ ID NO 61512, (p) SEQ ID NO 61523, (q) SEQ ID NO 61518, (r) SEQ ID NO 61530, (s) SEQ ID NO 61529, (t) SEQ ID NO 61511, (u) SEQ ID NO 61534, (v) SEQ ID NO 61524, (w) SEQ ID NO 61525, (x) SEQ ID NO 61517, (y) SEQ ID NO 61514, (z) SEQ ID NO 61508, (aa) SEQ ID NO 61513, (bb) SEQ ID NO 61515, (cc) SEQ ID NO 61527, (dd) SEQ ID NO 61506, or (ee) SEQ ID NO 61532.

In some embodiments, the antisense oligomer does not increase the amount of target protein or functional RNA by modulating alternative splicing of the pre-mRNA transcribed from a gene encoding the target protein or functional RNA.

In some embodiments, the antisense oligomer does not increase the amount of the functional RNA or functional protein by modulating aberrant splicing resulting from mutation of the gene encoding the target protein or functional RNA.

In some embodiments, the RIC pre-mRNA was produced by partial splicing from a full-length pre-mRNA or a wild-type pre-mRNA.

In some embodiments, the mRNA encoding the target protein or functional RNA is a full-length mature mRNA, or a wild-type mature mRNA.

In some embodiments, the target protein produced is full-length protein, or wild-type protein.

In some embodiments, the retained intron is a rate-limiting intron.

In some embodiments, said retained intron is the most abundant retained intron in said RIC pre-mRNA.

In some embodiments, the retained intron is the second most abundant retained intron in said RIC pre-mRNA.

In some embodiments, the antisense oligomer comprises a backbone modification comprising a phosphorothioate linkage or a phosphorodiamidate linkage.

In some embodiments, said antisense oligomer is an antisense oligonucleotide.

In some embodiments, the antisense oligomer comprises a phosphorodiamidate morpholino, a locked nucleic acid, a peptide nucleic acid, a 2'-O-methyl, a 2'-Fluoro, or a 2'-O-methoxy ethyl moiety.

In some embodiments, the antisense oligomer comprises at least one modified sugar moiety.

In some embodiments, each sugar moiety is a modified sugar moiety.

In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

In some embodiments, the antisense oligomer is at least 80%, at least 85%, at least 90%, at least 95%, at least 98%, at least 99%, or is 100% complementary to the targeted portion of the RIC pre-mRNA encoding the protein.

In one aspect, provided herein is a pharmaceutical composition comprising an antisense oligomer of any of the compositions described herein, and an excipient.

In one aspect, provided herein is a method of treating a subject in need thereof by administering a pharmaceutical composition described herein by intraperitoneal injection, intramuscular injection, subcutaneous injection, or intravenous injection.

In one aspect, provided herein is a pharmaceutical composition comprising: an antisense oligomer that hybridizes to a target sequence of a deficient AMT, ADA, PPDX, UROD, HMBS, ACADVL, PC, IVD, APOA5, GALT, LDL- RAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 mRNA transcript, wherein the deficient AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 mRNA transcript comprises a retained intron, wherein the antisense oligomer induces splicing out of the retained intron from the deficient AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 mRNA transcript; and a pharmaceutical acceptable excipient.

In some embodiments, the deficient AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 mRNA transcript is a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA transcript.

In some embodiments, the targeted portion of the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA transcript is in the retained intron within the region +500 relative to the 5' splice site of the retained intron to −500 relative to the 3' spliced site of the retained intron.

In some embodiments, the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA transcript is encoded by a genetic sequence with at least about 80%, 85%, 90%, 95%, 96%, 97%, 98%, 99% or 100% sequence identity to any one of SEQ ID NOs: 61504-61534.

In some embodiments, the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA transcript comprises a sequence with at least about 80%, 85%, 90%, 95%, 96%, 97%, 98%, 99% or 100% sequence identity to any one of SEQ ID NOs: 61535-61633.

In some embodiments, the antisense oligomer comprises a backbone modification comprising a phosphorothioate linkage or a phosphorodiamidate linkage.

In some embodiments, the antisense oligomer is an antisense oligonucleotide.

In some embodiments, the antisense oligomer comprises a phosphorodiamidate morpholino, a locked nucleic acid, a peptide nucleic acid, a 2'-O-methyl, a 2'-Fluoro, or a 2'-O-methoxy ethyl moiety.

In some embodiments, the antisense oligomer comprises at least one modified sugar moiety.

In some embodiments, the antisense oligomer comprises from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

In some embodiments, the antisense oligomer is at least 80%, at least 85%, at least 90%, at least 95%, at least 98%, at least 99%, or is 100% complementary to a targeted portion of the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA transcript.

In some embodiments, the targeted portion of the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA transcript is within a sequence selected from SEQ ID NOs: 139852-140004.

In some embodiments, the antisense oligomer comprises a nucleotide sequence with at least about 80%, 85%, 90%, 91%, 92%, 93%, 94%, 95%, 96%, 97%, 98%, or 99% sequence identity to any one of SEQ ID NOs: 61634-139851.

In some embodiments, the antisense oligomer comprises a nucleotide sequence selected from SEQ ID NOs: 61634-139851.

In some embodiments, the pharmaceutical composition is formulated for intrathecal injection, intracerebroventricular injection, intraperitoneal injection, intramuscular injection, subcutaneous injection, or intravenous injection.

In one aspect, provided herein is a method of inducing processing of a deficient AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 mRNA transcript to facilitate removal of a retained intron to produce a fully processed AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 mRNA transcript that encodes a functional form of a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 protein, the method comprising: contacting an antisense oligomer to a target cell of a subject; hybridizing the antisense oligomer to the deficient AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 mRNA transcript, wherein the deficient AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 mRNA transcript is capable of encoding the functional form of a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 protein and comprises at least one retained intron; removing the at least one retained intron from the deficient AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 mRNA transcript to produce the fully processed AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 mRNA transcript that encodes the functional form of AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 protein; and translating the functional form of AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 protein from the fully processed AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 mRNA transcript.

In some embodiments, the retained intron is an entire retained intron.

In some embodiments, the deficient AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 mRNA transcript is a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA transcript.

In one aspect, provided herein is a method of treating a subject having a condition caused by a deficient amount or activity of AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 protein comprising administering to the subject an antisense oligomer comprising a nucleotide sequence with at least about 80%, 85%, 90%, 91%, 92%, 93%, 94%, 95%, 96%, 97%, 98%, or 99% sequence identity to any one of SEQ ID NOs: 61634-139851.

In one aspect, provided herein is a method of treating a kidney disease in a subject in need thereof by increasing the expression of a target protein or functional RNA by cells of the subject, wherein the cells have a retained-intron-containing pre-mRNA (RIC pre-mRNA), the RIC pre-mRNA comprising a retained intron, an exon flanking the 5' splice site, an exon flanking the 3' splice site, and wherein the RIC pre-mRNA encodes the target protein or functional RNA, the method comprising contacting the cells of the subject with an antisense oligomer (ASO) complementary to a targeted portion of the RIC pre-mRNA encoding the target protein or functional RNA, whereby the retained intron is constitutively spliced from the RIC pre-mRNA encoding the target protein or functional RNA, thereby increasing the level of mRNA encoding the target protein or functional RNA, and increasing the expression of the target protein or functional RNA in the cells of the subject.

In some embodiments, the kidney disease is infantile nephropathic cystinosis, late-onset cystinosis, focal segmental glomerulosclerosis 7, Papillorenal syndrome, or infantile hypercalcemia.

In one aspect, provided herein is a method of increasing expression of a target protein by cells having a retained-intron-containing pre-mRNA (RIC pre-mRNA), the RIC pre-mRNA comprising a retained intron, an exon flanking the 5' splice site of the retained intron, an exon flanking the 3' splice site of the retained intron, and wherein the RIC pre-mRNA encodes the target protein, the method comprising contacting the cells with an antisense oligomer (ASO) complementary to a targeted portion of the RIC pre-mRNA encoding the target protein, whereby the retained intron is constitutively spliced from the RIC pre-mRNA encoding the target protein, thereby increasing the level of mRNA encoding the target protein, and increasing the expression of the target protein in the cells, wherein the target protein is cystinosin, protein paired box gene 2 protein, protein cytochrome P450 family 24, subfamily A, polypeptide 1, or peroxisome proliferator activated receptor delta.

In some embodiments, the target protein is cystinosin, protein paired box gene 2 protein, protein cytochrome P450 family 24, subfamily A, polypeptide 1, or peroxisome proliferator activated receptor delta.

In some embodiments, the target protein or the functional RNA is a compensating protein or a compensating functional RNA that functionally augments or replaces a target protein or functional RNA that is deficient in amount or activity in the subject.

In some embodiments, the cells are in or from a subject having a condition caused by a deficient amount or activity of the target protein.

In some embodiments, the deficient amount of the target protein is caused by haploinsufficiency of the target protein, wherein the subject has a first allele encoding a functional target protein, and a second allele from which the target protein is not produced, or a second allele encoding a nonfunctional target protein, and wherein the antisense oligomer binds to a targeted portion of a RIC pre-mRNA transcribed from the first allele.

In some embodiments, the subject has a condition caused by a disorder resulting from a deficiency in the amount or function of the target protein, wherein the subject has a first mutant allele from which the target protein is produced at a reduced level compared to production from a wild-type allele, the target protein is produced in a form having reduced function compared to an equivalent wild-type protein, or the target protein is not produced, and a second mutant allele from which the target protein is produced at a reduced level compared to production from a wild-type allele, the target protein is produced in a form having reduced function compared to an equivalent wild-type protein, or the target protein is not produced, and wherein when the subject has a first mutant allele a(iii), the second mutant allele is b(i) or b(ii), and wherein when the subject has a second mutant allele b(iii), the first mutant allele is a(i) or a(ii), and wherein the RIC pre-mRNA is transcribed from either the first mutant allele that is a(i) or a(ii), and/or the second allele that is b(i)(ii) or b(ii).

In some embodiments, the target protein is produced in a form having reduced function compared to the equivalent wild-type protein.

In some embodiments, the target protein is produced in a form that is fully-functional compared to the equivalent wild-type protein.

In some embodiments, the targeted portion of the RIC pre-mRNA is in the retained intron within the region +6 relative to the 5' splice site of the retained intron to −16 relative to the 3' splice site of the retained intron.

In some embodiments, the targeted portion of the RIC pre-mRNA is in the retained intron within the region +69 relative to the 5' splice site of the retained intron to −79 relative to the 3' splice site of the retained intron.

In some embodiments, the target protein is cystinosin.

In some embodiments, the targeted portion of the RIC pre-mRNA is in the retained intron within the region +500 relative to the 5' splice site of the retained intron to −500 relative to the 3' splice site of the retained intron.

In some embodiments, the targeted portion of the RIC pre-mRNA comprises a sequence that is at least about 80%, 85%, 90%, 95%, 96%, 97%, 98%, 99% or 100% complimentary to any one of SEQ ID NOs 148628-150072.

In some embodiments, the targeted portion of the RIC pre-mRNA comprises a sequence with at least 80%, 85%, 90%, 95%, 96%, 97%, 98%, 99% or 100% sequence identity to a region comprising at least 8 contiguous nucleic acids of SEQ ID NO 150752 or SEQ ID NO 150738.

In some embodiments, the ASO comprises a sequence with at least about 80%, 85%, 90%, 95%, 96%, 97%, 98%, 99% or 100% sequence identity to any one of SEQ ID NOs 148628-150072.

In some embodiments, the RIC pre-mRNA comprises a sequence with at least about 80%, 85%, 90%, 95%, 96%, 97%, 98%, 99% or 100% sequence identity to SEQ ID NO 140020 or SEQ ID NO 140021.

In some embodiments, the RIC pre-mRNA is encoded by a genetic sequence with at least about 80%, 85%, 90%, 95%, 96%, 97%, 98%, 99% or 100% sequence identity to SEQ ID NO 140007.

In some embodiments, the target protein is paired box gene 2 protein.

In some embodiments, the targeted portion of the RIC pre-mRNA is in the retained intron within the region +500 relative to the 5' splice site of the retained intron to −500 relative to the 3' splice site of the retained intron.

In some embodiments, the targeted portion of the RIC pre-mRNA comprises a sequence that is at least about 80%, 85%, 90%, 95%, 96%, 97%, 98%, 99% or 100% complimentary to any one of SEQ ID NOs. 146957-148627.

In some embodiments, the targeted portion of the RIC pre-mRNA comprises a sequence with at least 80%, 85%, 90%, 95%, 96%, 97%, 98%, 99% or 100% sequence identity to a region comprising at least 8 contiguous nucleic acids of SEQ ID NO 150742 or SEQ ID NO 150744.

In some embodiments, the ASO comprises a sequence with at least about 80%, 85%, 90%, 95%, 96%, 97%, 98%, 99% or 100% sequence identity to any one of SEQ ID NOs 146957-148627.

In some embodiments, the RIC pre-mRNA comprises a sequence with at least about 80%, 85%, 90%, 95%, 96%, 97%, 98%, 99% or 100% sequence identity to any one of SEQ ID NOs 140014-140019.

In some embodiments, the RIC pre-mRNA is encoded by a genetic sequence with at least about 80%, 85%, 90%, 95%, 96%, 97%, 98%, 99% or 100% sequence identity to SEQ ID NO 140006.

In some embodiments, the target protein is protein cytochrome P450 family 24, subfamily A, polypeptide 1.

In some embodiments, the targeted portion of the RIC pre-mRNA is in the retained intron within the region +500 relative to the 5' splice site of the retained intron to −500 relative to the 3' splice site of the retained intron.

In some embodiments, the targeted portion of the RIC pre-mRNA comprises a sequence that is at least about 80%, 85%, 90%, 95%, 96%, 97%, 98%, 99% or 100% complimentary to any one of SEQ ID NOs. 149524-150737.

In some embodiments, the targeted portion of the RIC pre-mRNA comprises a sequence with at least 80%, 85%, 90%, 95%, 96%, 97%, 98%, 99% or 100% sequence identity to a region comprising at least 8 contiguous nucleic acids of SEQ ID NO 150752, SEQ ID NO 150738, SEQ ID NO 150750, SEQ ID NO 150749 or SEQ ID NO 150745.

In some embodiments, the ASO comprises a sequence with at least about 80%, 85%, 90%, 95%, 96%, 97%, 98%, 99% or 100% sequence identity to any one of SEQ ID NOs 149524-150737.

In some embodiments, the RIC pre-mRNA comprises a sequence with at least about 80%, 85%, 90%, 95%, 96%, 97%, 98%, 99% or 100% sequence identity to any one of SEQ ID NOs 140020-140023.

In some embodiments, the RIC pre-mRNA is encoded by a genetic sequence with at least about 80%, 85%, 90%, 95%, 96%, 97%, 98%, 99% or 100% sequence identity to SEQ ID NO 140008.

In some embodiments, the target protein is peroxisome proliferator activated receptor delta.

In some embodiments, the targeted portion of the RIC pre-mRNA is in the retained intron within the region +500 relative to the 5' splice site of the retained intron to −500 relative to the 3' splice site of the retained intron.

In some embodiments, the targeted portion of the RIC pre-mRNA comprises a sequence that is at least about 80%, 85%, 90%, 95%, 96%, 97%, 98%, 99% or 100% complimentary to any one of SEQ ID NOs 140024-146956.

In some embodiments, the targeted portion of the RIC pre-mRNA comprises a sequence with at least 80%, 85%, 90%, 95%, 96%, 97%, 98%, 99% or 100% sequence identity to a region comprising at least 8 contiguous nucleic acids of SEQ ID NO 150740, SEQ ID NO 150751, SEQ ID NO 150743, SEQ ID NO 150747, SEQ ID NO 150746, SEQ ID NO 150741, SEQ ID NO 150739, or SEQ ID NO 150748.

In some embodiments, the ASO comprises a sequence with at least about 80%, 85%, 90%, 95%, 96%, 97%, 98%, 99% or 100% sequence identity to any one of SEQ ID NOs 140024-146956.

In some embodiments, the RIC pre-mRNA comprises a sequence with at least about 80%, 85%, 90%, 95%, 96%, 97%, 98%, 99% or 100% sequence identity to any one of SEQ ID NOs 140009-140013.

In some embodiments, the RIC pre-mRNA is encoded by a genetic sequence with at least about 80%, 85%, 90%, 95%, 96%, 97%, 98%, 99% or 100% sequence identity to SEQ ID NO 140005.

In some embodiments, the targeted portion of the RIC pre-mRNA is in the retained intron within: the region +6 to +100 relative to the 5' splice site of the retained intron; or the region −16 to −100 relative to the 3' splice site of the retained intron.

In some embodiments, the antisense oligomer targets a portion of the RIC pre-mRNA that is within the region about 100 nucleotides downstream of the 5' splice site of the at least one retained intron, to about 100 nucleotides upstream of the 3' splice site of the at least one retained intron In some embodiments, the targeted portion of the RIC pre-mRNA is within: the region +2e to −4e in the exon flanking the 5' splice site of the retained intron; or the region +2e to −4e in the exon flanking the 3' splice site of the retained intron.

In some embodiments, the antisense oligomer does not increase the amount of the target protein or the functional RNA by modulating alternative splicing of pre-mRNA transcribed from a gene encoding the functional RNA or target protein.

In some embodiments, the antisense oligomer does not increase the amount of the target protein or the functional RNA by modulating aberrant splicing resulting from mutation of the gene encoding the target protein or the functional RNA.

In some embodiments, the RIC pre-mRNA was produced by partial splicing of a full-length pre-mRNA or partial splicing of a wild-type pre-mRNA.

In some embodiments, the mRNA encoding the target protein or functional RNA is a full-length mature mRNA, or a wild-type mature mRNA.

In some embodiments, the target protein produced is full-length protein, or wild-type protein.

In some embodiments, the total amount of the mRNA encoding the target protein or functional RNA produced in the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of the mRNA encoding the target protein or functional RNA produced in a control cell.

In some embodiments, the total amount of target protein produced by the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of target protein produced by a control cell.

In some embodiments, the antisense oligomer comprises a backbone modification comprising a phosphorothioate linkage or a phosphorodiamidate linkage.

In some embodiments, the antisense oligomer comprises a phosphorodiamidate morpholino, a locked nucleic acid, a peptide nucleic acid, a 2'-O-methyl, a 2'-Fluoro, or a 2'-O-methoxy ethyl moiety.

In some embodiments, the antisense oligomer comprises at least one modified sugar moiety.

In some embodiments, each sugar moiety is a modified sugar moiety.

In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

In some embodiments, the antisense oligomer is at least 80%, at least 85%, at least 90%, at least 95%, at least 98%, at least 99%, or 100%, complementary to the targeted portion of the RIC pre-mRNA encoding the protein.

In some embodiments, the cell comprises a population of RIC pre-mRNAs transcribed from the gene encoding the target protein or functional RNA, wherein the population of RIC pre-mRNAs comprises two or more retained introns, and wherein the antisense oligomer binds to the most abundant retained intron in the population of RIC pre-mRNAs.

In some embodiments, the binding of the antisense oligomer to the most abundant retained intron induces splicing out of the two or more retained introns from the population of RIC pre-mRNAs to produce mRNA encoding the target protein or functional RNA.

In some embodiments, the cell comprises a population of RIC pre-mRNAs transcribed from the gene encoding the target protein or functional RNA, wherein the population of RIC pre-mRNAs comprises two or more retained introns, and wherein the antisense oligomer binds to the second most abundant retained intron in the population of RIC pre-mRNAs.

In some embodiments, the binding of the antisense oligomer to the second most abundant retained intron induces splicing out of the two or more retained introns from the population of RIC pre-mRNAs to produce mRNA encoding the target protein or functional RNA.

In some embodiments, the condition is a disease or disorder.

In some embodiments, the disease or disorder is a kidney disease.

In some embodiments, the kidney disease is infantile nephropathic cystinosis, late-onset cystinosis, focal segmental glomerulosclerosis 7, Papillorenal syndrome, or infantile hypercalcemia.

In some embodiments, the target protein and the RIC pre-mRNA are encoded by a gene, wherein the gene is CTNS, PAX2, CYP24A1 or PPARD.

In some embodiments, the method further comprises assessing protein expression.

In some embodiments, the subject is a human.

In some embodiments, the subject is a non-human animal.

In some embodiments, the subject is a fetus, an embryo, or a child.

In some embodiments, the cells are ex vivo.

In some embodiments, the antisense oligomer is administered by intraperitoneal injection, intramuscular injection, subcutaneous injection, or intravenous injection of the subject.

In some embodiments, the 9 nucleotides at −3e to −1e of the exon flanking the 5' splice site and +1 to +6 of the retained intron, are identical to the corresponding wild-type sequence.

In some embodiments, the 16 nucleotides at −15 to −1 of the retained intron and +1e of the exon flanking the 3' splice site are identical to the corresponding wild-type sequence.

In one aspect, provided herein is an antisense oligomer as used in a method described herein.

In one aspect, provided herein is an antisense oligomer comprising a sequence with at least about 80%, 85%, 90%, 95%, 96%, 97%, 98%, 99% or 100% sequence identity to any one of SEQ ID NOs 140024-150737.

In one aspect, provided herein is a pharmaceutical composition comprising an antisense oligomer described herein and an excipient.

In one aspect, provided herein is a method of treating a subject in need thereof by administering a pharmaceutical composition disclosed herein by intraperitoneal injection, intramuscular injection, subcutaneous injection, or intravenous injection.

In one aspect, provided herein is a composition comprising an antisense oligomer for use in a method of increasing expression of a target protein or a functional RNA by cells to treat a kidney disease in a subject in need thereof associated with a deficient protein or deficient functional RNA, wherein the deficient protein or deficient functional RNA is deficient in amount or activity in the subject, wherein the antisense oligomer enhances constitutive splicing of a retained intron-containing pre-mRNA (RIC pre-mRNA) encoding the target protein or the functional RNA, wherein the target protein is: the deficient protein; or a compensating protein which functionally augments or replaces the deficient protein or in the subject; and wherein the functional RNA is: the deficient RNA; or a compensating functional RNA which functionally augments or replaces the deficient functional RNA in the subject; wherein the RIC pre-mRNA comprises a retained intron, an exon flanking the 5' splice site and an exon flanking the 3' splice site, and wherein the retained intron is spliced from the RIC pre-mRNA encoding the target protein or the functional RNA, thereby increasing production or activity of the target protein or the functional RNA in the subject.

In some embodiments, the kidney disease is infantile nephropathic cystinosis, late-onset cystinosis, focal segmental glomerulosclerosis 7, Papillorenal syndrome, or infantile hypercalcemia.

In one aspect, provided herein is a composition comprising an antisense oligomer for use in a method of treating a condition associated with a target protein in a subject in need thereof, the method comprising the step of increasing expression of the target protein by cells of the subject, wherein the cells have a retained-intron-containing pre-mRNA (RIC pre-mRNA) comprising a retained intron, an exon flanking the 5' splice site of the retained intron, an exon flanking the 3' splice site of the retained intron, and wherein the RIC pre-mRNA encodes the target protein, the method comprising contacting the cells with the antisense oligomer, whereby the retained intron is constitutively spliced from the RIC pre-mRNA transcripts encoding the target protein, thereby increasing the level of mRNA encoding the target protein or functional RNA, and increasing the expression of the target protein, in the cells of the subject.

In some embodiments, the target protein is cystinosin, protein paired box gene 2 protein, protein cytochrome P450 family 24, subfamily A, polypeptide 1, or peroxisome proliferator activated receptor delta.

In some embodiments, the condition is a disease or disorder.

In some embodiments, the disease or disorder is a kidney disease.

In some embodiments, the kidney disease is infantile nephropathic cystinosis, late-onset cystinosis, focal segmental glomerulosclerosis 7, Papillorenal syndrome, or infantile hypercalcemia.

In some embodiments, the target protein and RIC pre-mRNA are encoded by a gene, wherein the gene is CTNS, PAX2, CYP24A1 or PPARD.

In some embodiments, the antisense oligomer targets a portion of the RIC pre-mRNA that is in the retained intron within the region +6 relative to the 5' splice site of the retained intron to −16 relative to the 3' splice site of the retained intron.

In some embodiments, the targeted portion of the RIC pre-mRNA is in the retained intron within the region +69 relative to the 5' splice site of the retained intron to −79 relative to the 3' splice site of the retained intron.

In some embodiments, the target protein is cystinosin.

In some embodiments, the targeted portion of the RIC pre-mRNA is in the retained intron within the region +500 relative to the 5' splice site of the retained intron to −500 relative to the 3' of the retained intron.

In some embodiments, the targeted portion of the RIC pre-mRNA comprises a sequence that is at least about 80%, 85%, 90%, 95%, 96%, 97%, 98%, 99% or 100% complimentary to any one of SEQ ID NOs 148628-150072.

In some embodiments, the targeted portion of the RIC pre-mRNA comprises a sequence with at least 80%, 85%, 90%, 95%, 96%, 97%, 98%, 99% or 100% sequence identity to a region comprising at least 8 contiguous nucleic acids of SEQ ID NO 150752 or SEQ ID NO 150738.

In some embodiments, the ASO comprises a sequence with at least about 80%, 85%, 90%, 95%, 96%, 97%, 98%, 99% or 100% sequence identity to any one of SEQ ID NOs 148628-150072.

In some embodiments, the RIC pre-mRNA comprises a sequence with at least about 80%, 85%, 90%, 95%, 96%, 97%, 98%, 99% or 100% sequence identity to SEQ ID NO 140020 or SEQ ID NO 140021.

In some embodiments, the RIC pre-mRNA is encoded by a genetic sequence with at least about 80%, 85%, 90%, 95%, 96%, 97%, 98%, 99% or 100% sequence identity to SEQ ID NO 140007.

In some embodiments, the target protein is paired box gene 2 protein.

In some embodiments, the targeted portion of the RIC pre-mRNA is in the retained intron within the region +500 relative to the 5' splice site of the retained intron to −500 relative to the 3' splice site of the retained intron.

In some embodiments, the targeted portion of the RIC pre-mRNA comprises a sequence that is at least about 80%, 85%, 90%, 95%, 96%, 97%, 98%, 99% or 100% complimentary to any one of SEQ ID NOs. 146957-148627.

In some embodiments, the targeted portion of the RIC pre-mRNA comprises a sequence with at least 80%, 85%, 90%, 95%, 96%, 97%, 98%, 99% or 100% sequence identity to a region comprising at least 8 contiguous nucleic acids of SEQ ID NO 150742 or SEQ ID NO 150744.

In some embodiments, the ASO comprises a sequence with at least about 80%, 85%, 90%, 95%, 96%, 97%, 98%, 99% or 100% sequence identity to any one of SEQ ID NOs 146957-148627.

In some embodiments, the RIC pre-mRNA comprises a sequence with at least about 80%, 85%, 90%, 95%, 96%, 97%, 98%, 99% or 100% sequence identity to any one of SEQ ID NOs 140014-140019.

In some embodiments, the RIC pre-mRNA is encoded by a genetic sequence with at least about 80%, 85%, 90%, 95%, 96%, 97%, 98%, 99% or 100% sequence identity to SEQ ID NO 140006.

In some embodiments, the target protein is protein cytochrome P450 family 24, subfamily A, polypeptide 1.

In some embodiments, the targeted portion of the RIC pre-mRNA is in the retained intron within the region +500 relative to the 5' splice site of the retained intron to −500 relative to the 3' splice site of the retained intron.

In some embodiments, the targeted portion of the RIC pre-mRNA comprises a sequence that is at least about 80%, 85%, 90%, 95%, 96%, 97%, 98%, 99% or 100% complimentary to any one of SEQ ID NOs. 149524-150737.

In some embodiments, the targeted portion of the RIC pre-mRNA comprises a sequence with at least 80%, 85%, 90%, 95%, 96%, 97%, 98%, 99% or 100% sequence identity to a region comprising at least 8 contiguous nucleic acids of SEQ ID NO 150752, SEQ ID NO 150738, SEQ ID NO 150750, SEQ ID NO 150749 or SEQ ID NO 150745.

In some embodiments, the ASO comprises a sequence with at least about 80%, 85%, 90%, 95%, 96%, 97%, 98%, 99% or 100% sequence identity to any one of SEQ ID NOs 149524-150737.

In some embodiments, the RIC pre-mRNA comprises a sequence with at least about 80%, 85%, 90%, 95%, 96%, 97%, 98%, 99% or 100% sequence identity to any one of SEQ ID NOs 140020-19.

In some embodiments, the RIC pre-mRNA is encoded by a genetic sequence with at least about 80%, 85%, 90%, 95%, 96%, 97%, 98%, 99% or 100% sequence identity to SEQ ID NO 140008.

In some embodiments, the target protein is peroxisome proliferator activated receptor delta.

In some embodiments, the targeted portion of the RIC pre-mRNA is in the retained intron within the region +500 relative to the 5' splice site of the retained intron to −500 relative to the 3' splice site of the retained intron.

In some embodiments, the targeted portion of the RIC pre-mRNA comprises a sequence that is at least about 80%, 85%, 90%, 95%, 96%, 97%, 98%, 99% or 100% complimentary to any one of SEQ ID NOs 140024-146956.

In some embodiments, the targeted portion of the RIC pre-mRNA comprises a sequence with at least 80%, 85%, 90%, 95%, 96%, 97%, 98%, 99% or 100% sequence identity to a region comprising at least 8 contiguous nucleic acids of SEQ ID NO 150740, SEQ ID NO 150751, SEQ ID NO 150743, SEQ ID NO 150747, SEQ ID NO 150746, SEQ ID NO 150741, SEQ ID NO 150739, or SEQ ID NO 150748.

In some embodiments, the ASO comprises a sequence with at least about 80%, 85%, 90%, 95%, 96%, 97%, 98%, 99% or 100% sequence identity to any one of SEQ ID NOs 140024-146956.

In some embodiments, the RIC pre-mRNA comprises a sequence with at least about 80%, 85%, 90%, 95%, 96%, 97%, 98%, 99% or 100% sequence identity to any one of SEQ ID NOs 140009-140013.

In some embodiments, the RIC pre-mRNA is encoded by a genetic sequence with at least about 80%, 85%, 90%, 95%, 96%, 97%, 98%, 99% or 100% sequence identity to SEQ ID NO 140005.

In some embodiments, the antisense oligomer targets a portion of the RIC pre-mRNA that is in the retained intron within: the region +6 to +100 relative to the 5' splice site of the retained intron; or the region −16 to −100 relative to the 3' splice site of the retained intron.

In some embodiments, the antisense oligomer targets a portion of the RIC pre-mRNA that is within the region about 100 nucleotides downstream of the 5' splice site of the at least one retained intron, to about 100 nucleotides upstream of the 3' splice site of the at least one retained intron.

In some embodiments, the targeted portion of the RIC pre-mRNA is within: the region +2e to −4e in the exon flanking the 5' splice site of the retained intron; or the region +2e to −4e in the exon flanking the 3' splice site of the retained intron.

In some embodiments, the antisense oligomer does not increase the amount of target protein or functional RNA by modulating alternative splicing of the pre-mRNA transcribed from a gene encoding the target protein or functional RNA.

In some embodiments, the antisense oligomer does not increase the amount of the functional RNA or functional protein by modulating aberrant splicing resulting from mutation of the gene encoding the target protein or functional RNA.

In some embodiments, the RIC pre-mRNA was produced by partial splicing from a full-length pre-mRNA or a wild-type pre-mRNA.

In some embodiments, the mRNA encoding the target protein or functional RNA is a full-length mature mRNA, or a wild-type mature mRNA.

In some embodiments, the target protein produced is full-length protein, or wild-type protein.

In some embodiments, the retained intron is a rate-limiting intron.

In some embodiments, said retained intron is the most abundant retained intron in said RIC pre-mRNA.

In some embodiments, the retained intron is the second most abundant retained intron in said RIC pre-mRNA.

In some embodiments, the antisense oligomer comprises a backbone modification comprising a phosphorothioate linkage or a phosphorodiamidate linkage.

In some embodiments, said antisense oligomer is an antisense oligonucleotide.

In some embodiments, the antisense oligomer comprises a phosphorodiamidate morpholino, a locked nucleic acid, a peptide nucleic acid, a 2'-O-methyl, a 2'-Fluoro, or a 2'-O-methoxy ethyl moiety.

In some embodiments, the antisense oligomer comprises at least one modified sugar moiety.

In some embodiments, each sugar moiety is a modified sugar moiety.

In some embodiments, the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

In some embodiments, the antisense oligomer is at least 80%, at least 85%, at least 90%, at least 95%, at least 98%, at least 99%, or is 100% complementary to the targeted portion of the RIC pre-mRNA encoding the protein.

In one aspect, provided herein is a pharmaceutical composition comprising an antisense oligomer described herein, and an excipient.

In one aspect, provided herein is a method of treating a subject in need thereof by administering a pharmaceutical composition described herein by intraperitoneal injection, intramuscular injection, subcutaneous injection, or intravenous injection.

In one aspect, provided herein is a pharmaceutical composition comprising: an antisense oligomer that hybridizes to a target sequence of a deficient CTNS, PAX2, CYP24A1 or PPARD mRNA transcript, wherein the deficient CTNS, PAX2, CYP24A1 or PPARD mRNA transcript comprises a retained intron, wherein the antisense oligomer induces splicing out of the retained intron from the deficient CTNS, PAX2, CYP24A1 or PPARD mRNA transcript; and a pharmaceutical acceptable excipient.

In some embodiments, the deficient CTNS, PAX2, CYP24A1 or PPARD mRNA transcript is a CTNS, PAX2, CYP24A1 or PPARD RIC pre-mRNA transcript.

In some embodiments, the targeted portion of the CTNS, PAX2, CYP24A1 or PPARD RIC pre-mRNA transcript is in the retained intron within the region +500 relative to the 5' splice site of the retained intron to −500 relative to the 3' spliced site of the retained intron.

In some embodiments, the CTNS, PAX2, CYP24A1 or PPARD RIC pre-mRNA transcript is encoded by a genetic sequence with at least about 80%, 85%, 90%, 95%, 96%, 97%, 98%, 99% or 100% sequence identity to any one of SEQ ID NOs: 140005-140008.

In some embodiments, the CTNS, PAX2, CYP24A1 or PPARD RIC pre-mRNA transcript comprises a sequence with at least about 80%, 85%, 90%, 95%, 96%, 97%, 98%, 99% or 100% sequence identity to any one of SEQ ID NOs: 140009-140023.

In some embodiments, the antisense oligomer comprises a backbone modification comprising a phosphorothioate linkage or a phosphorodiamidate linkage.

In some embodiments, the antisense oligomer is an antisense oligonucleotide.

In some embodiments, the antisense oligomer comprises a phosphorodiamidate morpholino, a locked nucleic acid, a peptide nucleic acid, a 2'-O-methyl, a 2'-Fluoro, or a 2'-O-methoxy ethyl moiety.

In some embodiments, the antisense oligomer comprises at least one modified sugar moiety.

In some embodiments, the antisense oligomer comprises from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

In some embodiments, the antisense oligomer is at least 80%, at least 85%, at least 90%, at least 95%, at least 98%, at least 99%, or is 100% complementary to a targeted portion of the CTNS, PAX2, CYP24A1 or PPARD RIC pre-mRNA transcript.

In some embodiments, the targeted portion of the CTNS, PAX2, CYP24A1 or PPARD RIC pre-mRNA transcript is within a sequence selected from SEQ ID NOs: 150038-150752.

In some embodiments, the antisense oligomer comprises a nucleotide sequence that is at least about 80%, 85%, 90%, 91%, 92%, 93%, 94%, 95%, 96%, 97%, 98%, or 99% sequence identity to any one of SEQ ID NOs: 140024-150737.

In some embodiments, the antisense oligomer comprises a nucleotide sequence selected from SEQ ID NOs: 140024-150737.

In some embodiments, the pharmaceutical composition is formulated for intrathecal injection, intracerebroventricular injection, intraperitoneal injection, intramuscular injection, subcutaneous injection, or intravenous injection.

In one aspect, provided herein is a method of inducing processing of a deficient CTNS, PAX2, CYP24A1 or PPARD mRNA transcript to facilitate removal of a retained intron to produce a fully processed CTNS, PAX2, CYP24A1 or PPARD mRNA transcript that encodes a functional form of a CTNS, PAX2, CYP24A1 or PPARD protein, the method comprising: contacting an antisense oligomer to a target cell of a subject; hybridizing the antisense oligomer to the deficient CTNS, PAX2, CYP24A1 or PPARD mRNA transcript, wherein the deficient CTNS, PAX2, CYP24A1 or PPARD mRNA transcript is capable of encoding the functional form of a CTNS, PAX2, CYP24A1 or PPARD protein and comprises at least one retained intron; removing the at least one retained intron from the deficient CTNS, PAX2, CYP24A1 or PPARD mRNA transcript to produce the fully processed CTNS, PAX2, CYP24A1 or PPARD mRNA transcript that encodes the functional form of CTNS, PAX2, CYP24A1 or PPARD protein; and translating the functional form of CTNS, PAX2, CYP24A1 or PPARD protein from the fully processed CTNS, PAX2, CYP24A1 or PPARD mRNA transcript.

In some embodiments, the retained intron is an entire retained intron.

In some embodiments, the deficient CTNS, PAX2, CYP24A1 or PPARD mRNA transcript is a CTNS, PAX2, CYP24A1 or PPARD RIC pre-mRNA transcript.

In one aspect, provided herein is a method of treating a subject having a condition caused by a deficient amount or activity of CTNS, PAX2, CYP24A1 or PPARD protein comprising administering to the subject an antisense oligomer comprising a nucleotide sequence with at least about 80%, 85%, 90%, 91%, 92%, 93%, 94%, 95%, 96%, 97%, 98%, or 99% sequence identity to any one of SEQ ID NOs: 140024-150737.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings.

FIG. 2A shows a cell divided into nuclear and cytoplasmic compartments. In the nucleus, a pre-mRNA transcript of a target gene consisting of exons (rectangles) and introns (connecting lines) undergoes splicing to generate an mRNA, and this mRNA is exported to the cytoplasm and translated into target protein. For this target gene, the splicing of intron 1 is inefficient and a retained intron-containing (RIC) pre-mRNA accumulates primarily in the nucleus, and if exported to the cytoplasm, is degraded, leading to no target protein production. FIG. 2B shows an example of the same cell divided into nuclear and cytoplasmic compartments. Treatment with an antisense oligomer (ASO) promotes the splicing of intron 1 and results in an increase in mRNA, which is in turn translated into higher levels of target protein

FIG. 121 depicts a schematic of the RefSeq Genes for CTNS corresponding to NM_004937 and NM_001031681. The Percent Intron Retention (PIR) of the circled intron is shown.

Figure 122:
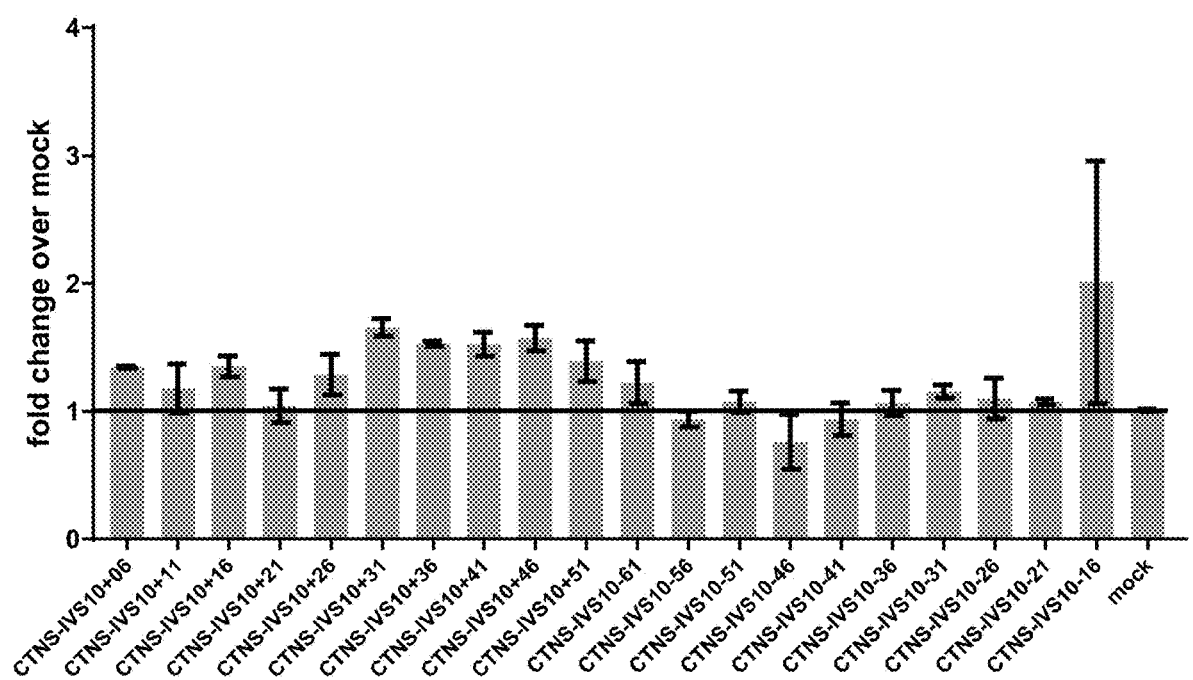

FIG. 122 depicts an exemplary graph showing the fold change in expression levels of CTNS mRNA without intron 10 in ARPE-19 cells treated for 24 hrs with 80 nM of the indicated ASOs over mock treated cells. Data is normalized to RPL32 expression.

Figure 123A:
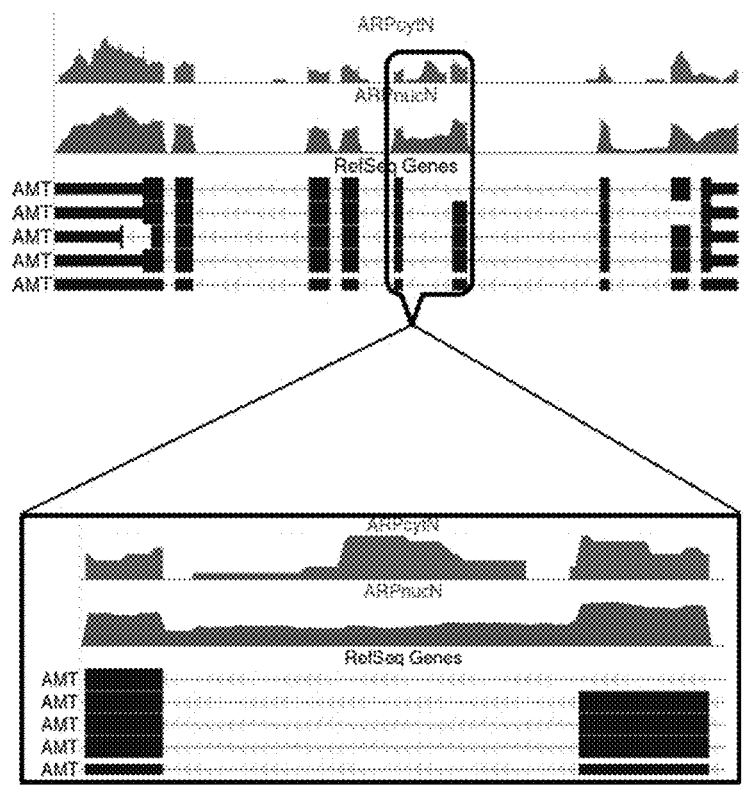

FIG. 123A depicts a schematic of the RefSeq Genes for AMT corresponding to NM_001164710, NM_00116471,1 NM_001164712, NM_000481 and NR_028435. The Percent Intron Retention (PIR) of the circled intron is shown.

Figure 123B:
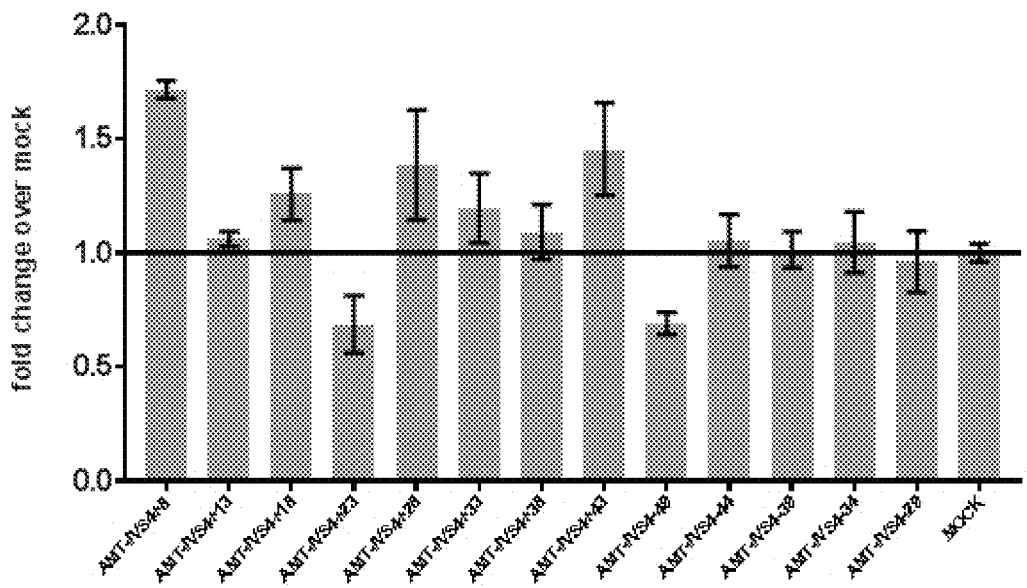

FIG. 123B depicts an exemplary graph showing the average (n=3) fold change in expression levels of AMT mRNA without intron 4 in ARPE-19 cells treated for 24 hrs with 80 nM of the indicated ASOs (spanning the exon 4-exon 5 splice junction) over mock treated cells. Data is normalized to RPL32 expression.

Figure 123C:
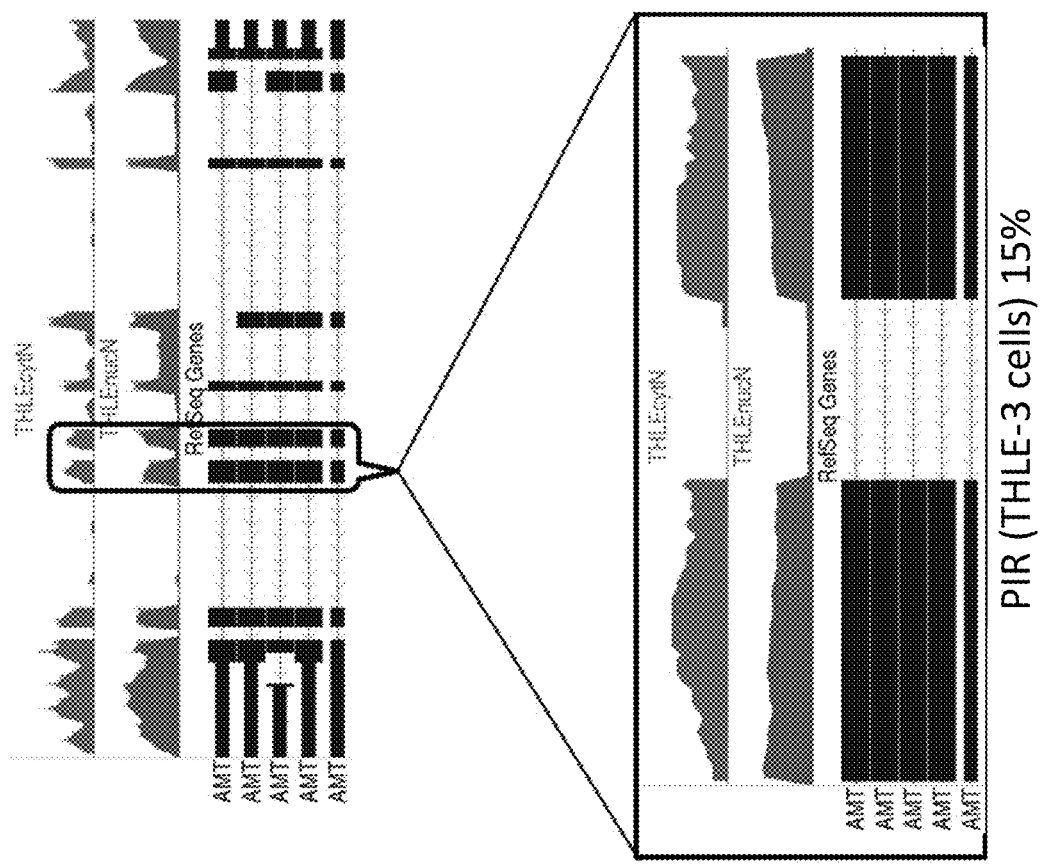

FIG. 123C depicts a schematic of the RefSeq Genes for AMT corresponding to NM_001164710, NM_00116471,1 NM_001164712, NM_000481 and NR_028435. The Percent Intron Retention (PIR) of the circled intron is shown.

Figure 124A:
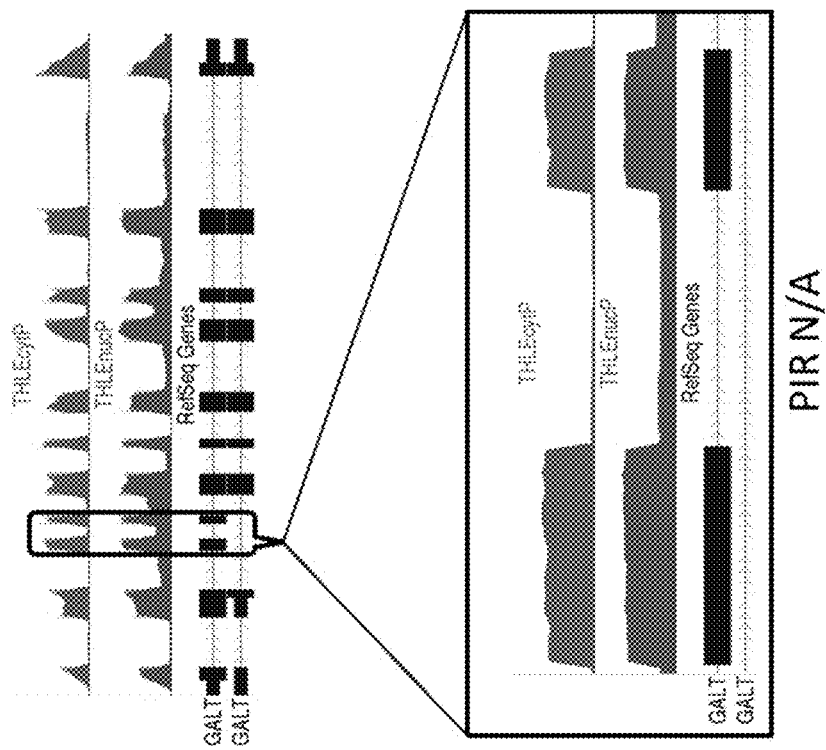

FIG. 124A depicts a schematic of the RefSeq Genes for GALT corresponding to GALT: NM_000155 and NM_001258332. The Percent Intron Retention (PIR) of the circled intron is shown (GALT intron 2, NM_000155).

Figure 124B:
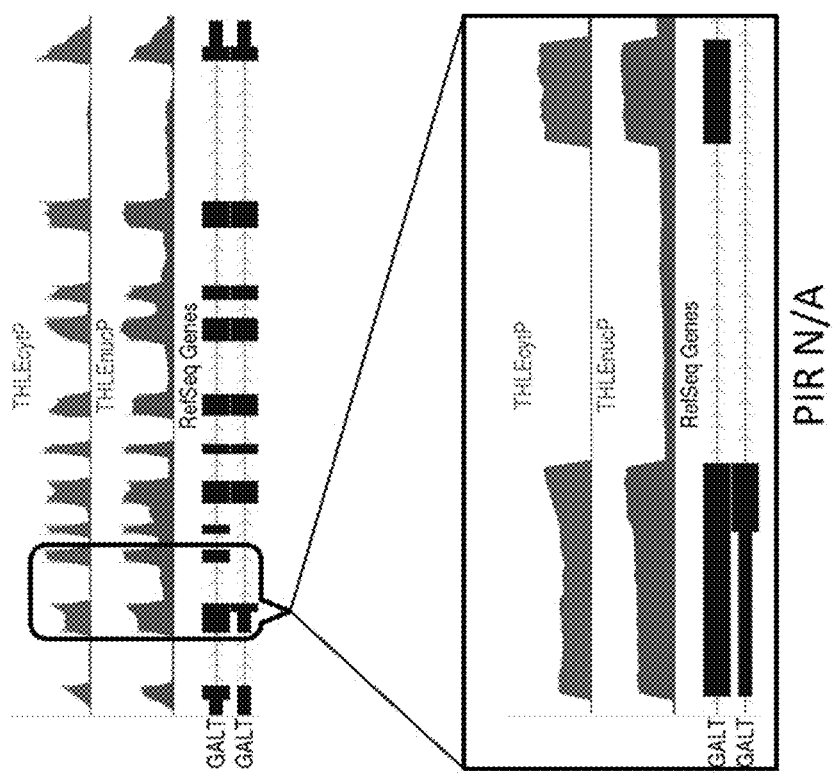

FIG. 124B depicts a schematic of the RefSeq Genes for GALT corresponding to GALT: NM_000155 and NM_001258332. The Percent Intron Retention (PIR) of the circled intron is shown (GALT intron 3, NM_000155).

Figure 124C:
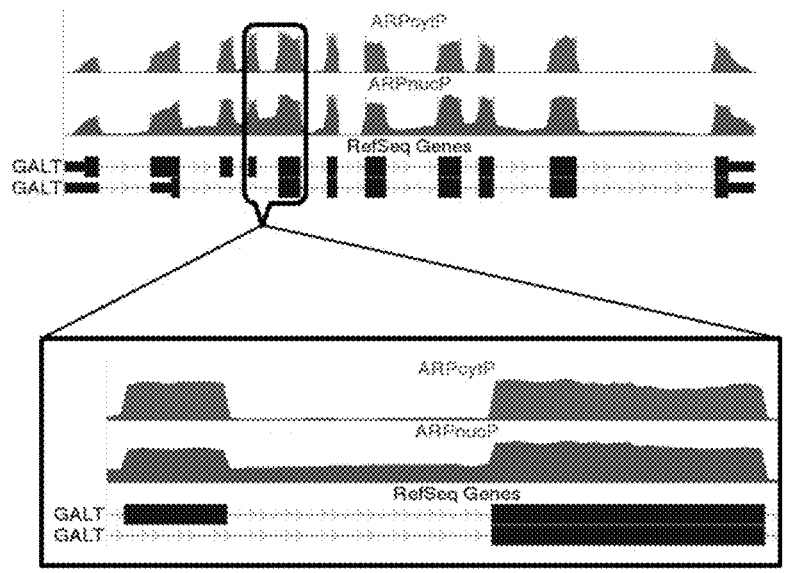

FIG. 124C depicts a schematic of the RefSeq Genes for GALT corresponding to GALT: NM_000155 and NM_001258332. The Percent Intron Retention (PIR) of the circled intron is shown (GALT intron 4, NM_000155).

Figure 124D:
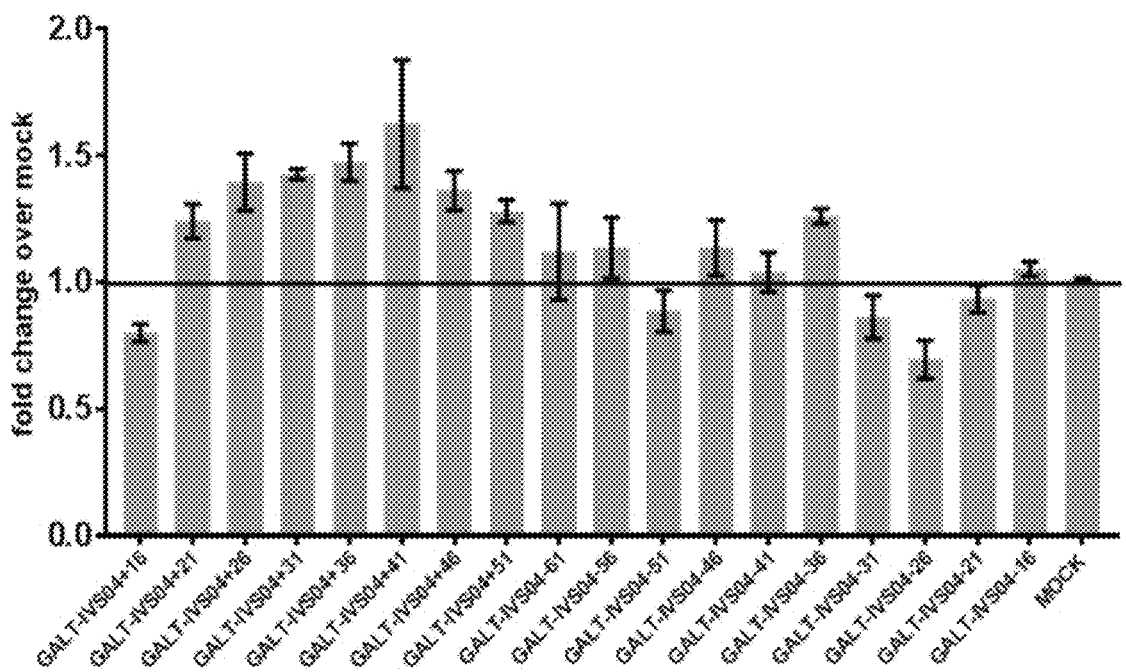

FIG. 124D depicts an exemplary graph showing the average (n=3) fold change in expression levels of GALT mRNA without intron 4 in ARPE-19 cells treated for 24 hrs with 80 nM of the indicated ASOs (spanning the exon 4-exon 5 splice junction) over mock treated cells. Data is normalized to RPL32 expression.

Figure 124E:
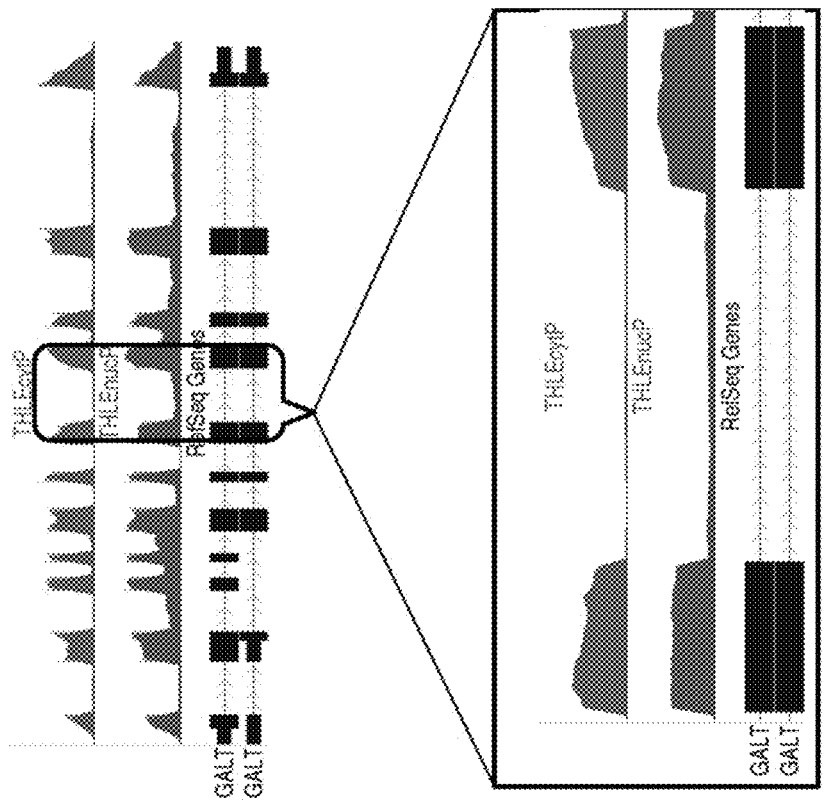

FIG. 124E depicts a schematic of the RefSeq Genes for GALT corresponding to GALT: NM_000155 and NM_001258332. The Percent Intron Retention (PIR) of the circled intron is shown (GALT intron 5, NM_000155).

Figure 124F:
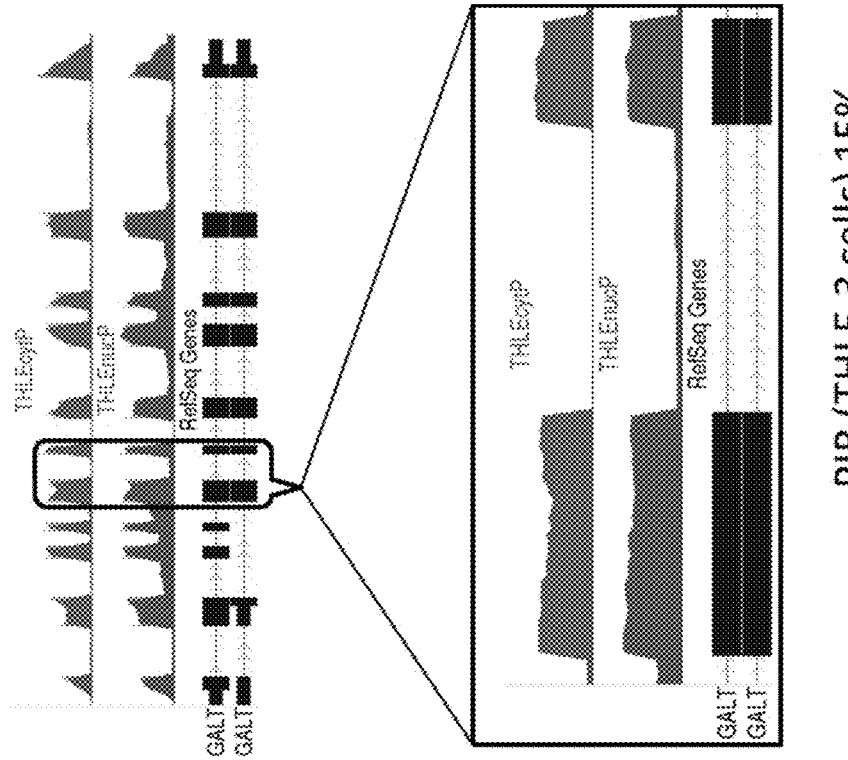

FIG. 124F depicts a schematic of the RefSeq Genes for GALT corresponding to GALT: NM_000155 and NM_001258332. The Percent Intron Retention (PIR) of the circled intron is shown (GALT intron 7, NM_000155).

Figure 124G:
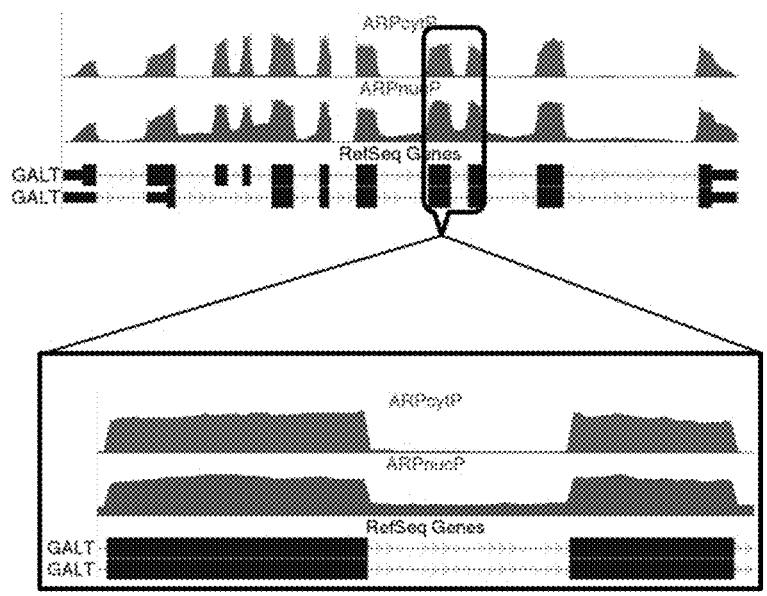

FIG. 124G depicts a schematic of the RefSeq Genes for GALT corresponding to GALT: NM_000155 and NM_001258332. The Percent Intron Retention (PIR) of the circled intron is shown (GALT intron 8, NM_000155).

Figure 124H:
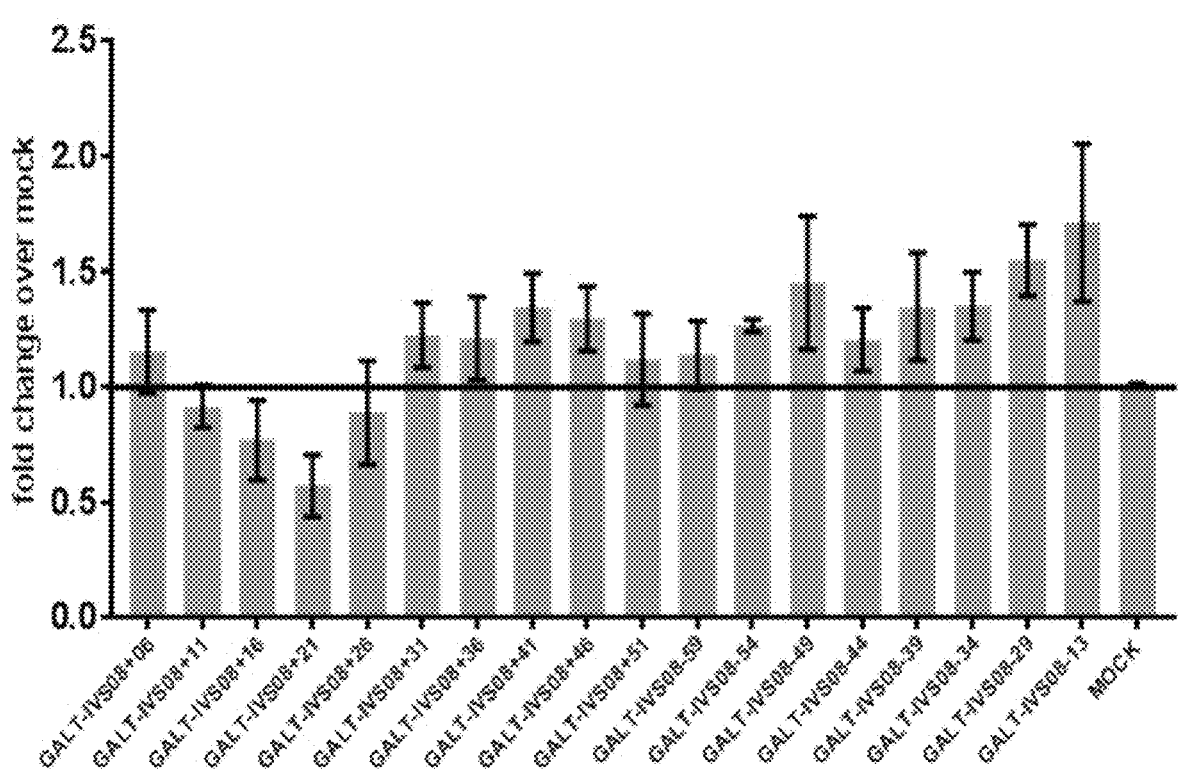

FIG. 124H depicts an exemplary graph showing the average (n=3) fold change in expression levels of GALT mRNA without intron 8 in ARPE-19 cells treated for 24 hrs with 80 nM of the indicated ASOs (spanning the exon 8-exon 9 splice junction) over mock treated cells. Data is normalized to RPL32 expression.

Figure 124I:
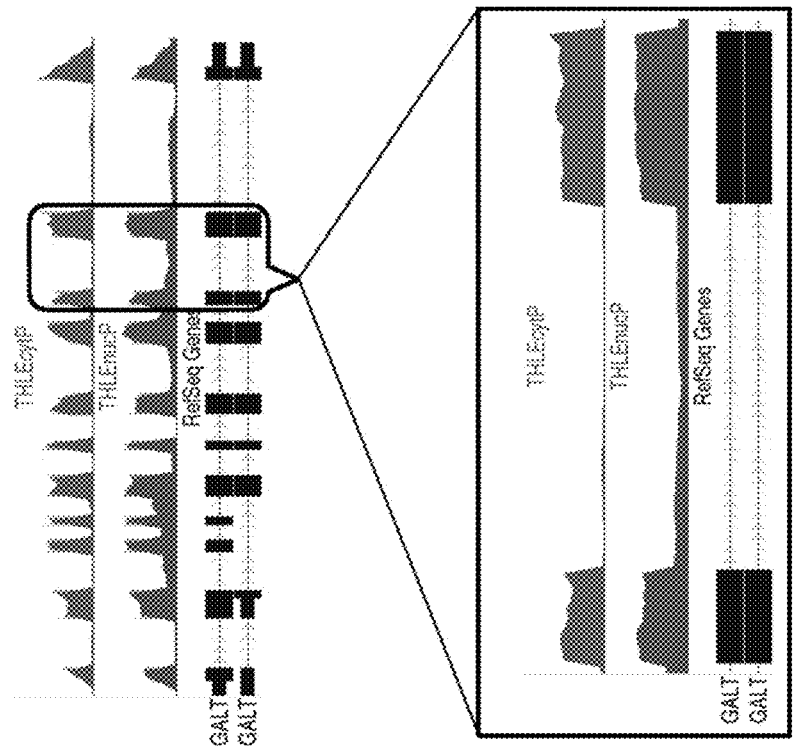

FIG. 124I depicts a schematic of the RefSeq Genes for GALT corresponding to GALT: NM_000155 and NM_001258332. The Percent Intron Retention (PIR) of the circled intron is shown (GALT intron 9, NM_000155).

Figure 124J:
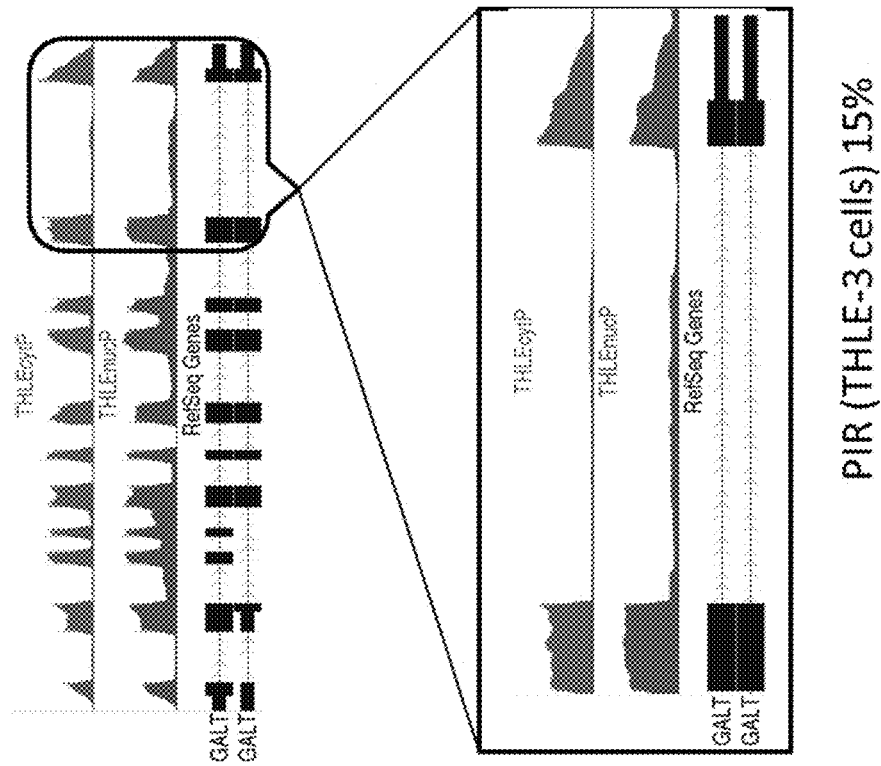

FIG. 124J depicts a schematic of the RefSeq Genes for GALT corresponding to GALT: NM_000155 and NM_001258332. The Percent Intron Retention (PIR) of the circled intron is shown (GALT intron 10, NM_000155).

Figure 125A:
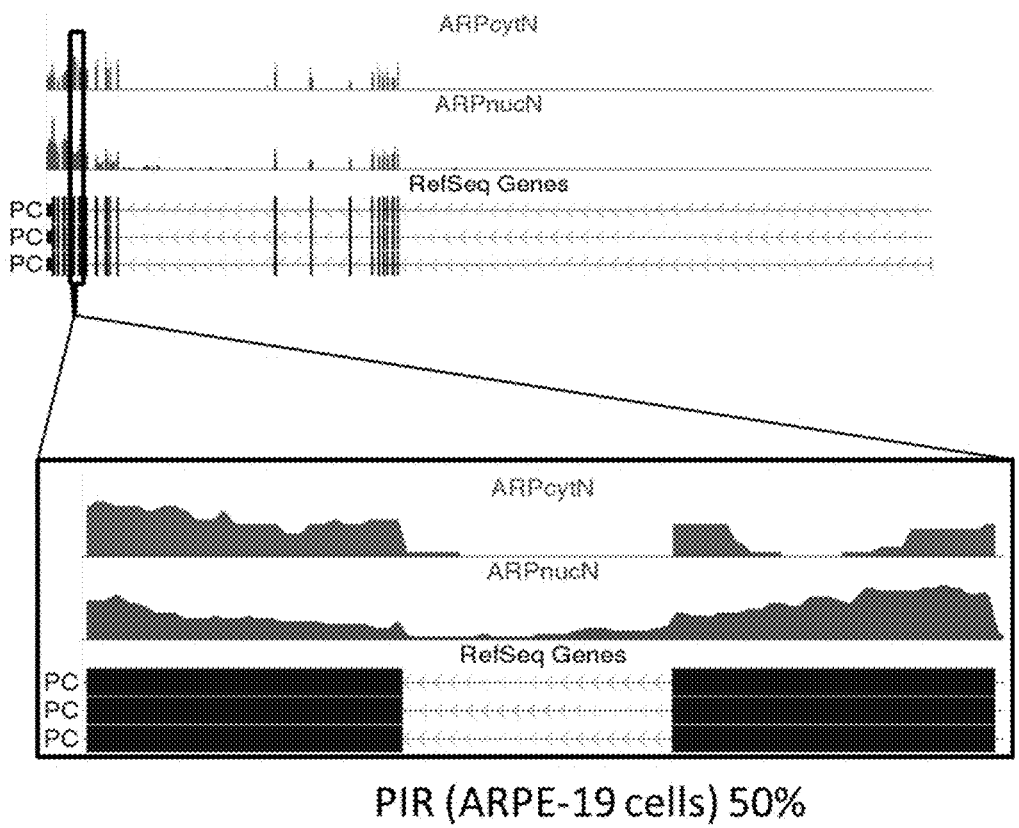

FIG. 125A depicts a schematic of the RefSeq Genes for PC corresponding to PC: NM_000920, NM_022172 and NM_001040716. The Percent Intron Retention (PIR) of the circled intron is shown (PC intron 16, NM_022172).

Figure 125B:
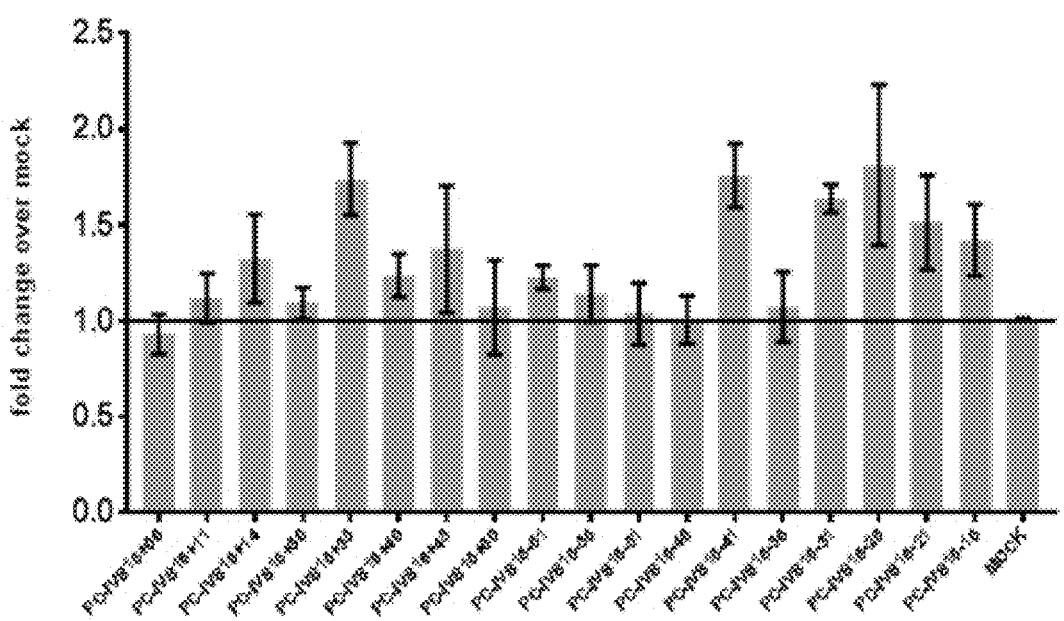

FIG. 125B depicts an exemplary graph showing the average (n=3) fold change in expression levels of PC mRNA without intron 16 in ARPE-19 cells treated for 24 hrs with 80 nM of the indicated ASOs (spanning the exon 16-exon 17 splice junction) over mock treated cells. Data is normalized to RPL32 expression.

Figure 126A:
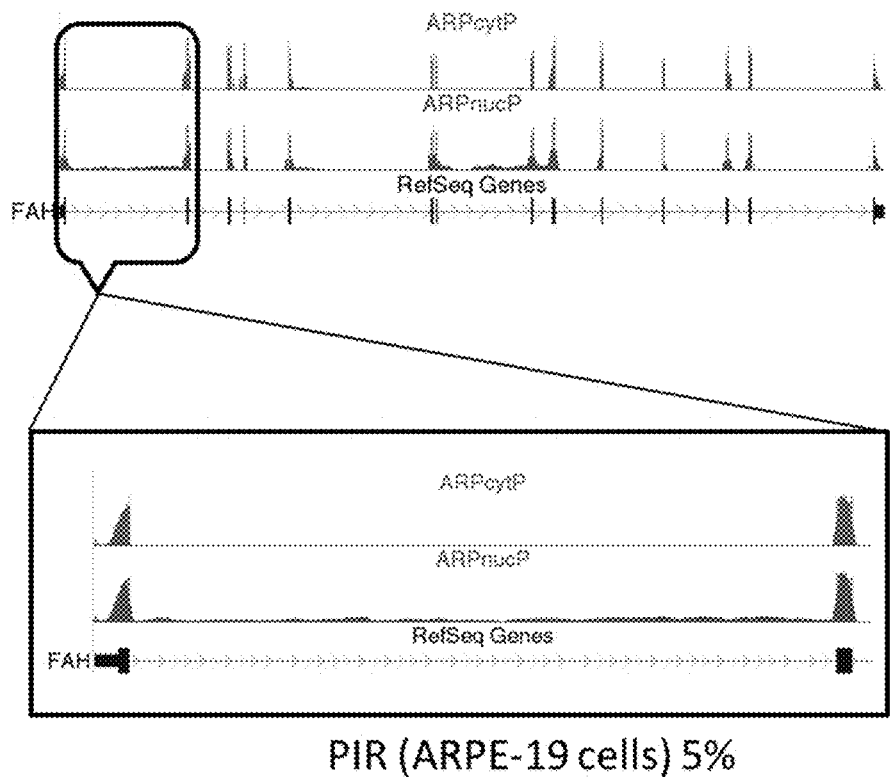

FIG. 126A depicts a schematic of the RefSeq Genes for FAH corresponding to FAH: NM_000137. The Percent Intron Retention (PIR) of the circled intron is shown (FAH intron 1, NM_000137).

Figure 126B:
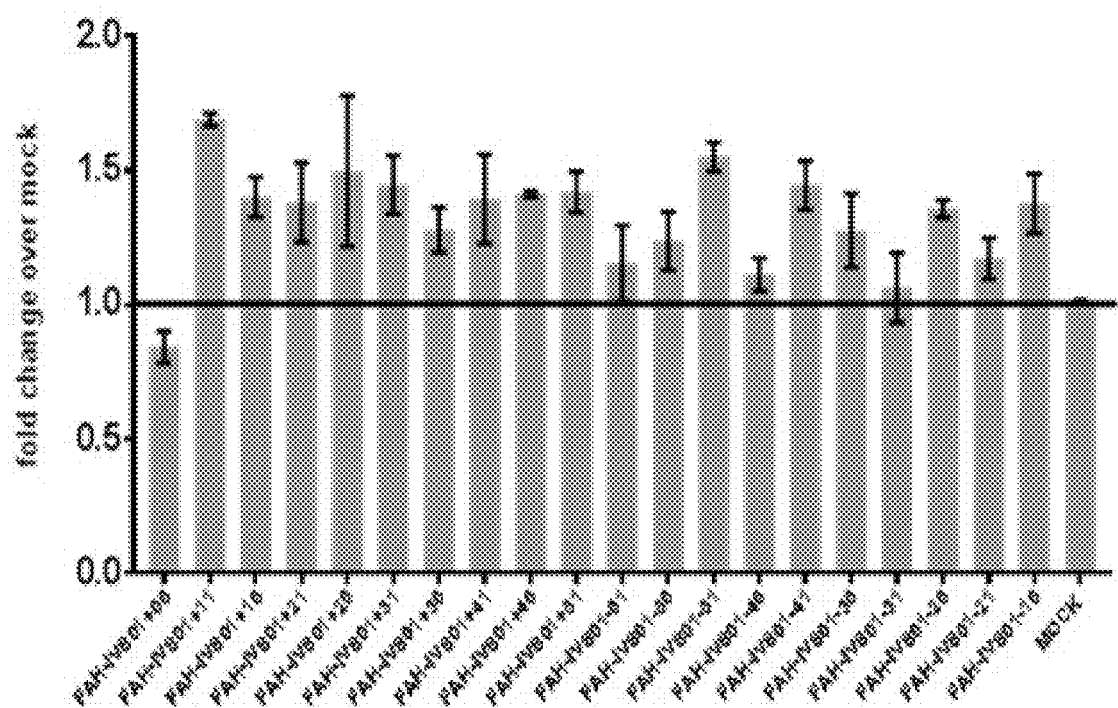

FIG. 126B depicts an exemplary graph showing the average (n=3) fold change in expression levels of FAH mRNA without intron 1 in ARPE-19 cells treated for 24 hrs with 80 nM of the indicated ASOs (spanning the exon 1-exon 2 splice junction) over mock treated cells. Data is normalized to RPL32 expression.

Figure 127A:
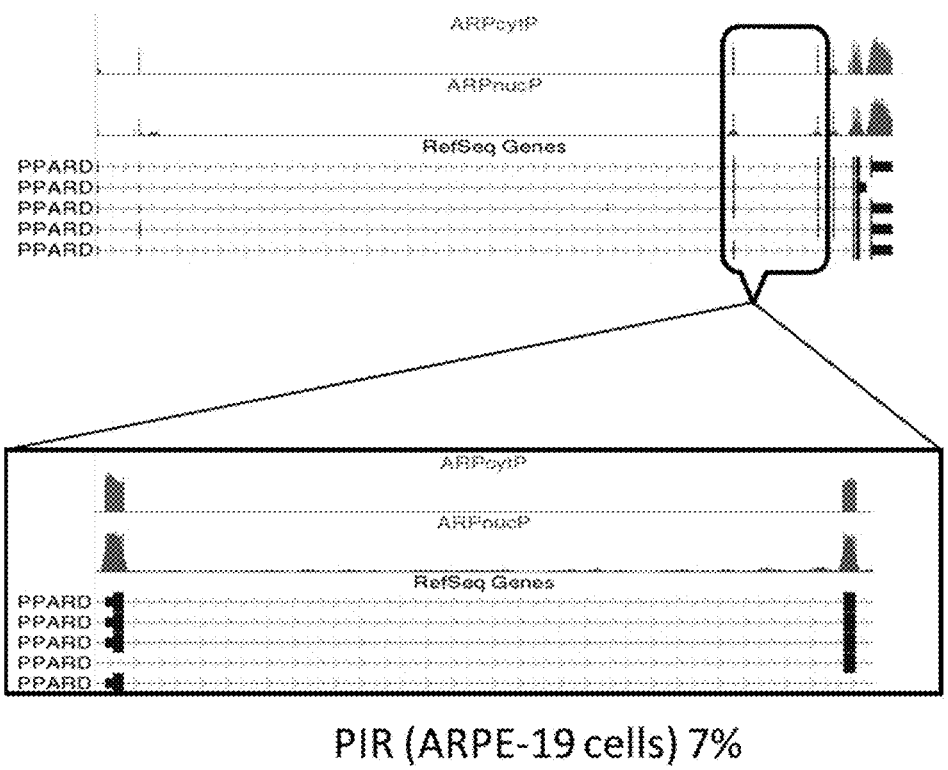

FIG. 127A depicts a schematic of the RefSeq Genes for PPARD corresponding to PPARD: NM_006238, NM_177435, NM_001171818, NM_001171819 and NM_001171820. The Percent Intron Retention (PIR) of the circled intron is shown (PPARD intron 3, NM_006238).

Figure 127B:
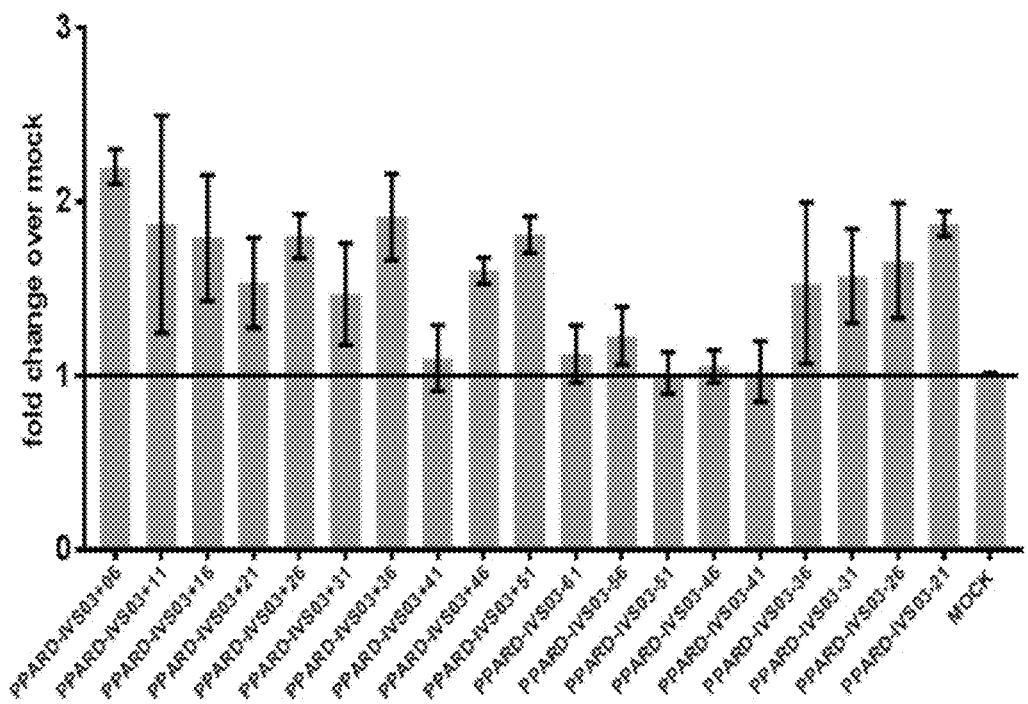

FIG. 127B depicts an exemplary graph showing the average (n=3) fold change in expression levels of PPARD mRNA without intron 3 in ARPE-19 cells treated for 24 hrs with 80 nM of the indicated ASOs over mock treated cells. Data is normalized to RPL32 expression.

Figure 127C:
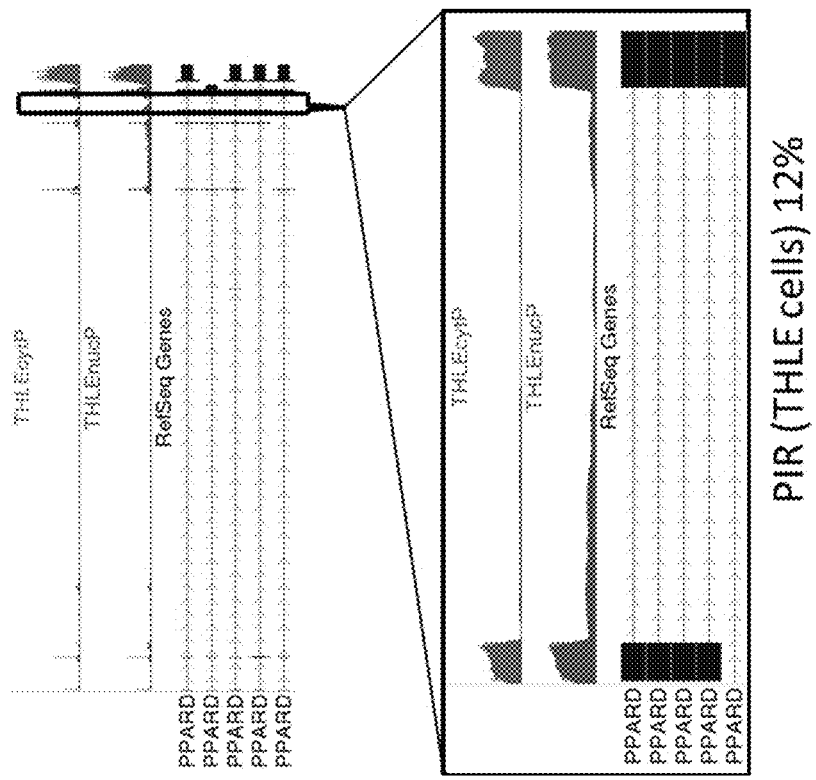

FIG. 127C depicts a schematic of the RefSeq Genes for PPARD corresponding to PPARD: NM_006238, NM_177435, NM_001171818, NM_001171819 and NM_001171820. The Percent Intron Retention (PIR) of the circled intron is shown (PPARD intron 4, NM_006238).

Figure 127D:
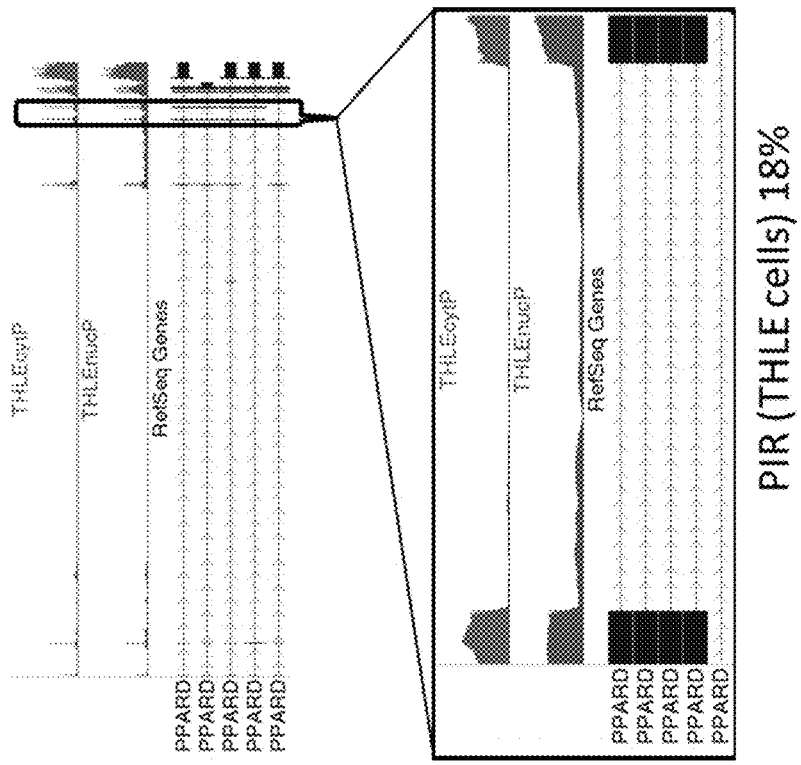

FIG. 127D depicts a schematic of the RefSeq Genes for PPARD corresponding to PPARD: NM_006238, NM_177435, NM_001171818, NM_001171819 and NM_001171820. The Percent Intron Retention (PIR) of the circled intron is shown (PPARD intron 5, NM_006238).

Figure 127E:
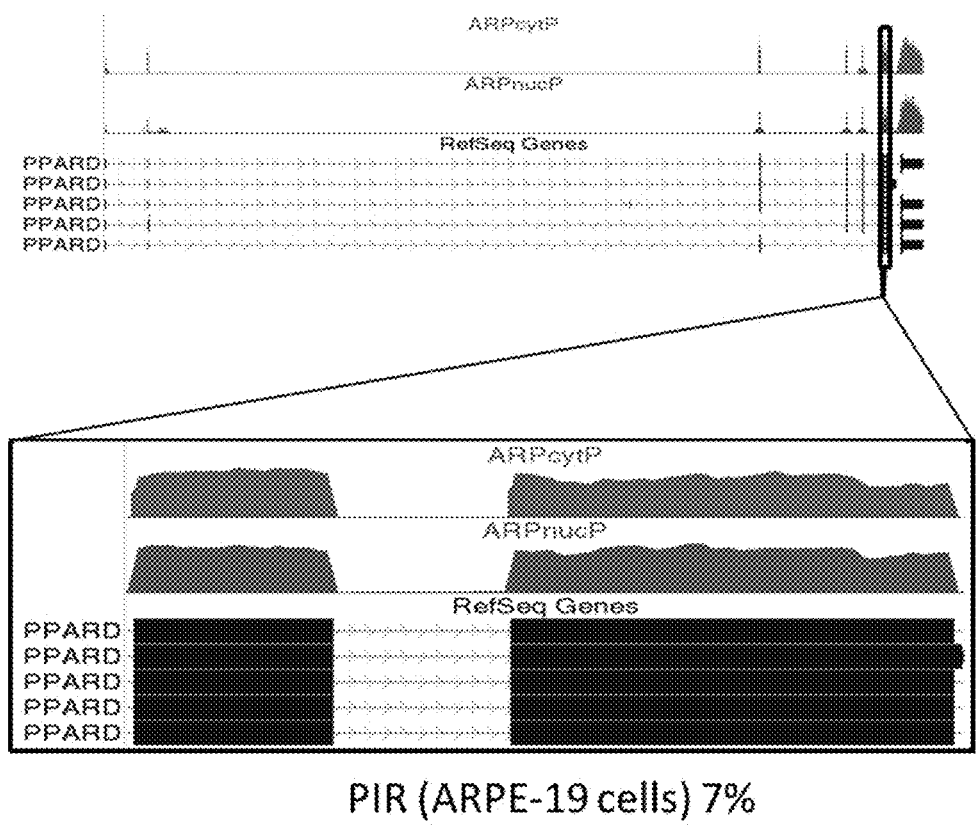

FIG. 127E depicts a schematic of the RefSeq Genes for PPARD corresponding to PPARD: NM_006238, NM_177435, NM_001171818, NM_001171819 and NM_001171820. The Percent Intron Retention (PIR) of the circled intron is shown (PPARD intron 6, NM_006238).

Figure 127F:
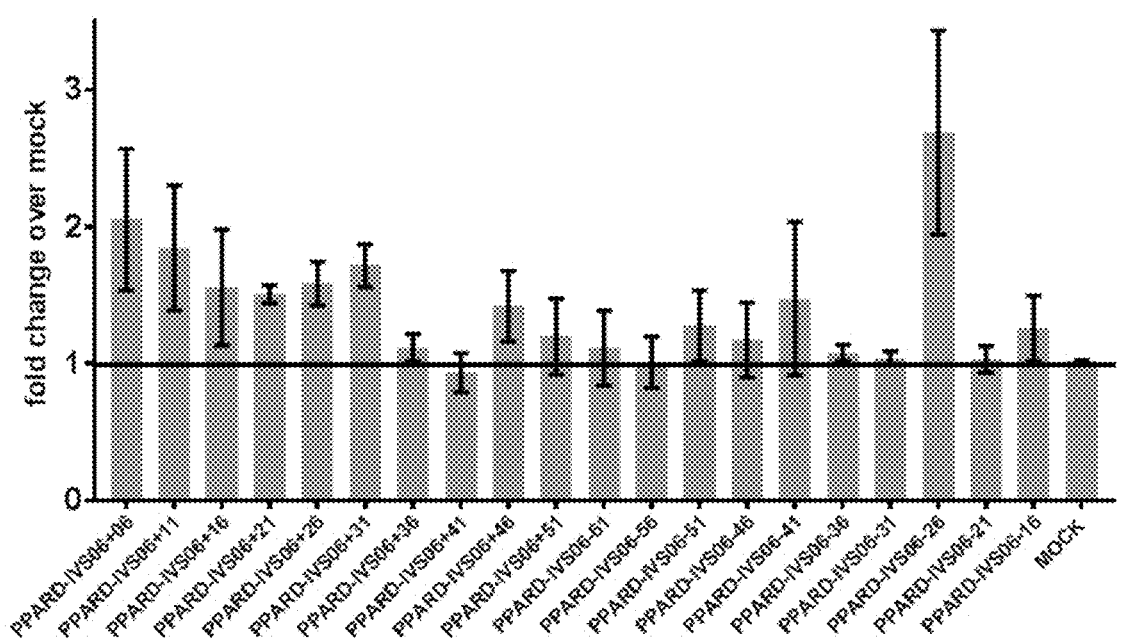

FIG. 127F depicts an exemplary graph showing the average (n=3) fold change in expression levels of PPARD mRNA without intron 6 in ARPE-19 cells treated for 24 hrs with 80 nM of the indicated ASOs over mock treated cells. Data is normalized to RPL32 expression.

Figure 127G:
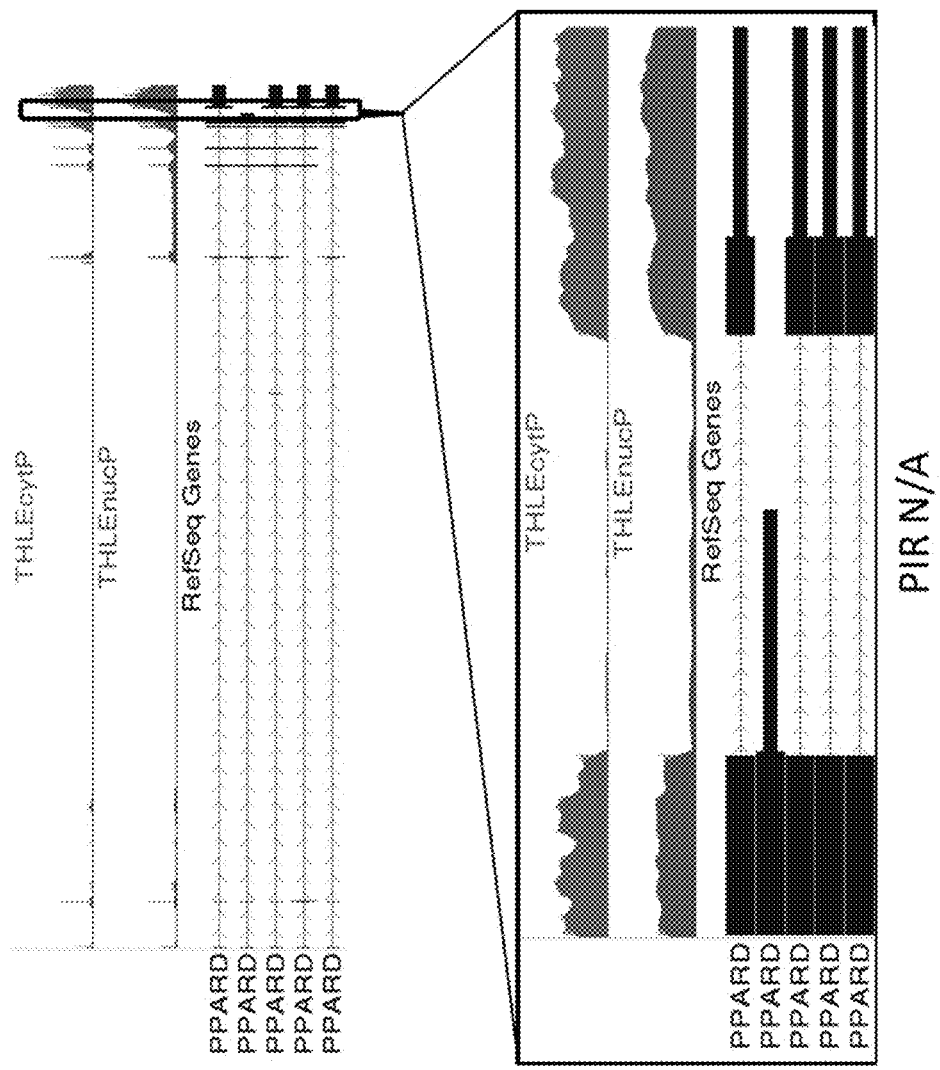

FIG. 127G depicts a schematic of the RefSeq Genes for PPARD corresponding to PPARD: NM_006238, NM_177435, NM_001171818, NM_001171819 and NM_001171820. The Percent Intron Retention (PIR) of the circled intron is shown (PPARD intron 7, NM_006238).

Figure 128A:
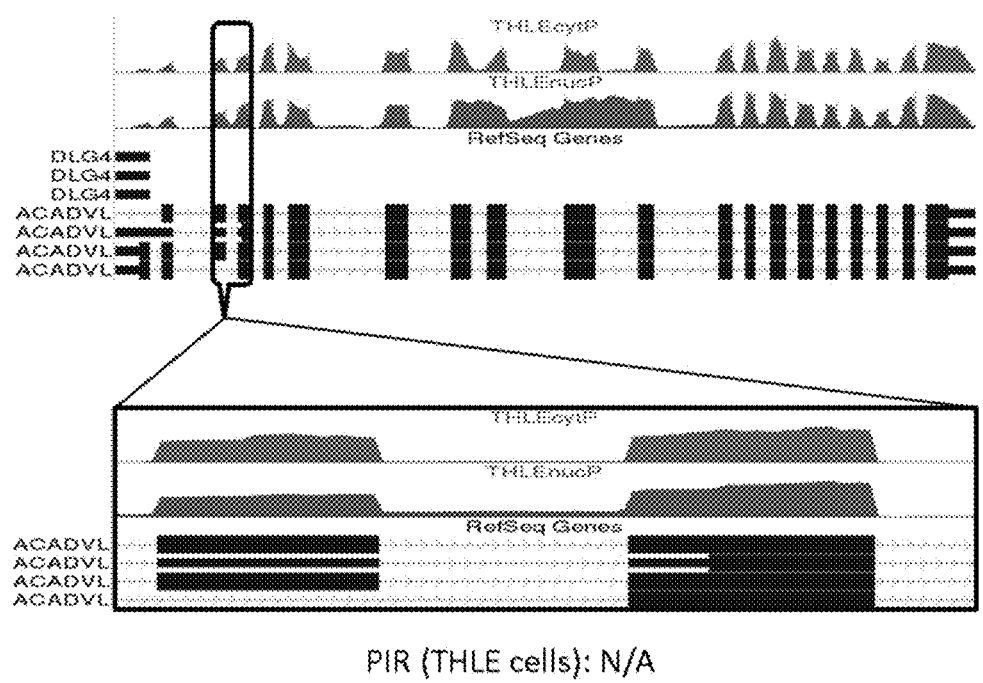

FIG. 128A depicts a schematic of the RefSeq Genes for ACADVL corresponding to ACADVL: NM_001270448, NM_001270447, NM_000018 and NM_001033859. The Percent Intron Retention (PIR) of the circled intron is shown (ACADVL intron 3, NM_000018).

Figure 128B:
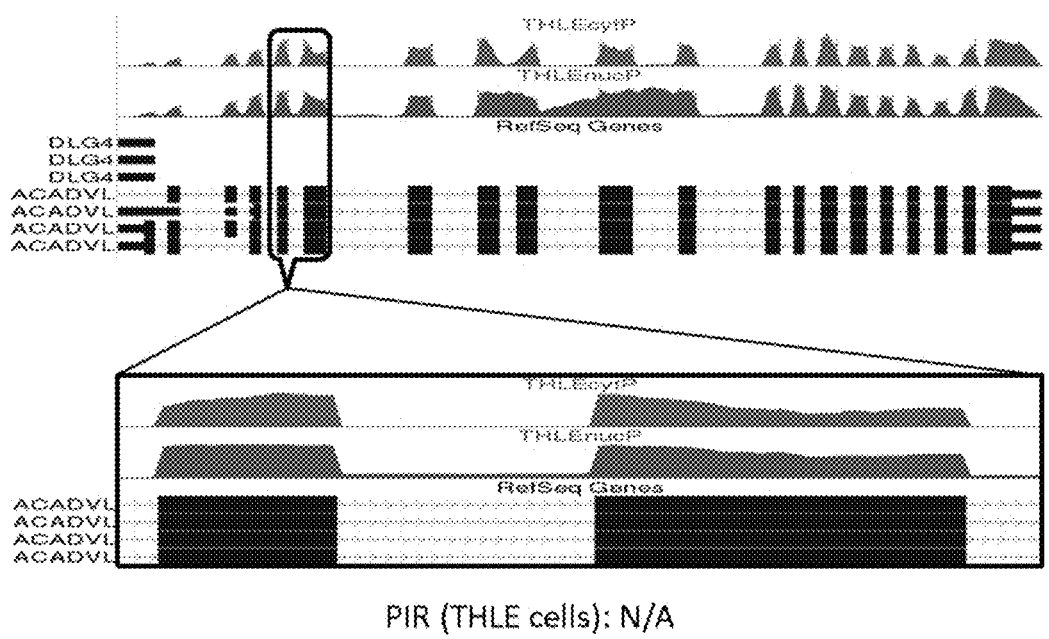

FIG. 128B depicts a schematic of the RefSeq Genes for ACADVL corresponding to ACADVL: NM_001270448, NM_001270447, NM_000018 and NM_001033859. The Percent Intron Retention (PIR) of the circled intron is shown (ACADVL intron 5, NM_000018).

Figure 128C:
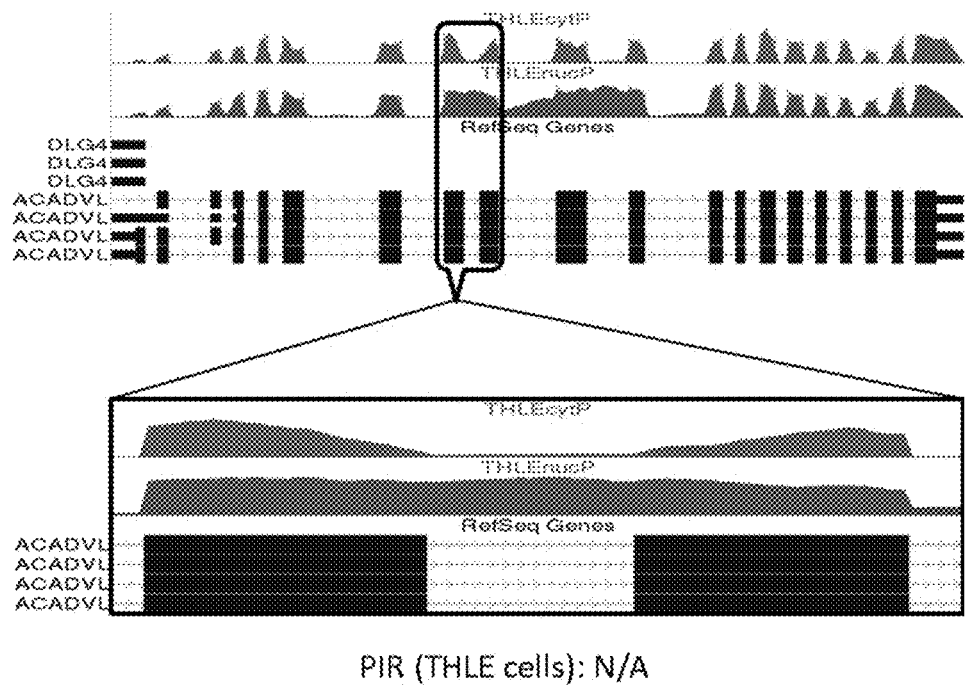

FIG. 128C depicts a schematic of the RefSeq Genes for ACADVL corresponding to ACADVL: NM_001270448, NM_001270447, NM_000018 and NM_001033859. The Percent Intron Retention (PIR) of the circled intron is shown (ACADVL intron 8, NM_000018).

Figure 128D:
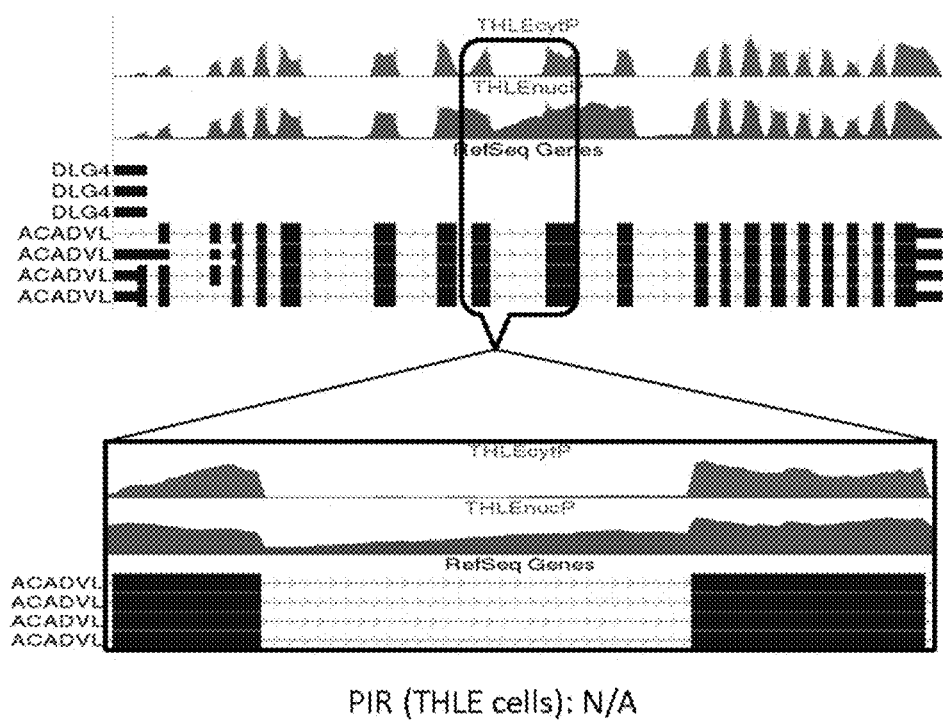

FIG. 128D depicts a schematic of the RefSeq Genes for ACADVL corresponding to ACADVL: NM_001270448, NM_001270447, NM_000018 and NM_001033859. The Percent Intron Retention (PIR) of the circled intron is shown (ACADVL intron 9, NM_000018).

Figure 128E:
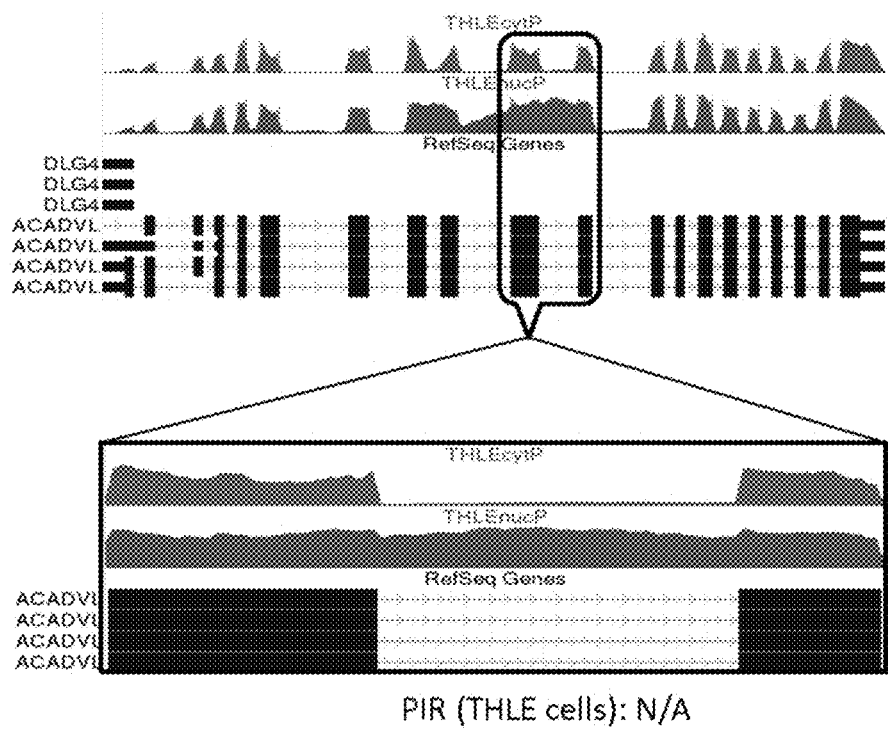

FIG. 128E depicts a schematic of the RefSeq Genes for ACADVL corresponding to ACADVL: NM_001270448, NM_001270447, NM_000018 and NM_001033859. The Percent Intron Retention (PIR) of the circled intron is shown (ACADVL intron 10, NM_000018).

Figure 128F:
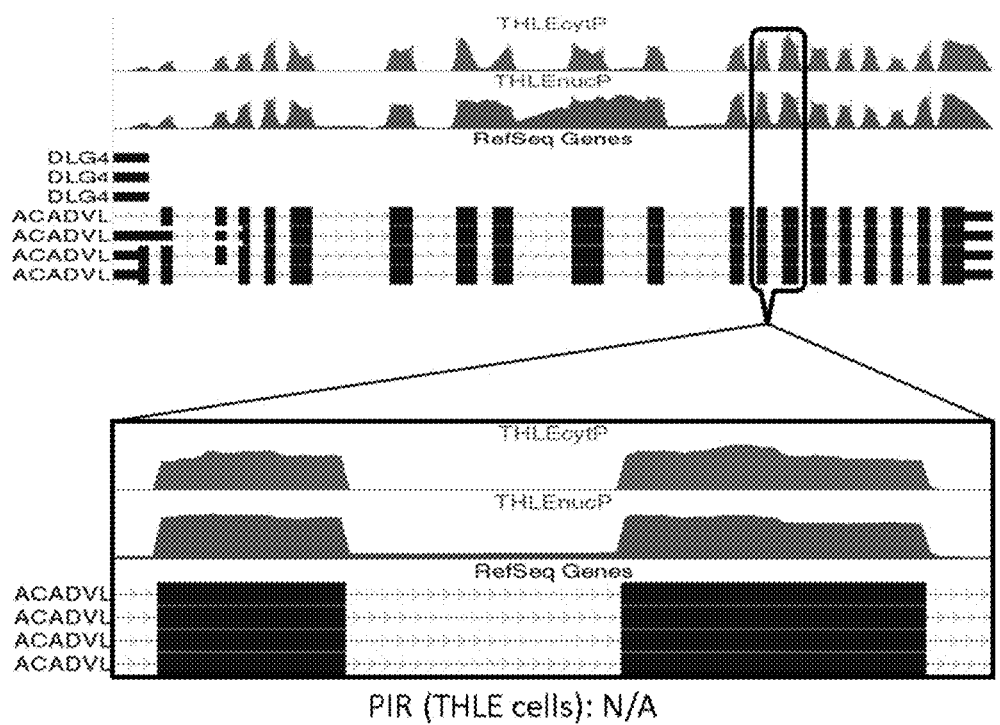

FIG. 128F depicts a schematic of the RefSeq Genes for ACADVL corresponding to ACADVL: NM_001270448, NM_001270447, NM_000018 and NM_001033859. The Percent Intron Retention (PIR) of the circled intron is shown (ACADVL intron 13, NM_000018).

Figure 128G:
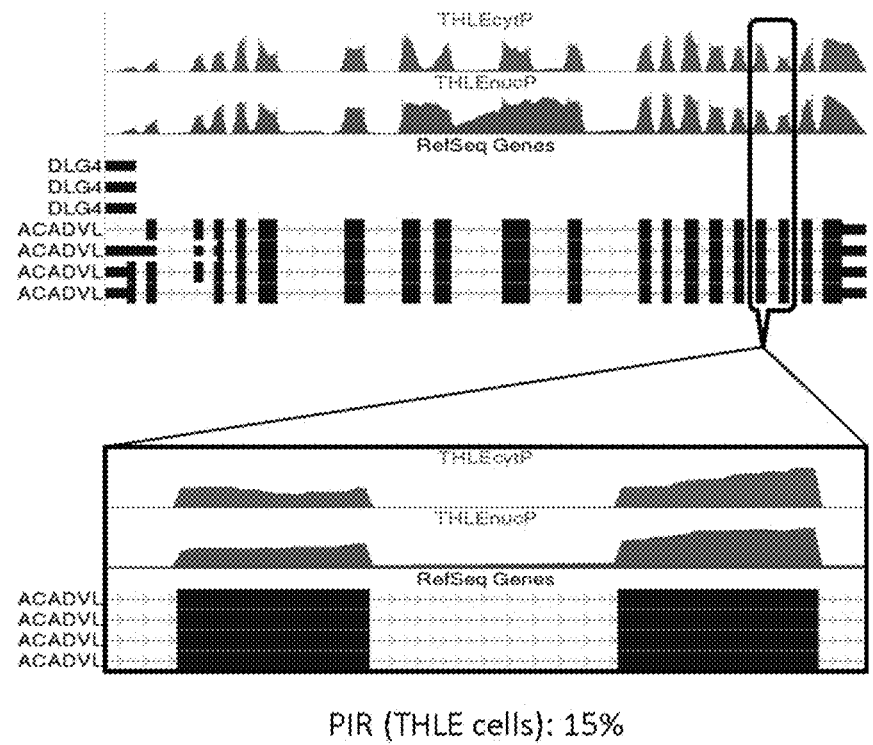

FIG. 128G depicts a schematic of the RefSeq Genes for ACADVL corresponding to ACADVL: NM_001270448, NM_001270447, NM_000018 and NM_001033859. The Percent Intron Retention (PIR) of the circled intron is shown (ACADVL intron 18, NM_000018).

Figure 128H:
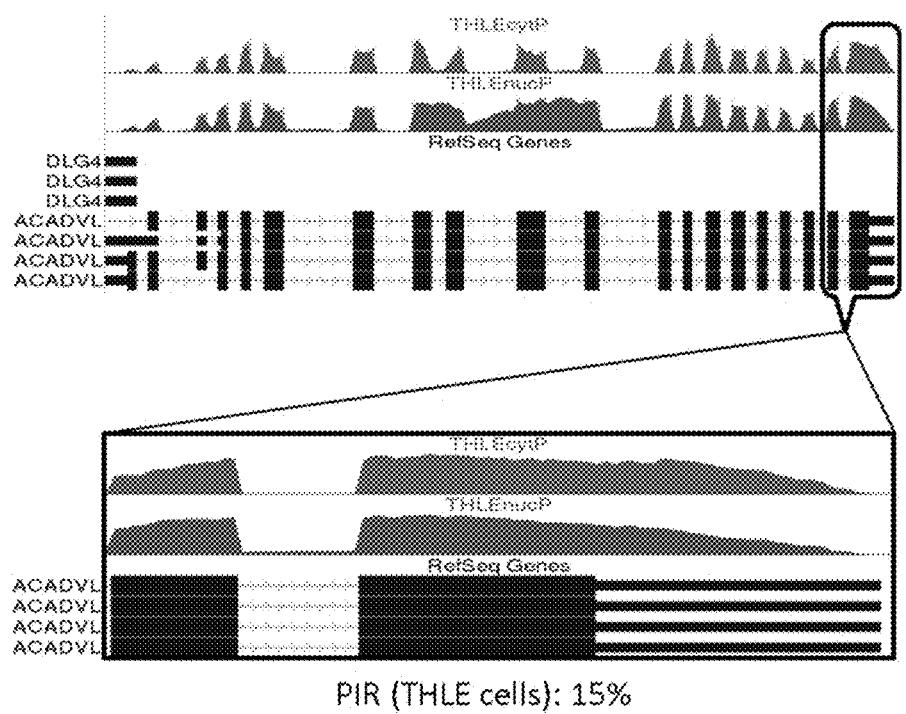

FIG. 128H depicts a schematic of the RefSeq Genes for ACADVL corresponding to ACADVL: NM_001270448, NM_001270447, NM_000018 and NM_001033859. The Percent Intron Retention (PIR) of the circled intron is shown (ACADVL intron 19, NM_000018).

Figure 129A:
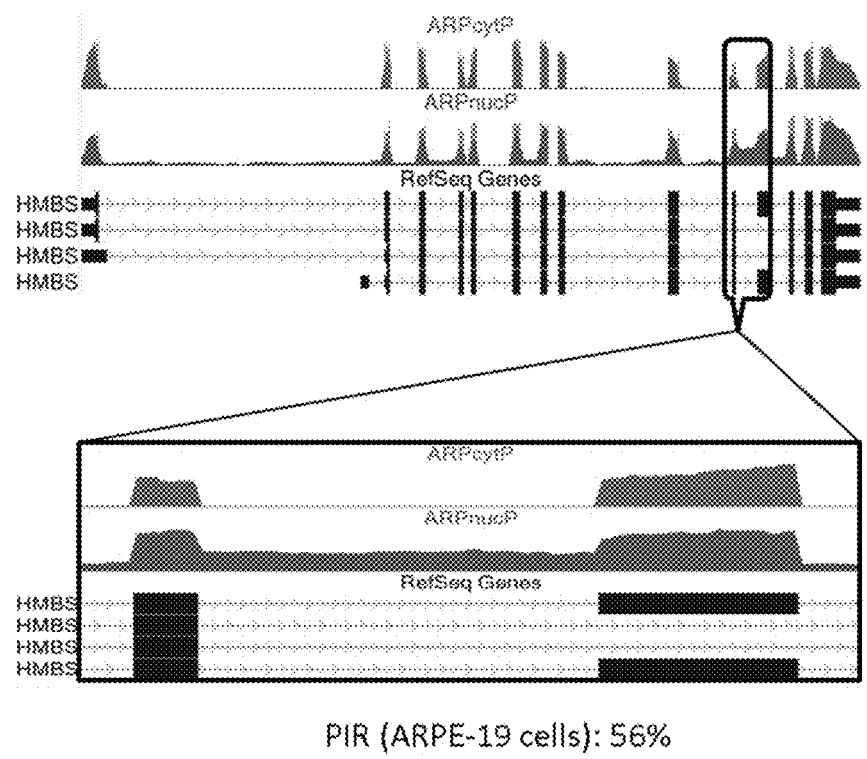

FIG. 129A depicts a schematic of the RefSeq Genes for HMBS corresponding to HMBS: NM_000190, NM_001258208, NM_001024382 and NM_001258209. The Percent Intron Retention (PIR) of the circled intron is shown (HMBS intron 10, NM_000190).

Figure 129B:
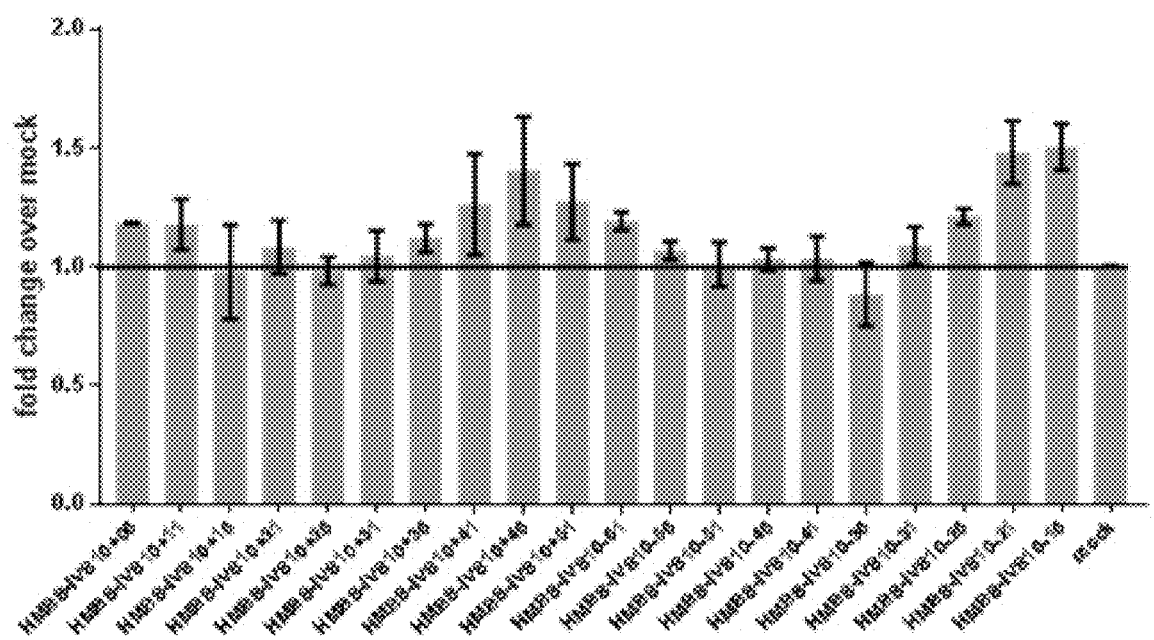

FIG. 129B depicts an exemplary graph showing the average (n=3) fold change in expression levels of HMBS mRNA without intron 10 in ARPE-19 cells treated for 24 hrs with 80 nM of the indicated ASOs (spanning the exon 10-exon 11 splice junction) over mock treated cells. Data is normalized to RPL32 expression.

Figure 129C:
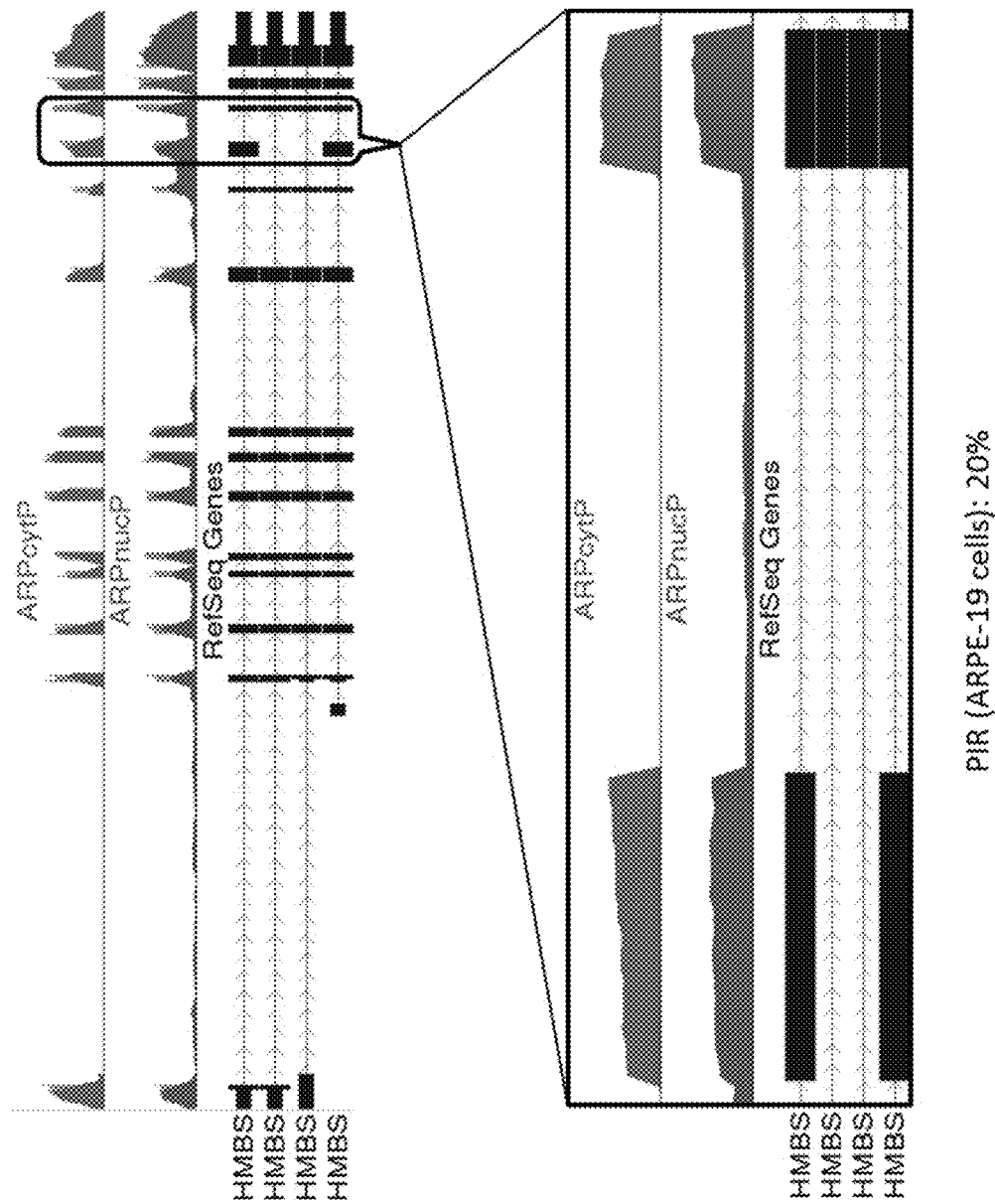

FIG. 129C depicts a schematic of the RefSeq Genes for HMBS corresponding to HMBS: NM_000190, NM_001258208, NM_001024382 and NM_001258209. The Percent Intron Retention (PIR) of the circled intron is shown (HMBS intron 11, NM_000190).

Figure 130A:
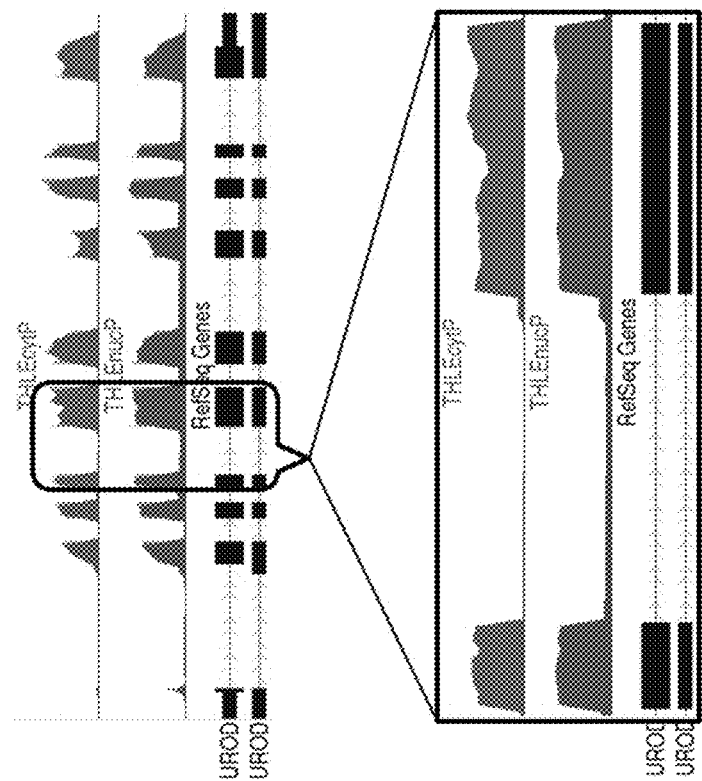

FIG. 130A depicts a schematic of the RefSeq Genes for UROD corresponding to UROD: NM_000374 and NR_036510. The Percent Intron Retention (PIR) of the circled intron is shown (UROD intron 3, NM_000374).

Figure 130B:
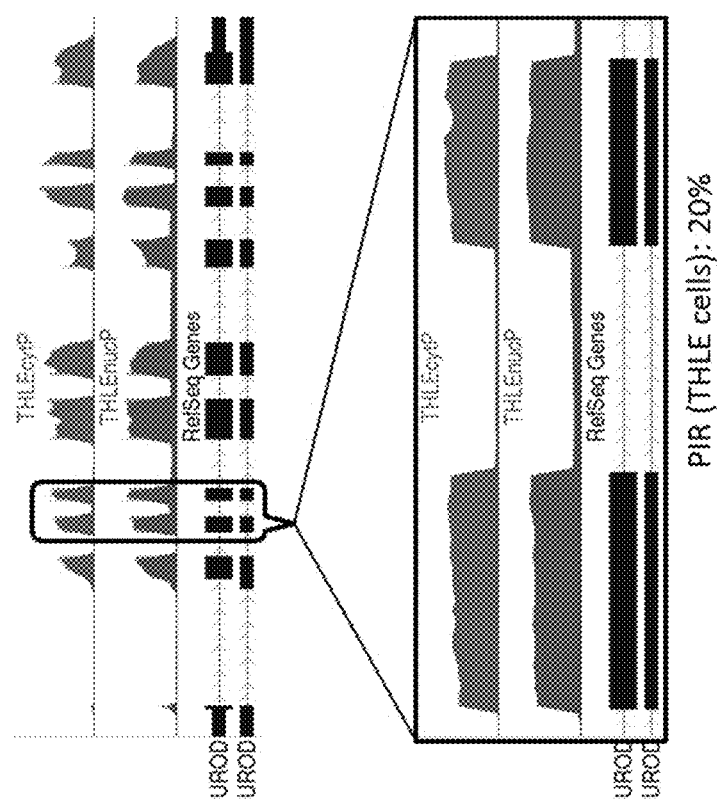

FIG. 130B depicts a schematic of the RefSeq Genes for UROD corresponding to UROD: NM_000374 and NR_036510. The Percent Intron Retention (PIR) of the circled intron is shown (UROD intron 4, NM_000374).

Figure 130C:
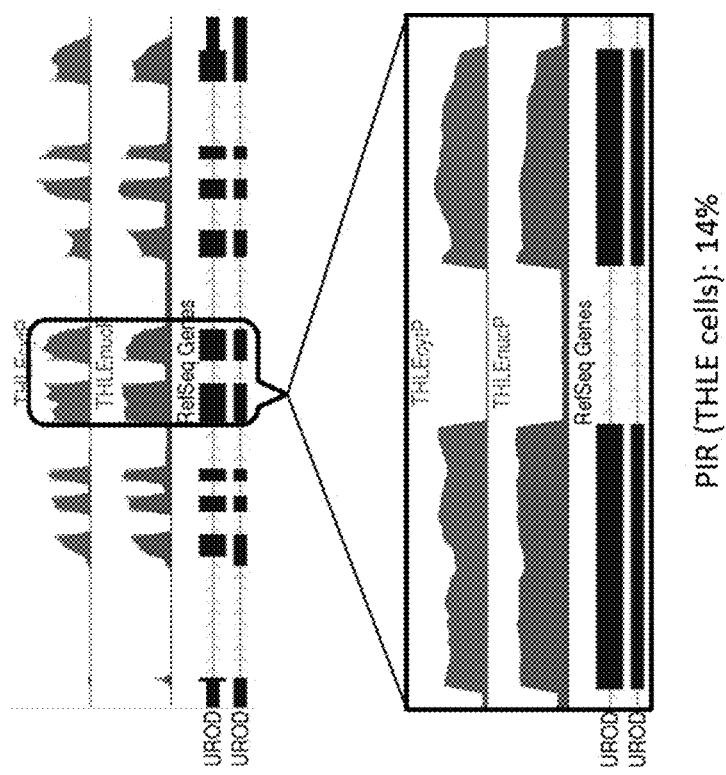

FIG. 130C depicts a schematic of the RefSeq Genes for UROD corresponding to UROD: NM_000374 and NR_036510. The Percent Intron Retention (PIR) of the circled intron is shown (UROD intron 5 NM_000374).

Figure 130D:
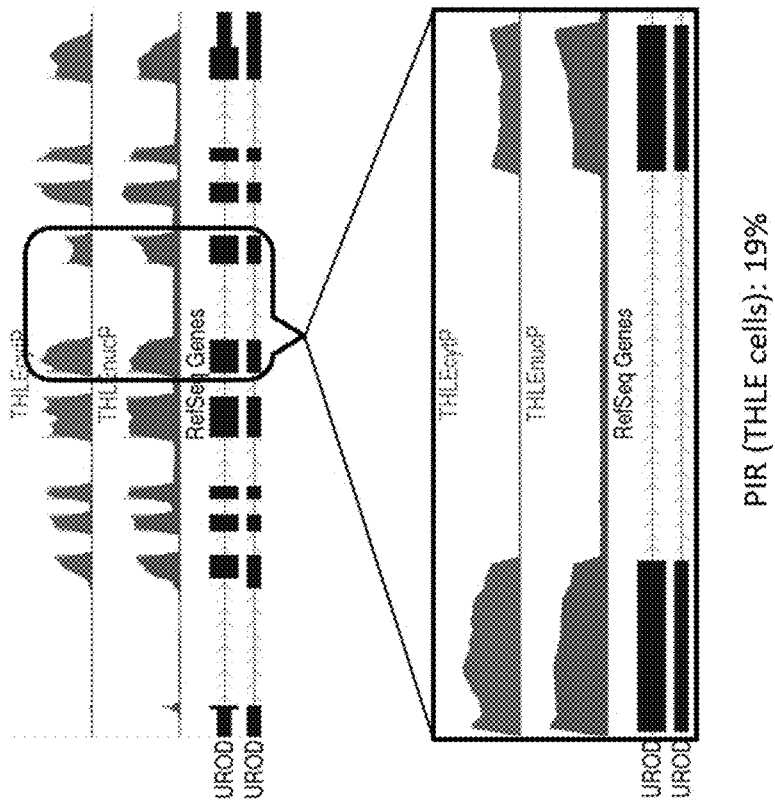

FIG. 130D depicts a schematic of the RefSeq Genes for UROD corresponding to UROD: NM_000374 and NR_036510. The Percent Intron Retention (PIR) of the circled intron is shown (UROD intron 6, NM_000374).

Figure 130E:
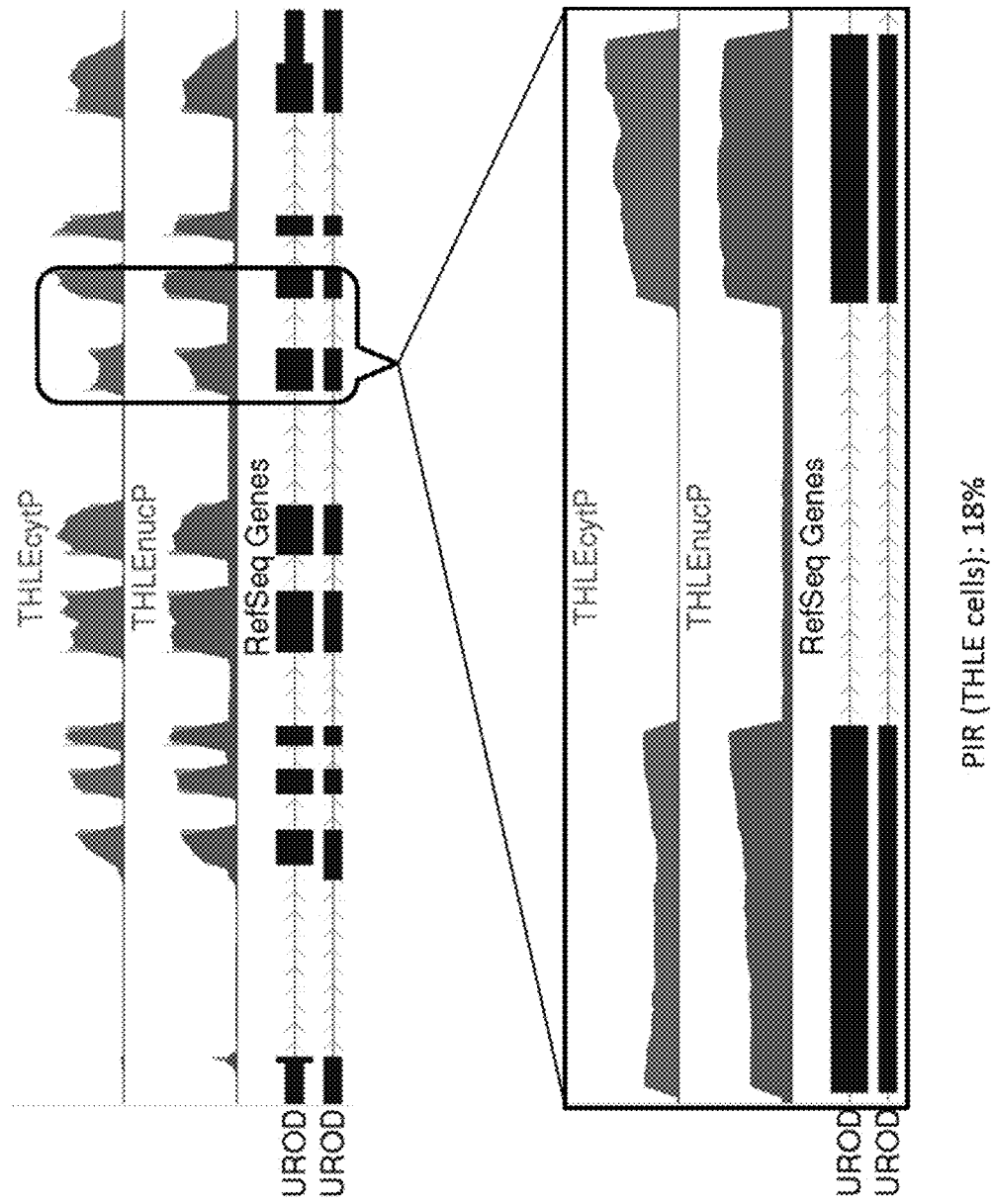

FIG. 130E depicts a schematic of the RefSeq Genes for UROD corresponding to UROD: NM_000374 and NR_036510. The Percent Intron Retention (PIR) of the circled intron is shown (UROD intron 7, NM_000374).

Figure 131A:
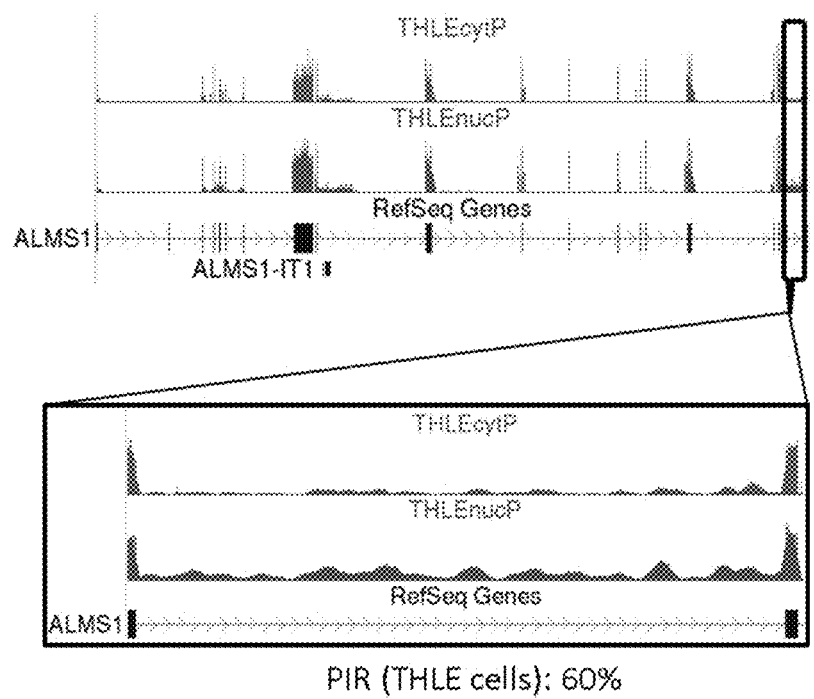

FIG. 131A depicts a schematic of the RefSeq Genes for ALMS1 corresponding to ALMS1: NM_015120. The Percent Intron Retention (PIR) of the circled intron is shown (ALMS1 intron 21, NM_015120).

Figure 131B:
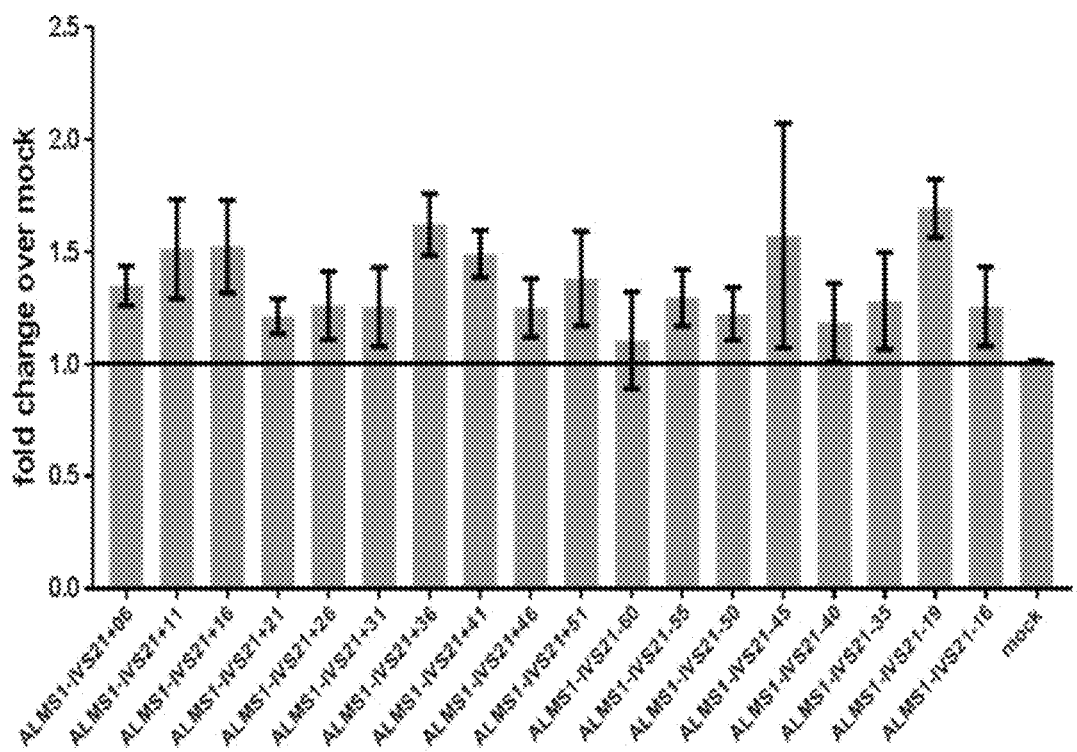

FIG. 131B depicts an exemplary graph showing the average (n=3) fold change in expression levels of ALMS1 mRNA without intron 21 in Huh7 cells treated for 24 hrs with 80 nM of the indicated ASOs (spanning the exon 21-exon 22 splice junction) over mock treated cells. Data is normalized to RPL32 expression.

Figure 132A:
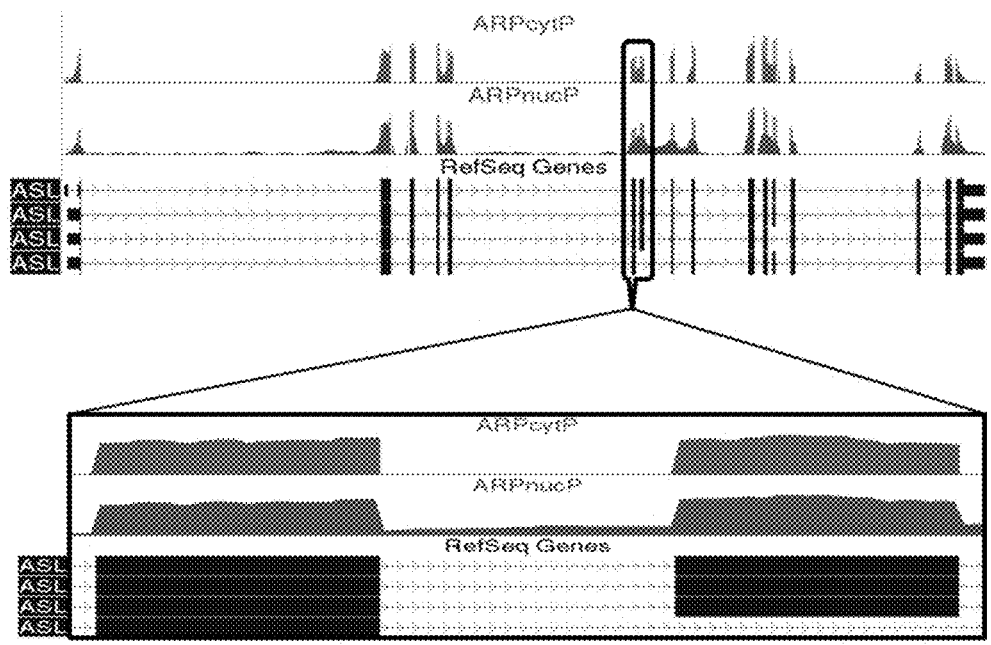

FIG. 132A depicts a schematic of the RefSeq Genes for ASL corresponding to ASL: NM_000048, NM_001024943, NM_001024944 and NM_001024946. The Percent Intron Retention (PIR) of the circled intron is shown (ASL intron 7, NM_000048).

Figure 132B:
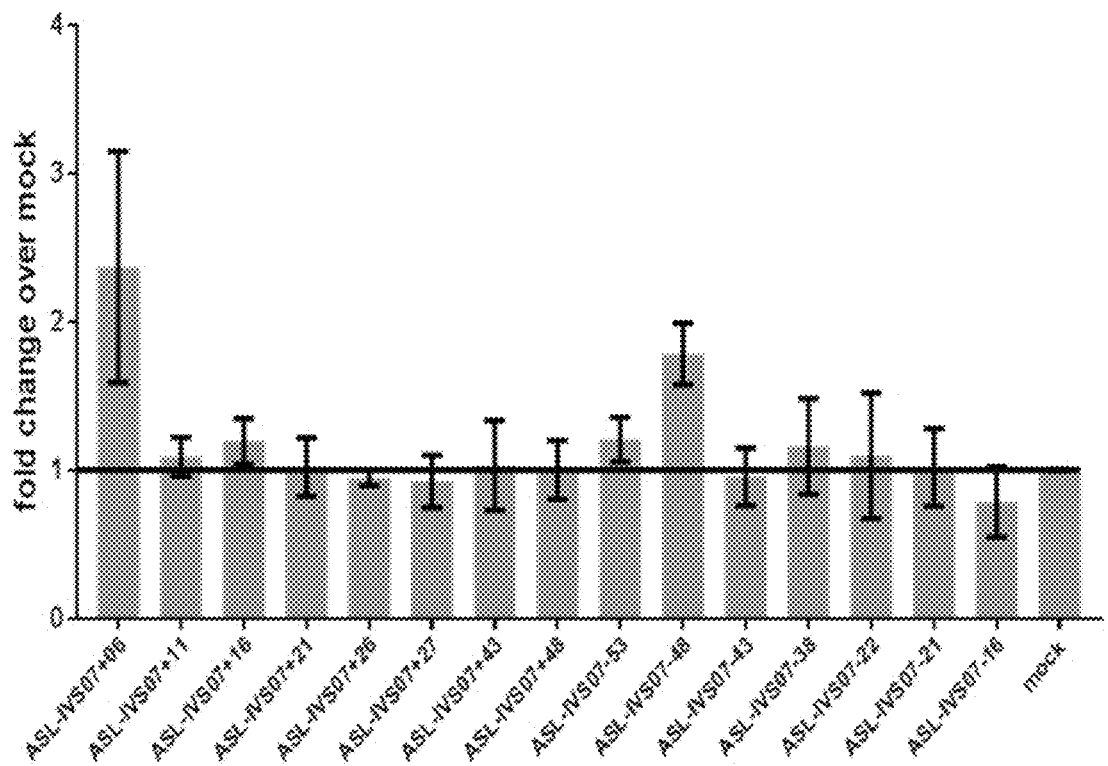

FIG. 132B depicts an exemplary graph showing the average (n=3) fold change in expression levels of ASL mRNA without intron 7 in ARPE-19 cells treated for 24 hrs with 80 nM of the indicated ASOs (spanning the exon 7-exon 8 splice junction) over mock treated cells. Data is normalized to RPL32 expression.

Figure 132C:
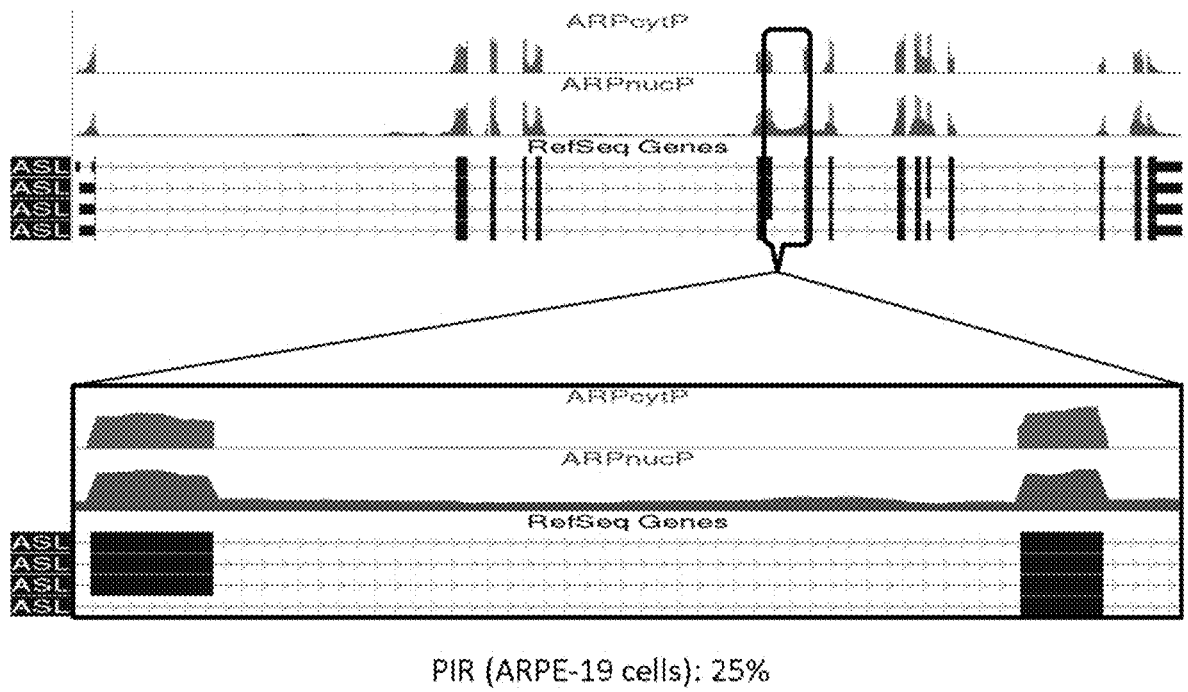

FIG. 132C depicts a schematic of the RefSeq Genes for ASL corresponding to ASL: NM_000048, NM_001024943, NM_001024944 and NM_001024946. The Percent Intron Retention (PIR) of the circled intron is shown (ASL intron 8, NM_000048).

Figure 132D:
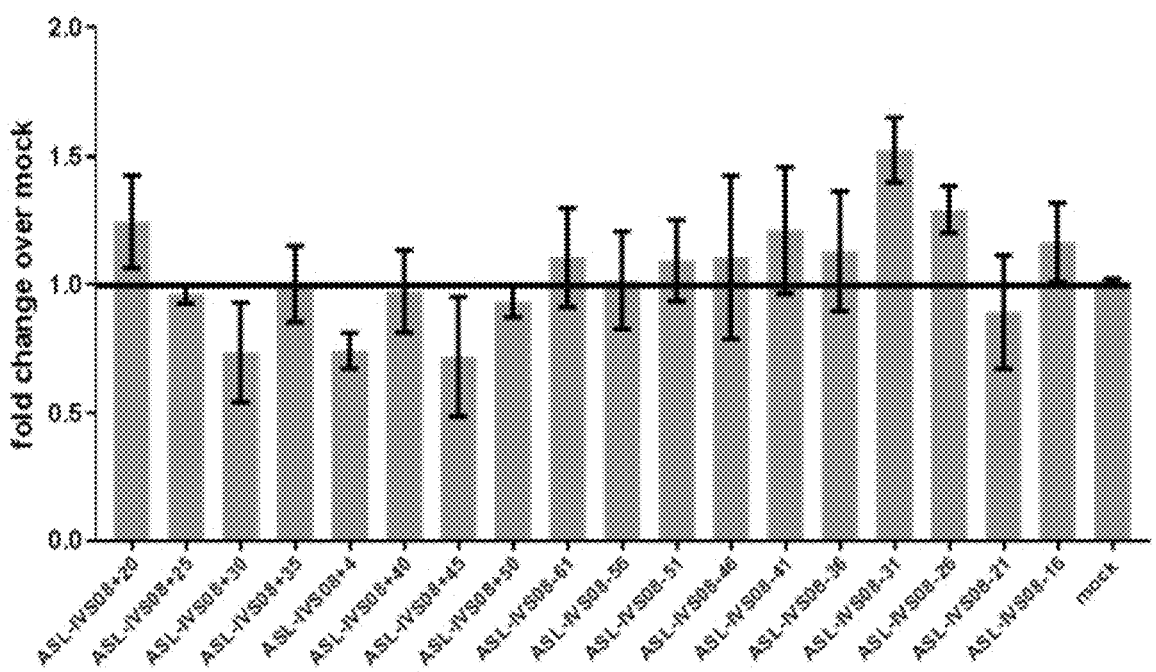

FIG. 132D depicts an exemplary graph showing the average (n=3) fold change in expression levels of ASL mRNA without intron 8 in ARPE-19 cells treated for 24 hrs with 80 nM of the indicated ASOs (spanning the exon 8-exon 9 splice junction) over mock treated cells. Data is normalized to RPL32 expression.

Figure 132E:
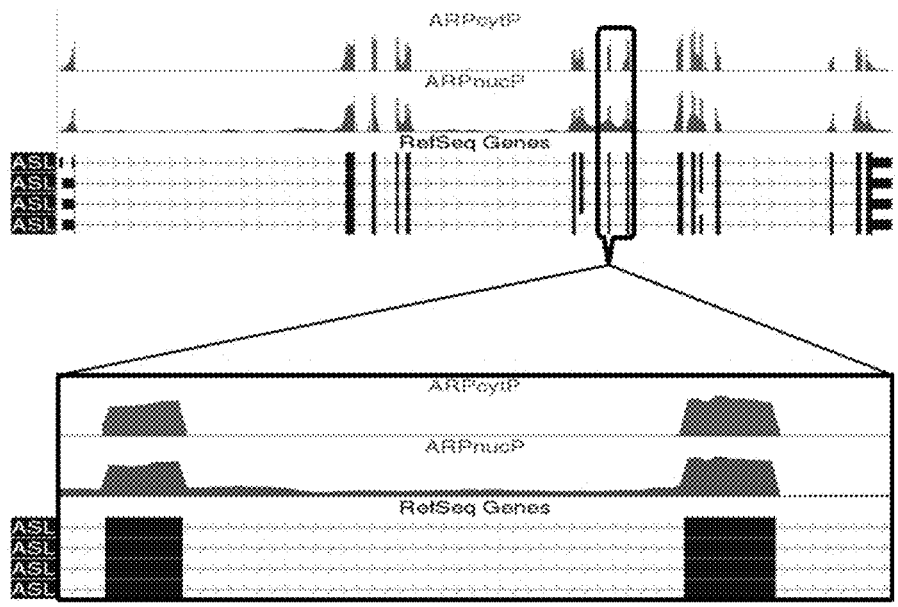

FIG. 132E depicts a schematic of the RefSeq Genes for ASL corresponding to ASL: NM_000048, NM_001024943, NM_001024944 and NM_001024946. The Percent Intron Retention (PIR) of the circled intron is shown (ASL intron 9, NM_000048).

Figure 132F:
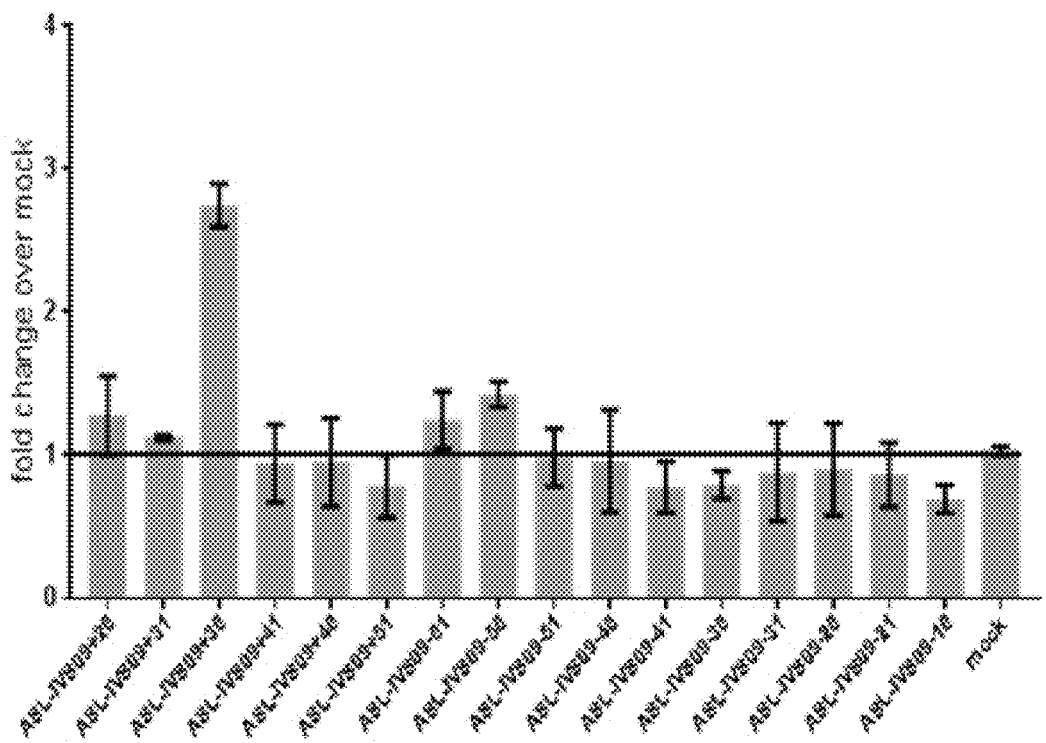

FIG. 132F depicts an exemplary graph showing the average (n=3) fold change in expression levels of ASL mRNA without intron 7 in ARPE-19 cells treated for 24 hrs with 80 nM of the indicated ASOs (spanning the exon 9-exon 10 splice junction) over mock treated cells. Data is normalized to RPL32 expression.

Figure 132G:
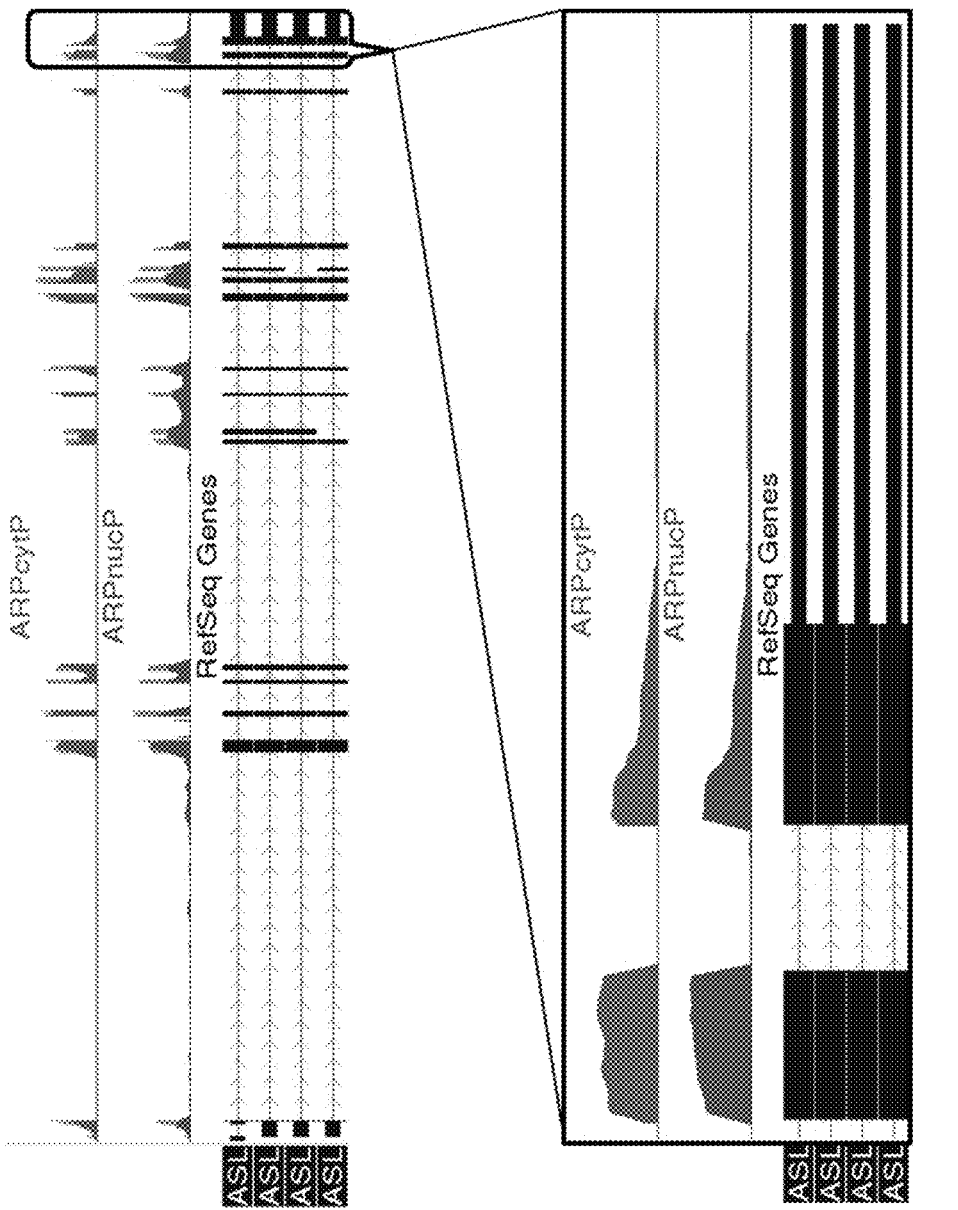

FIG. 132G depicts a schematic of the RefSeq Genes for ASL corresponding to ASL: NM_000048, NM_001024943, NM_001024944 and NM_001024946. The Percent Intron Retention (PIR) of the circled intron is shown (ASL intron 16, NM_000048).

Figure 133B:
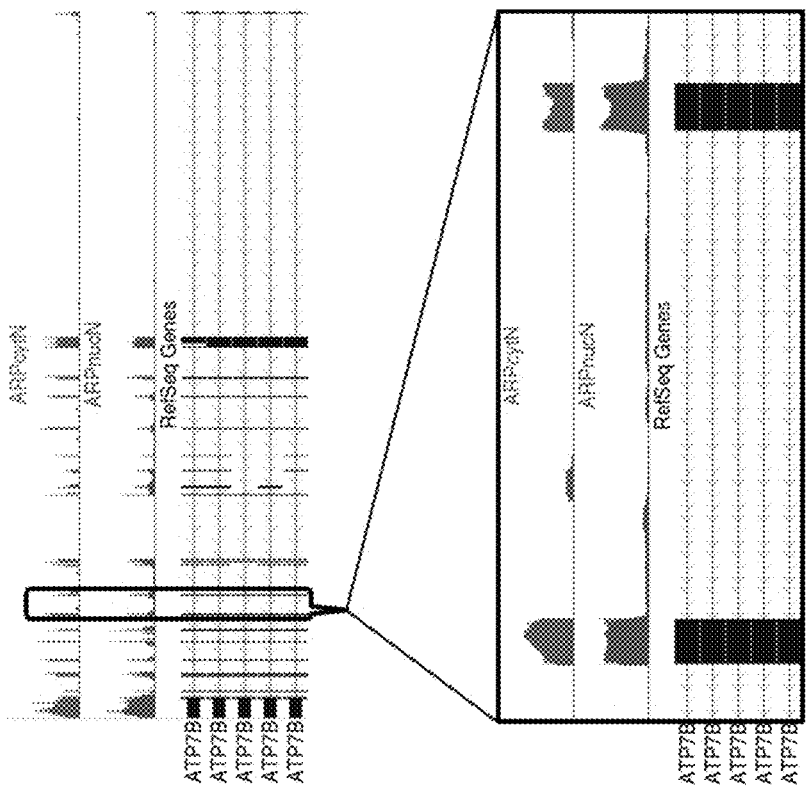
Figure 133A:
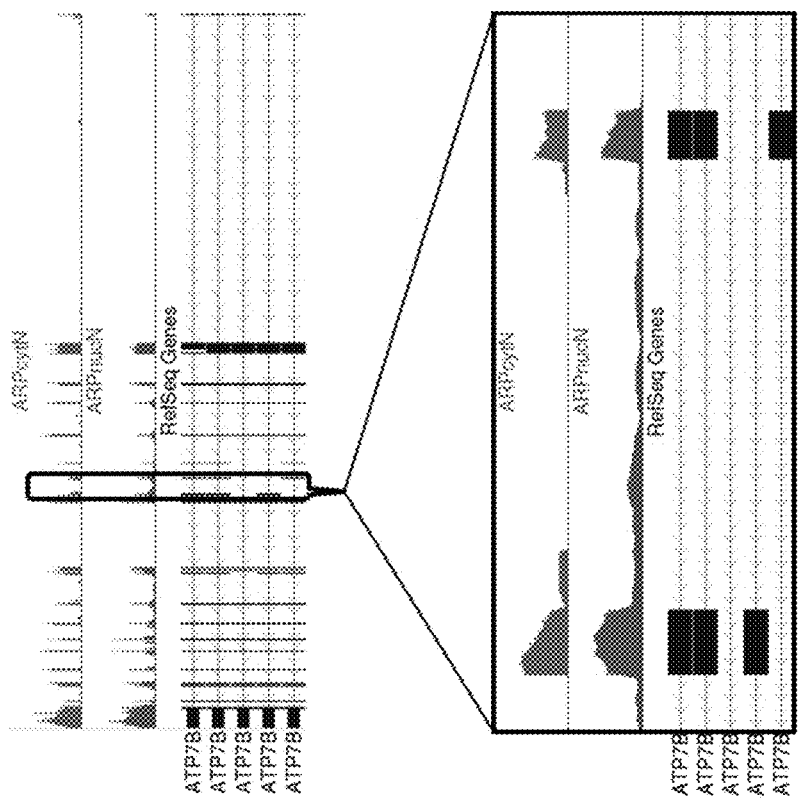

FIG. 133A depicts a schematic of the RefSeq Genes for ATP7B1 corresponding to ATP7B1: NM_001243182, NM_000053, NM_001005918, NM_001330579 and NM_001330578. The Percent Intron Retention (PIR) of the circled intron is shown (ATP7B1 intron 7, NM_000053).

FIG. 133B depicts a schematic of the RefSeq Genes for ATP7B1 corresponding to ATP7B1: NM_001243182, NM_000053, NM_001005918, NM_001330579 and NM_001330578. The Percent Intron Retention (PIR) of the circled intron is shown (ATP7B1 intron 13, NM_000053).

Figure 133C:
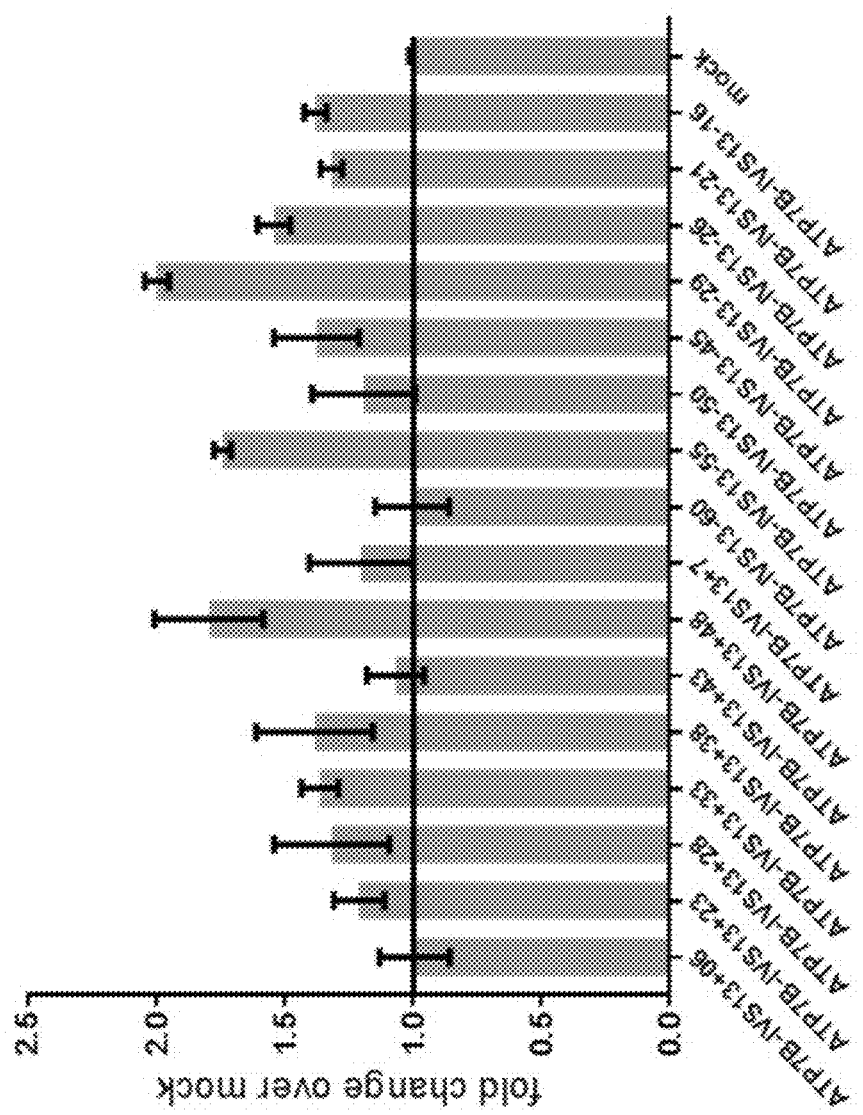

FIG. 133C depicts an exemplary graph showing the average (n=3) fold change in expression levels of ATP7B1 mRNA without intron 13 in ARPE-19 cells treated for 24 hrs with 80 nM of the indicated ASOs (spanning the exon 13-exon 14 splice junction) over mock treated cells. Data is normalized to RPL32 expression.

Figure 134:
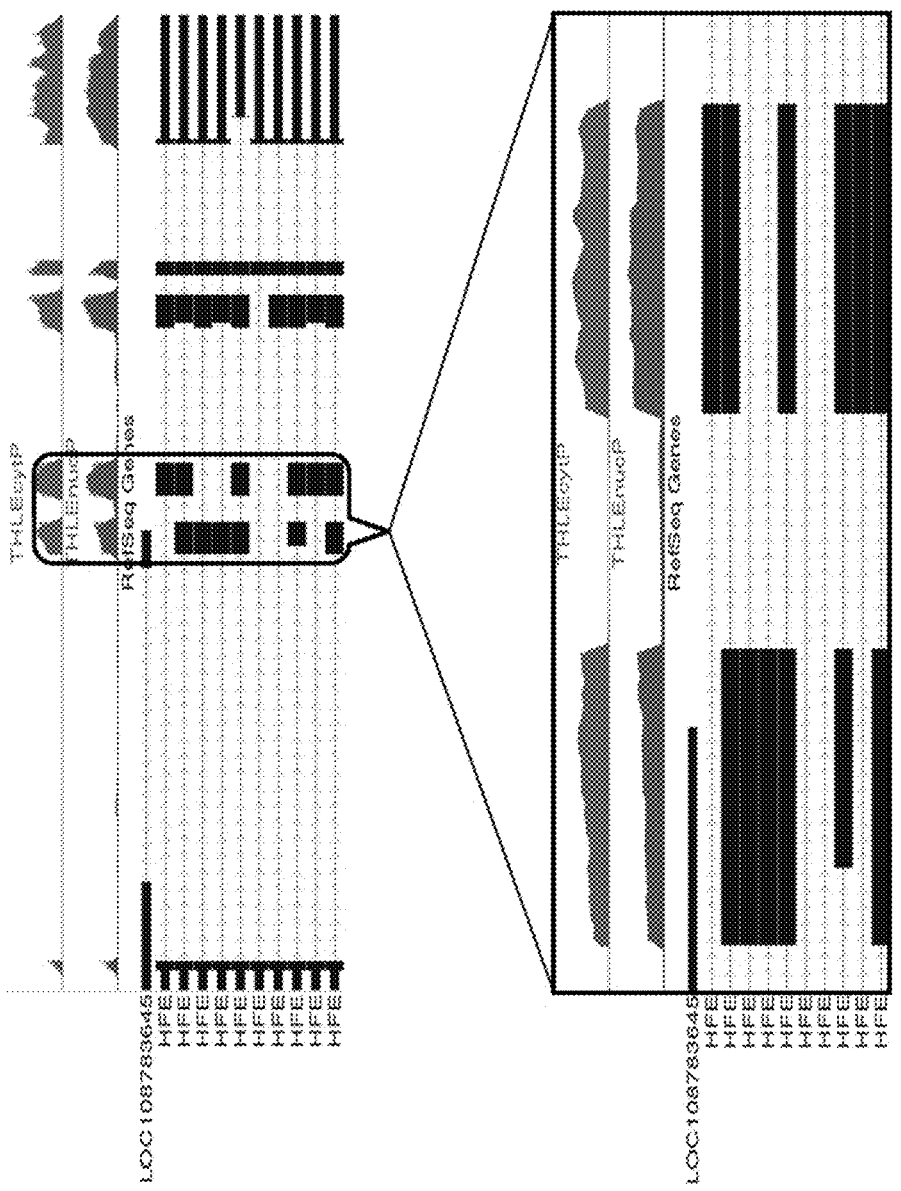

FIG. 134 depicts a schematic of the RefSeq Genes for HFE corresponding to HFE: NM_139007, NM_139006, NM_139004, NM_139003, NM_001300749, NM_139009, NM_139008, and NM_000410. The Percent Intron Retention (PIR) of the circled intron is shown (HFE intron 2, NM_000410).

Figure 135A:
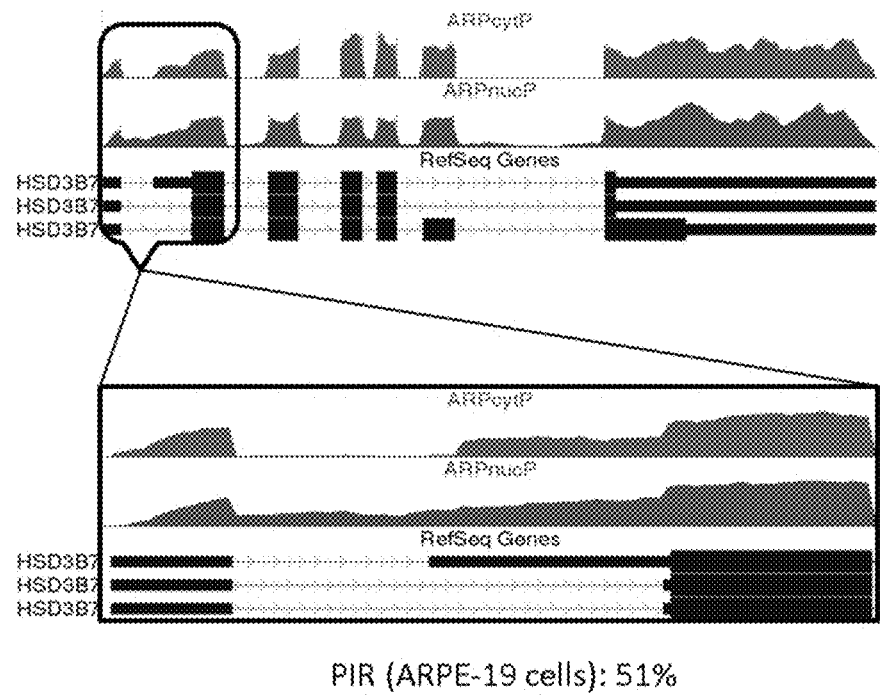

FIG. 135A depicts a schematic of the RefSeq Genes for HSD3B7 corresponding to HSD3B7: NM_001142777, NM_001142778 and NM_025193. The Percent Intron Retention (PIR) of the circled intron is shown (HSD3B7 intron 1, NM_001142777).

Figure 135B:
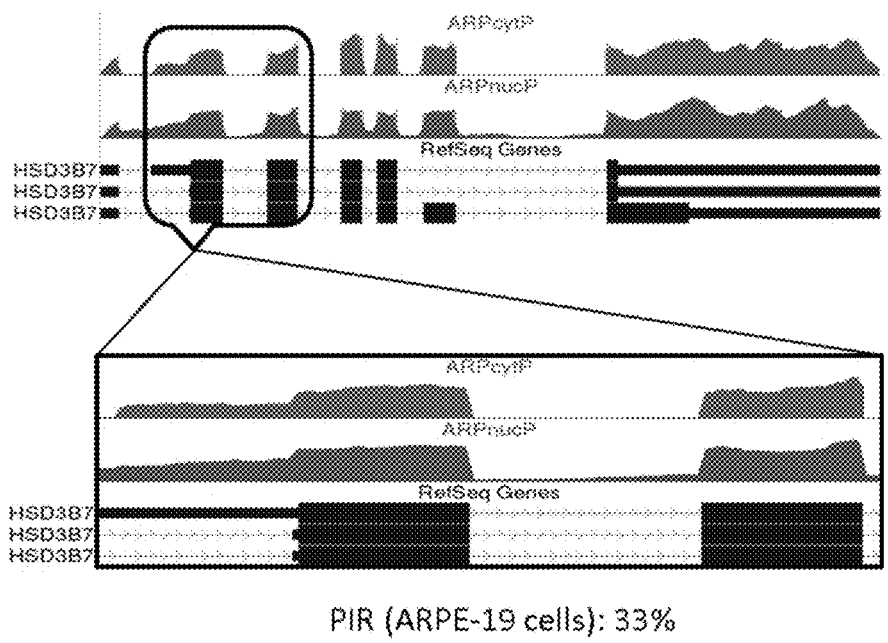

FIG. 135B depicts a schematic of the RefSeq Genes for HSD3B7 corresponding to HSD3B7: NM_001142777, NM_001142778 and NM_025193. The Percent Intron Retention (PIR) of the circled intron is shown (HSD3B7 intron 1, NM_001142777).

Figure 135C:
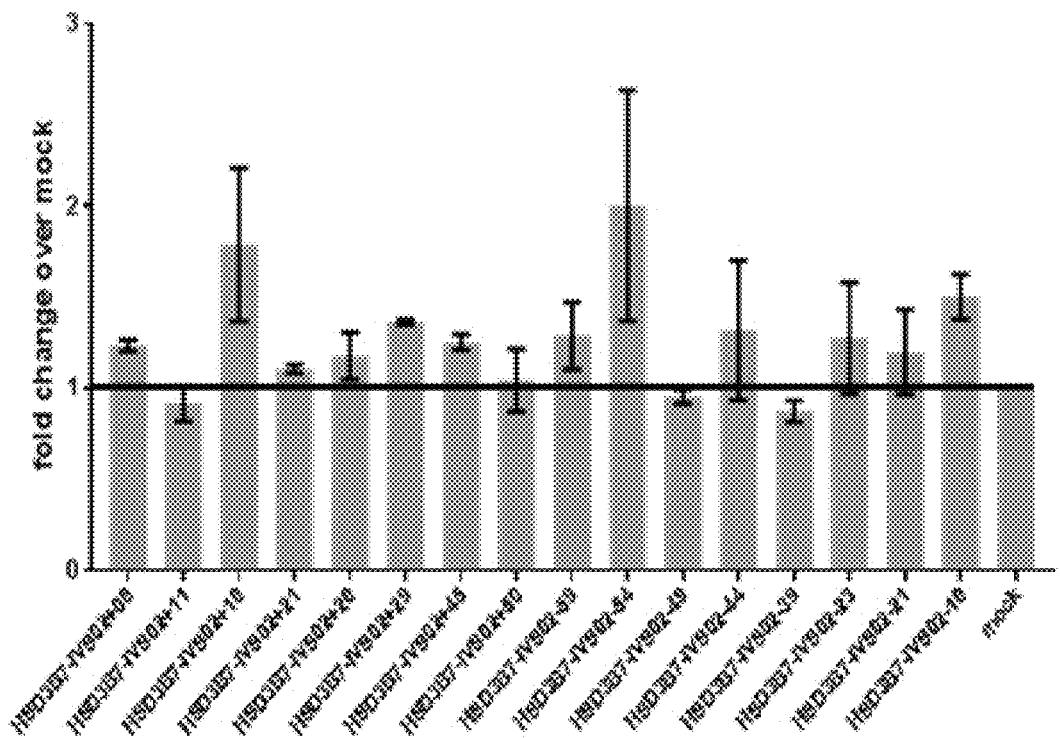

FIG. 135C depicts an exemplary graph showing the average (n=3) fold change in expression levels of HSD3B7 mRNA without intron 2 in ARPE-19 cells treated for 24 hrs with 80 nM of the indicated ASOs (spanning the exon 2-exon 3 splice junction) over mock treated cells. Data is normalized to RPL32 expression.

Figure 135D:
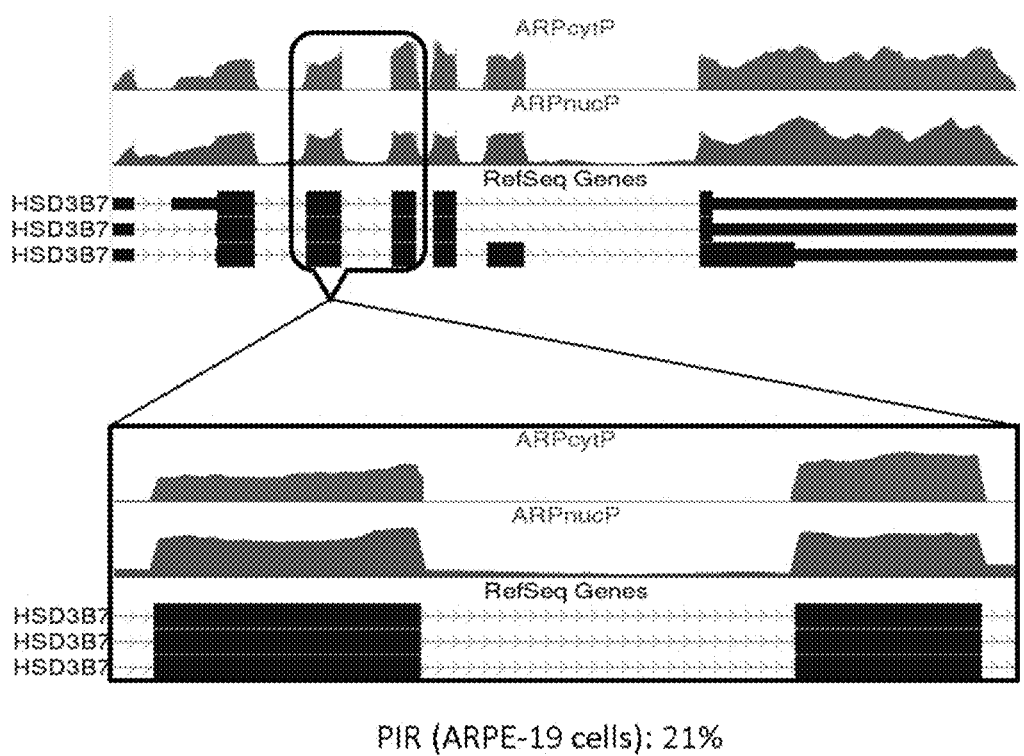

FIG. 135D depicts a schematic of the RefSeq Genes for HSD3B7 corresponding to HSD3B7: NM_001142777, NM_001142778 and NM_025193. The Percent Intron Retention (PIR) of the circled intron is shown (HSD3B7 intron 3, NM_001142777).

Figure 135E:
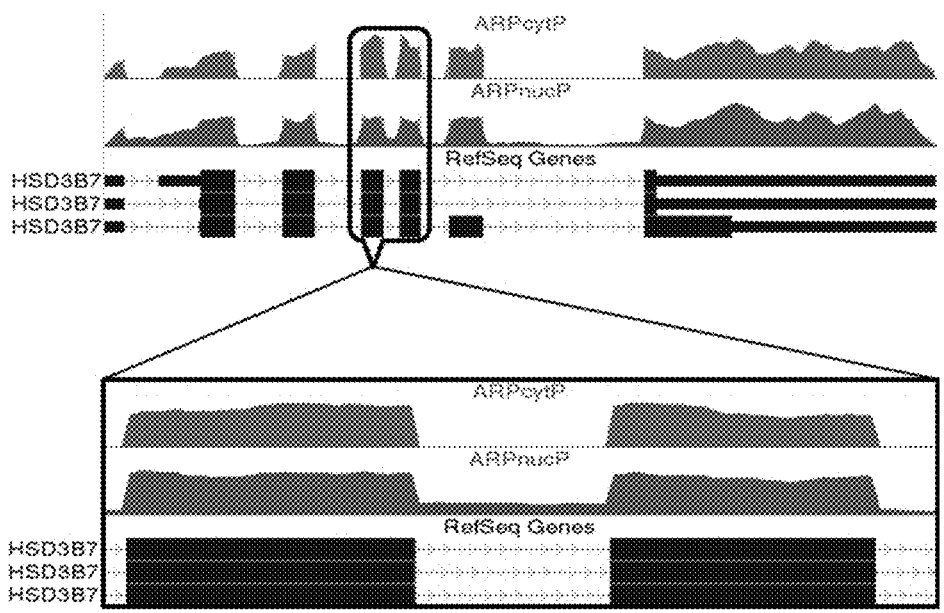

FIG. 135E depicts a schematic of the RefSeq Genes for HSD3B7 corresponding to HSD3B7: NM_001142777, NM_001142778 and NM_025193. The Percent Intron Retention (PIR) of the circled intron is shown (HSD3B7 intron 4, NM_001142777).

Figure 135F:
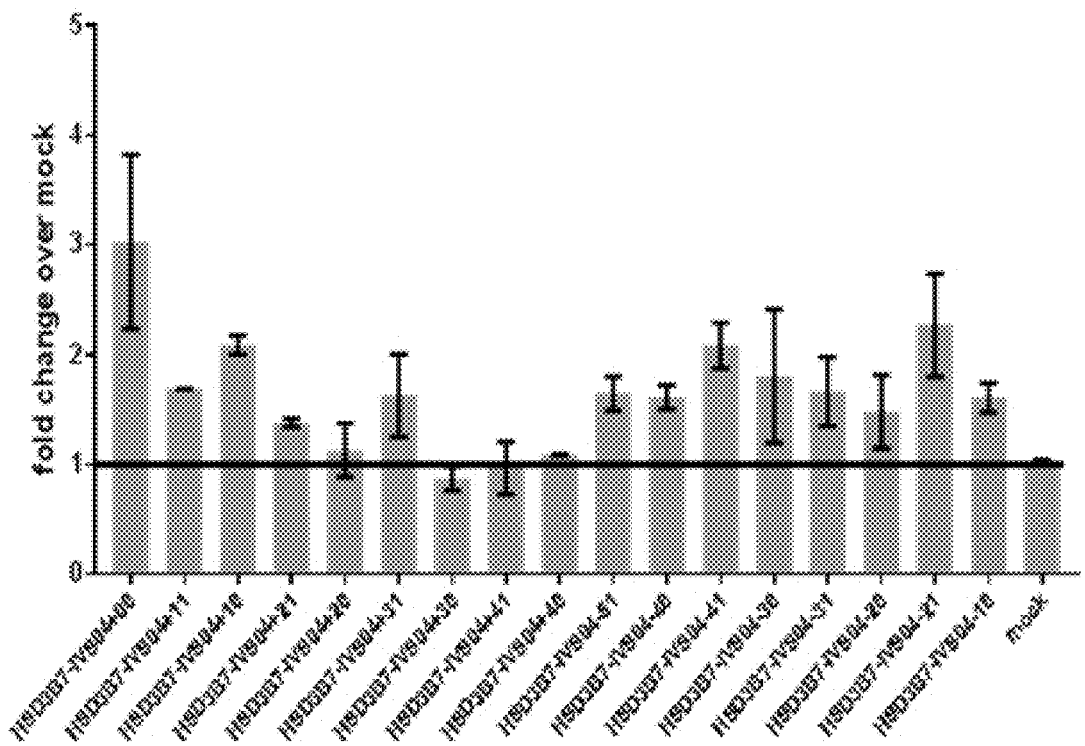

FIG. 135F depicts an exemplary graph showing the average (n=3) fold change in expression levels of HSD3B7 mRNA without intron 4 in ARPE-19 cells treated for 24 hrs with 80 nM of the indicated ASOs (spanning the exon 4-exon 5 splice junction) over mock treated cells. Data is normalized to RPL32 expression.

Figure 135G:
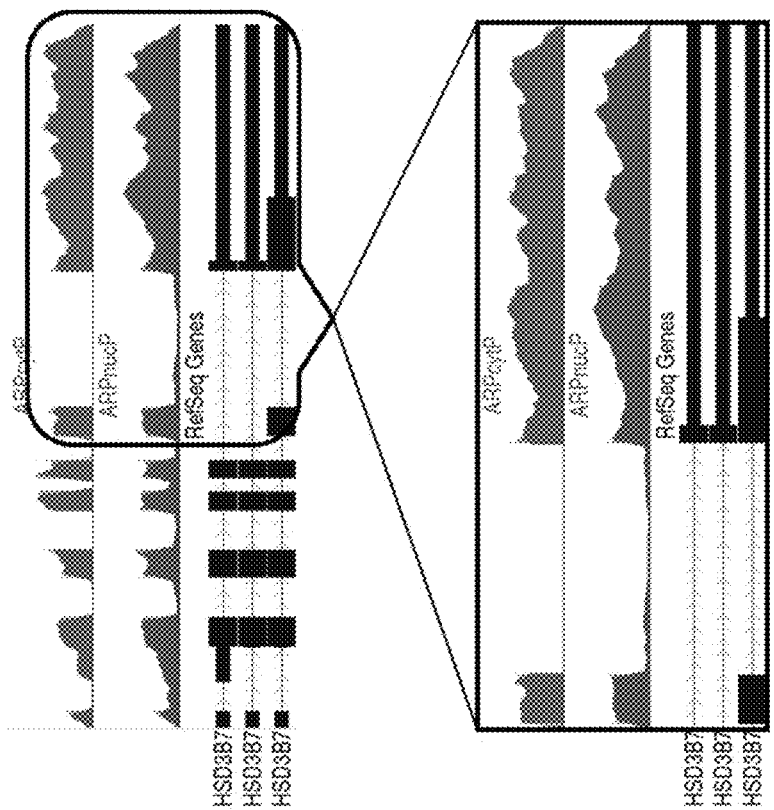

FIG. 135G depicts a schematic of the RefSeq Genes for HSD3B7 corresponding to HSD3B7: NM_001142777, NM_001142778 and NM_025193. The Percent Intron Retention (PIR) of the circled intron is shown (HSD3B7 intron 5, NM_025193).

Figure 135H:
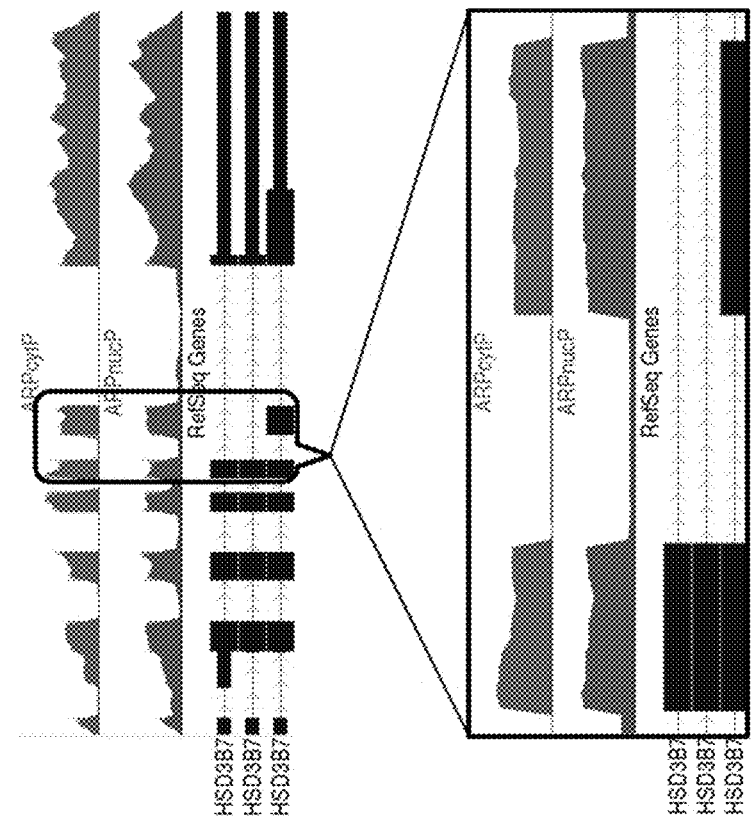

FIG. 135H depicts a schematic of the RefSeq Genes for HSD3B7 corresponding to HSD3B7: NM_001142777, NM_001142778 and NM_025193. The Percent Intron Retention (PIR) of the circled intron is shown (HSD3B7 intron 6, NM_025193).

Figure 136:
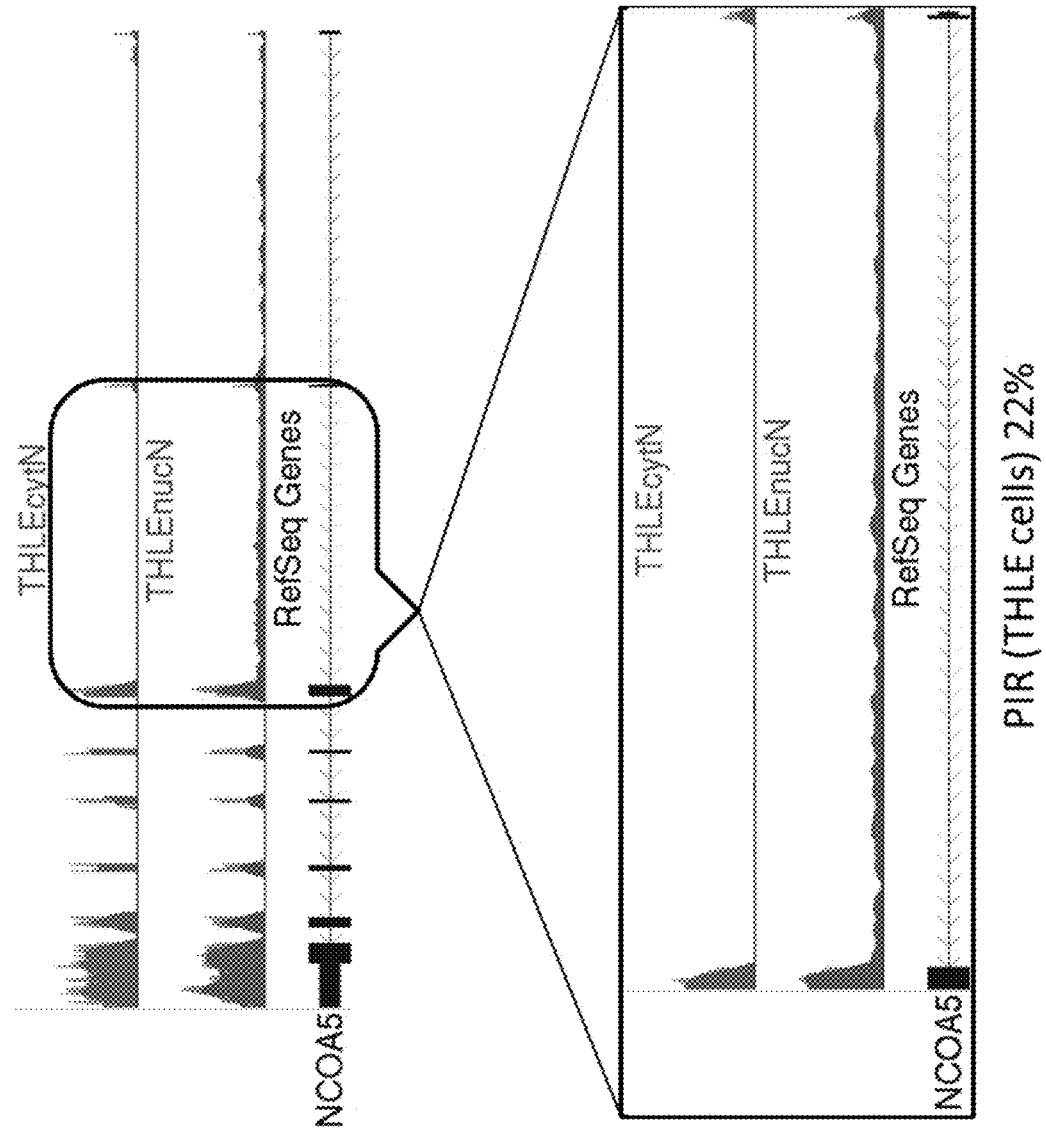

FIG. 136 depicts a schematic of the RefSeq Genes for NCOA5 corresponding to NCOA5: NM_020967. The Percent Intron Retention (PIR) of the circled intron is shown (NCOA5 intron2, NM_020967).

Figure 137A:
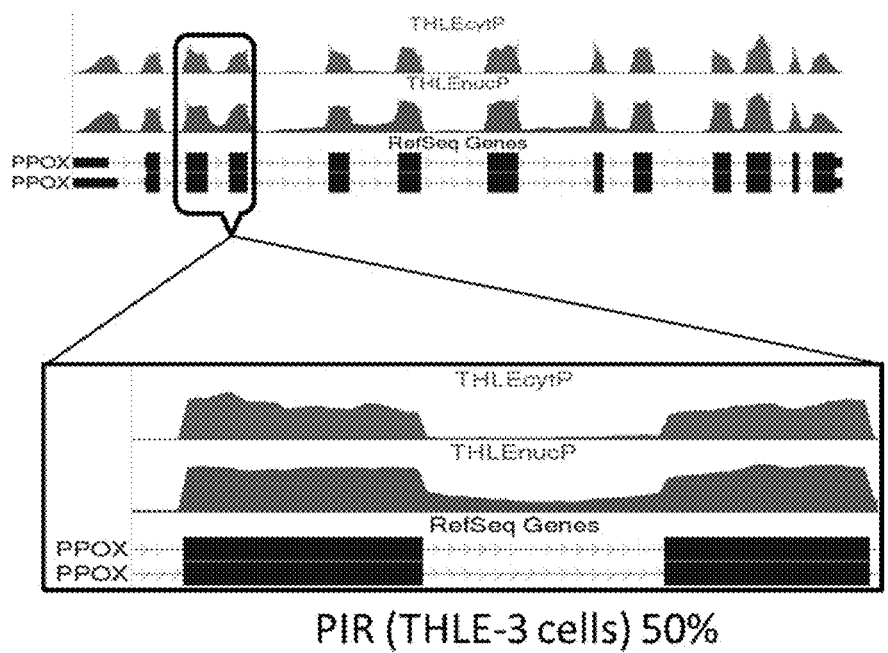

FIG. 137A depicts a schematic of the RefSeq Genes for PPDX corresponding to PPDX: NM_000309 and NM_001122764. The Percent Intron Retention (PIR) of the circled intron is shown (PPDX intron 3, 000309).

Figure 137B:
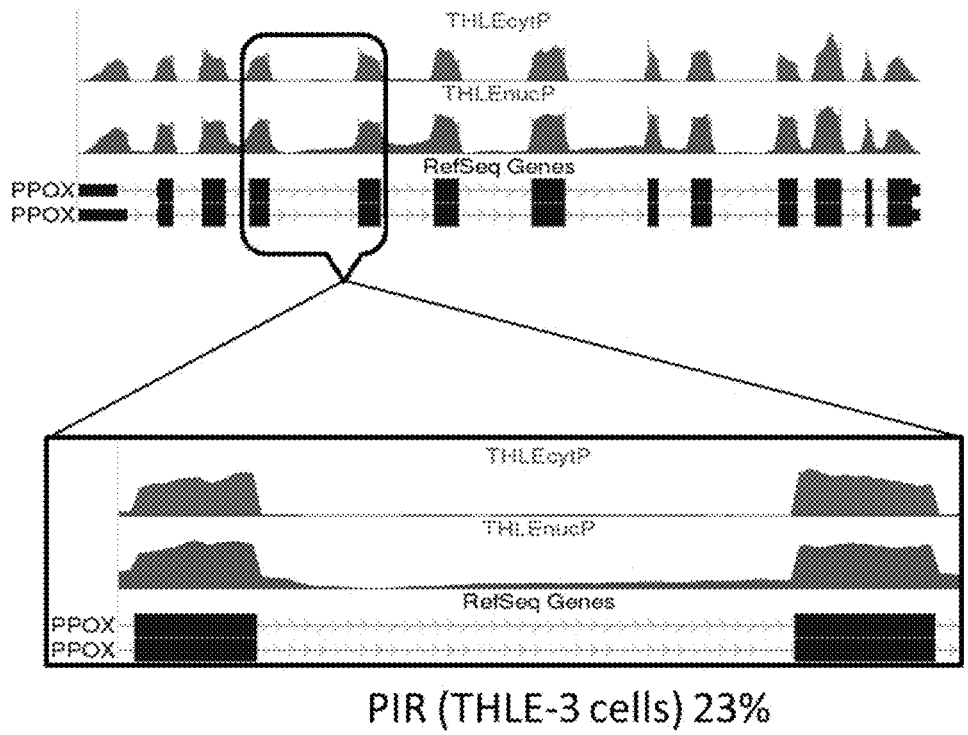

FIG. 137B depicts a schematic of the RefSeq Genes for PPDX corresponding to PPDX: NM_000309 and NM_001122764. The Percent Intron Retention (PIR) of the circled intron is shown (PPDX intron 4, 000309).

Figure 137C:
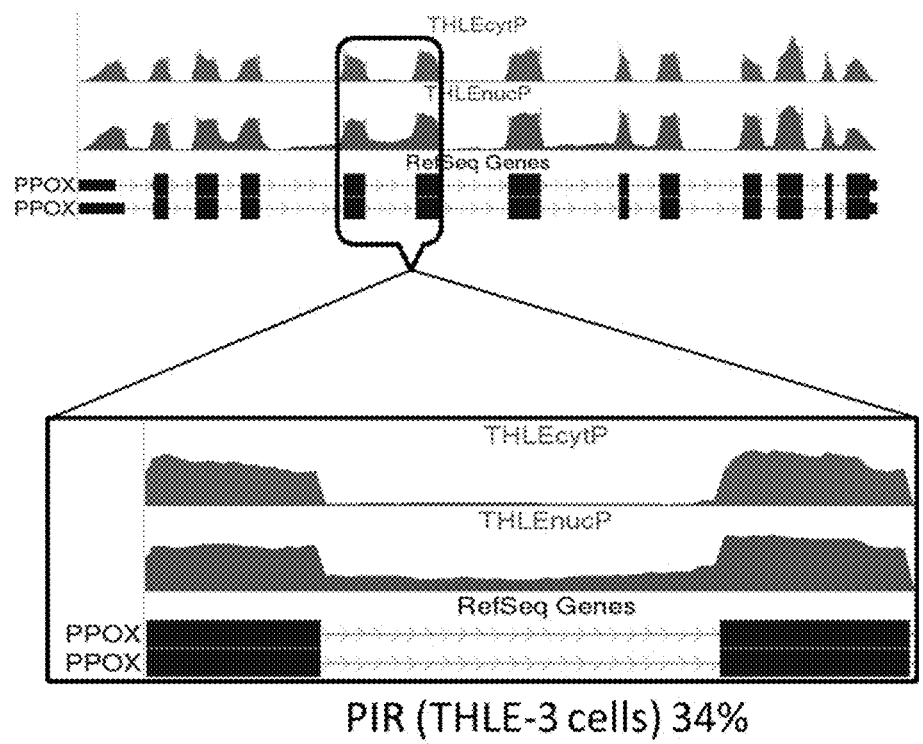

FIG. 137C depicts a schematic of the RefSeq Genes for PPDX corresponding to PPDX: NM_000309 and NM_001122764. The Percent Intron Retention (PIR) of the circled intron is shown (PPDX intron 5, 000309).

Figure 137D:
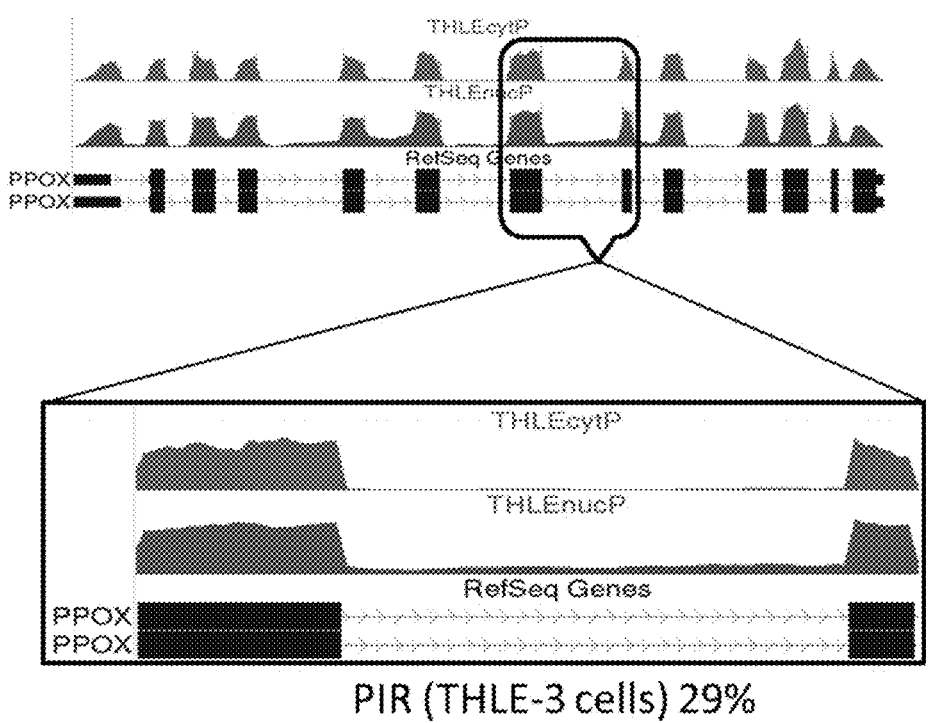

FIG. 137D depicts a schematic of the RefSeq Genes for PPDX corresponding to PPDX: NM_000309 and NM_001122764. The Percent Intron Retention (PIR) of the circled intron is shown (PPDX intron 7, 000309).

Figure 137E:
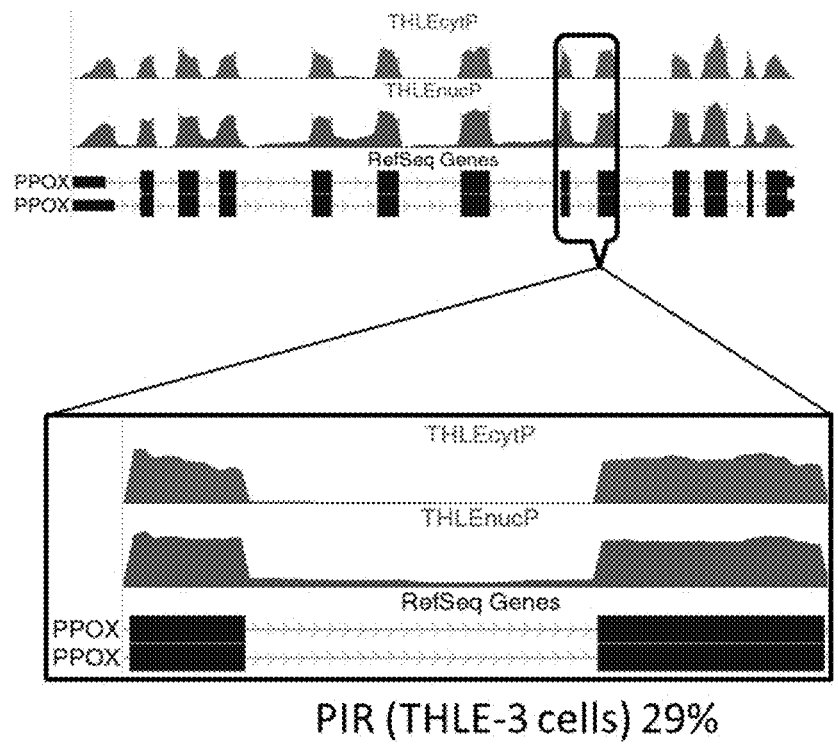

FIG. 137E depicts a schematic of the RefSeq Genes for PPDX corresponding to PPDX: NM_000309 and NM_001122764. The Percent Intron Retention (PIR) of the circled intron is shown (PPDX intron 8, 000309).

Figure 137F:
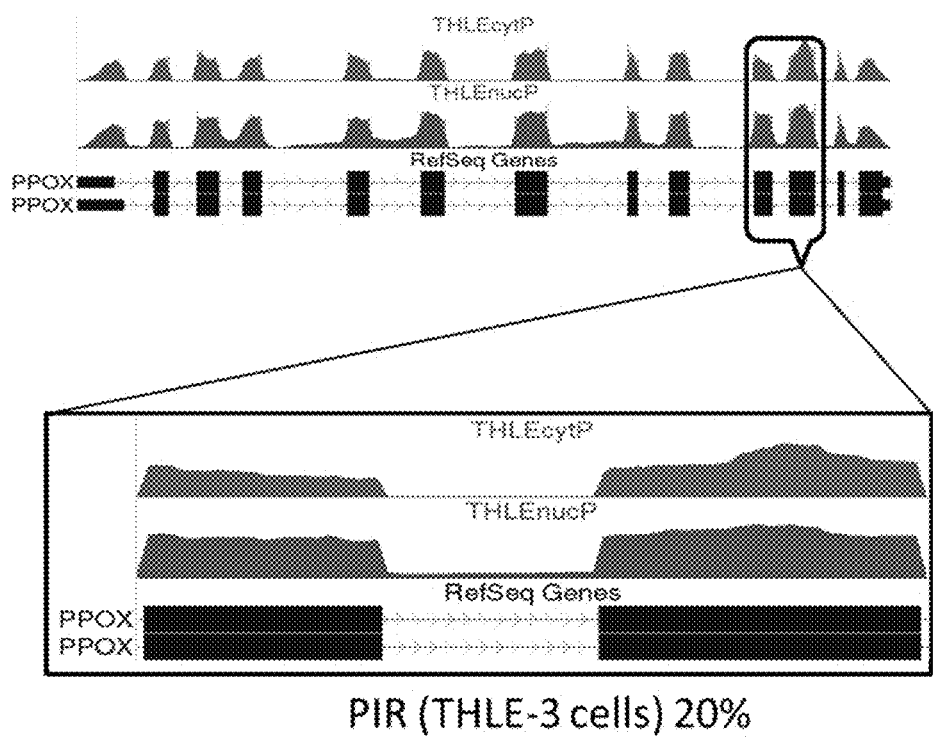

FIG. 137F depicts a schematic of the RefSeq Genes for PPDX corresponding to PPDX: NM_000309 and NM_001122764. The Percent Intron Retention (PIR) of the circled intron is shown (PPDX intron 10, 000309).

Figure 137G:
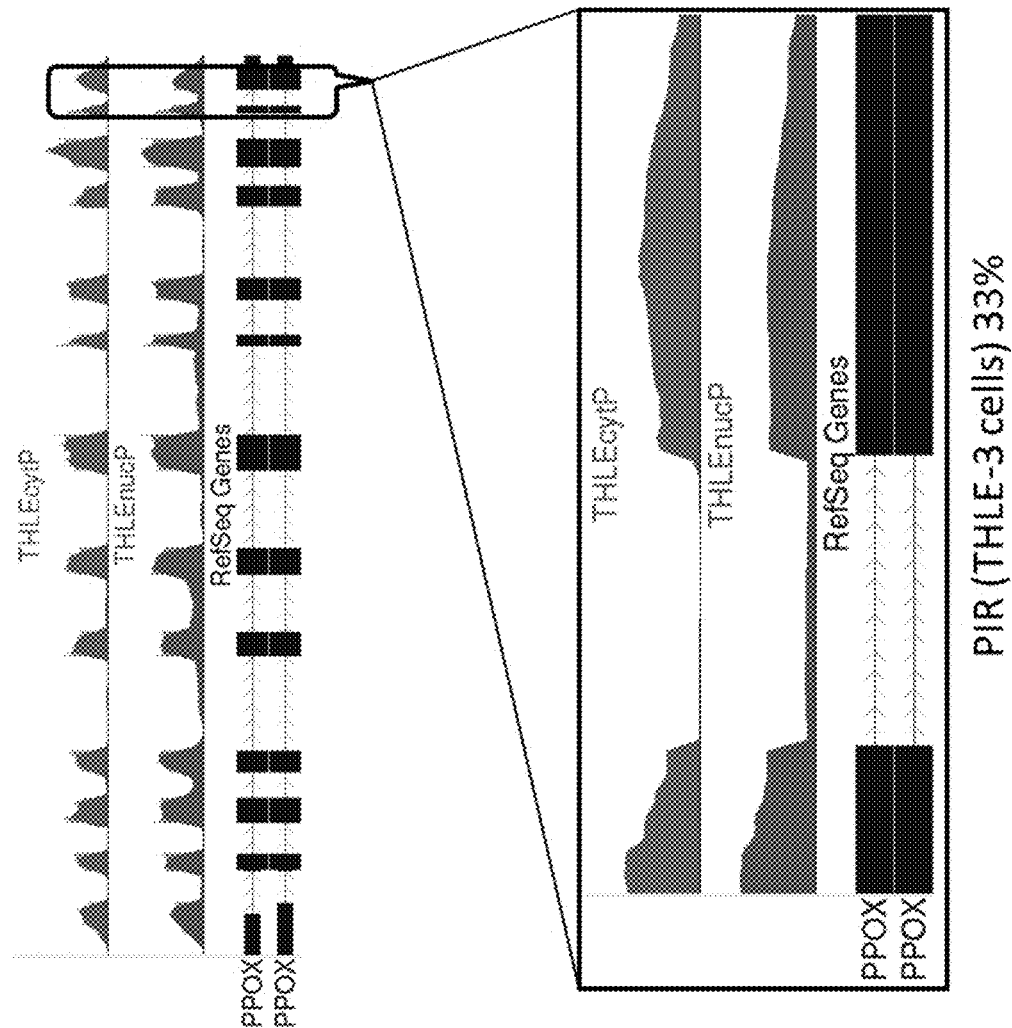

FIG. 137G depicts a schematic of the RefSeq Genes for PPDX corresponding to PPDX: NM_000309 and NM_001122764. The Percent Intron Retention (PIR) of the circled intron is shown (PPDX intron 12, 000309).

Figure 138A:
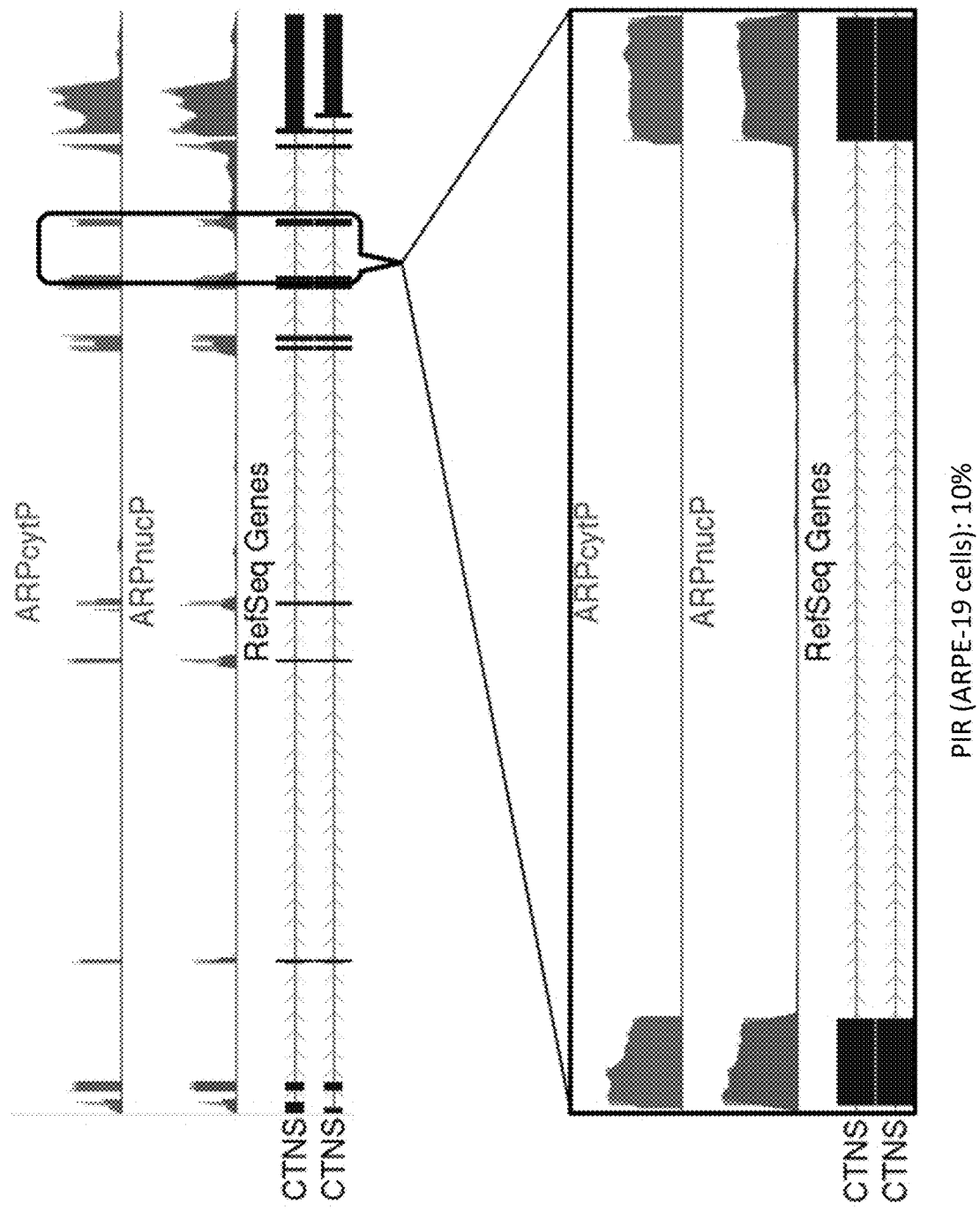

FIG. 138A depicts a schematic of the RefSeq Genes for CTNS corresponding to NM_004937 and NM_001031681. The Percent Intron Retention (PIR) of the circled intron is shown.

Figure 138B:
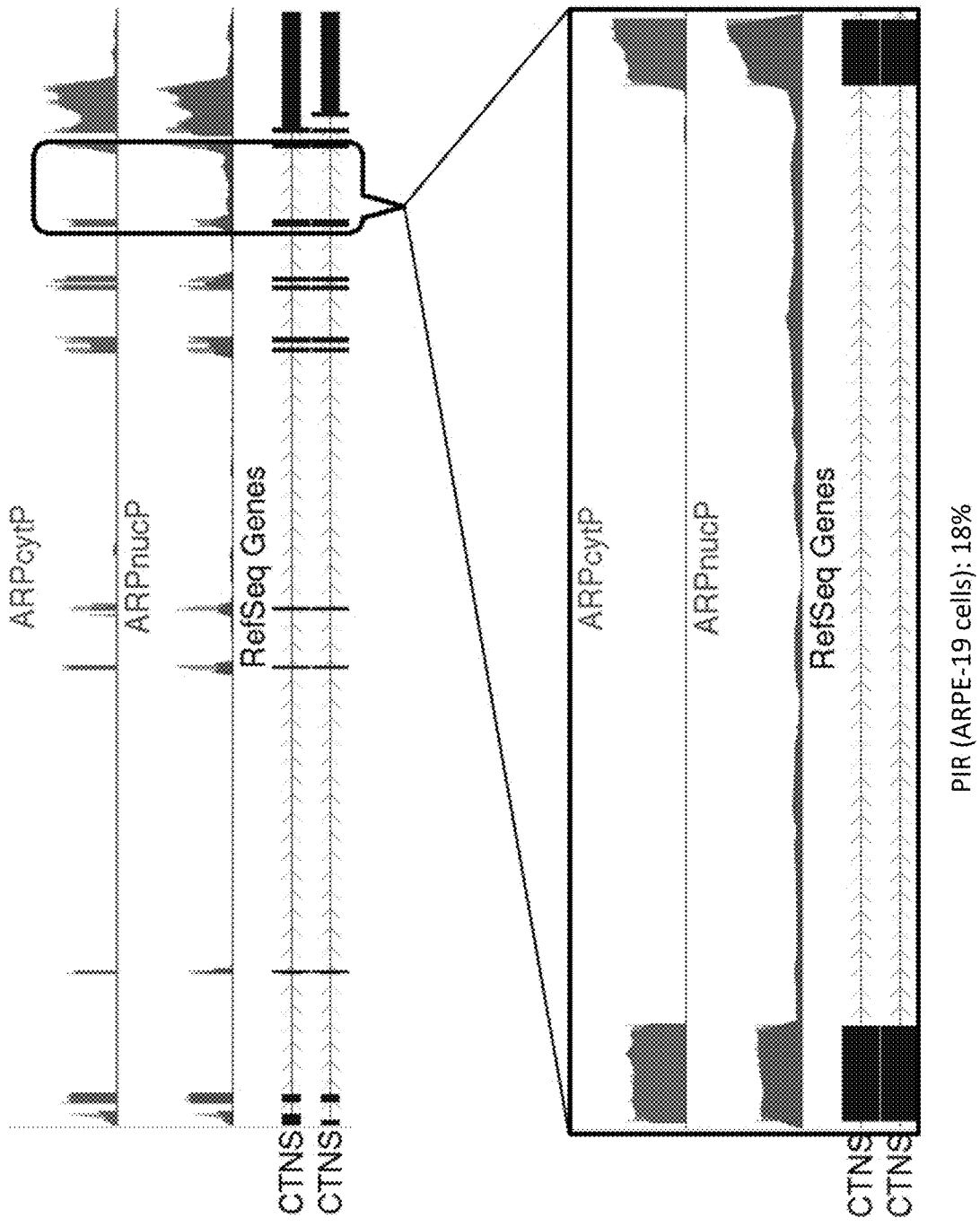

FIG. 138B depicts a schematic of the RefSeq Genes for CTNS corresponding to NM_004937 and NM_001031681. The PIR of the circled intron is shown.

Figure 138C:
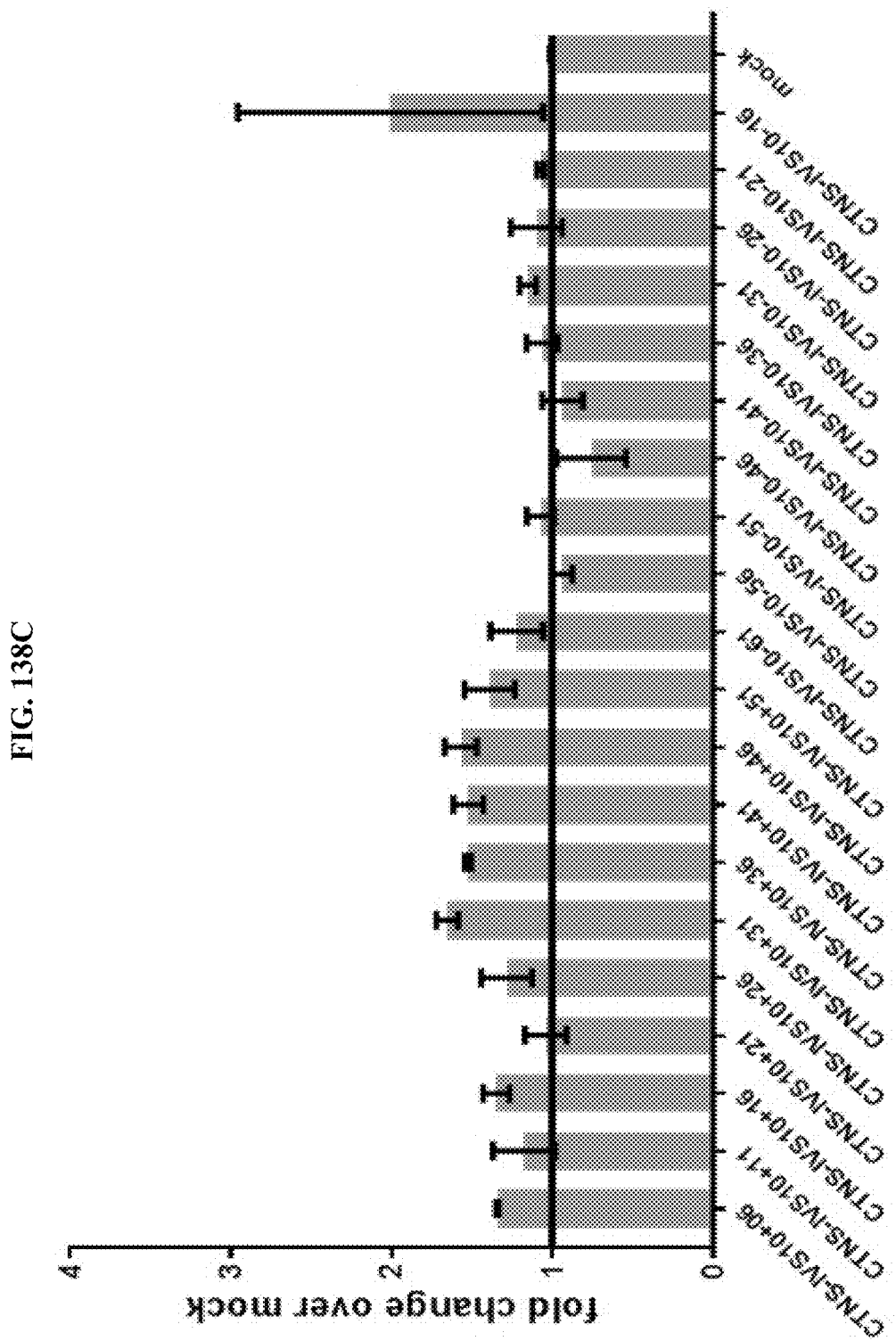

FIG. 138C depicts an exemplary graph showing the average (n=3) fold change in expression levels of CTNS mRNA without intron 10 in ARPE-19 cells treated for 24 hrs with 80 nM of the indicated ASOs over mock treated cells. Data is normalized to RPL32 expression.

Figure 139A:
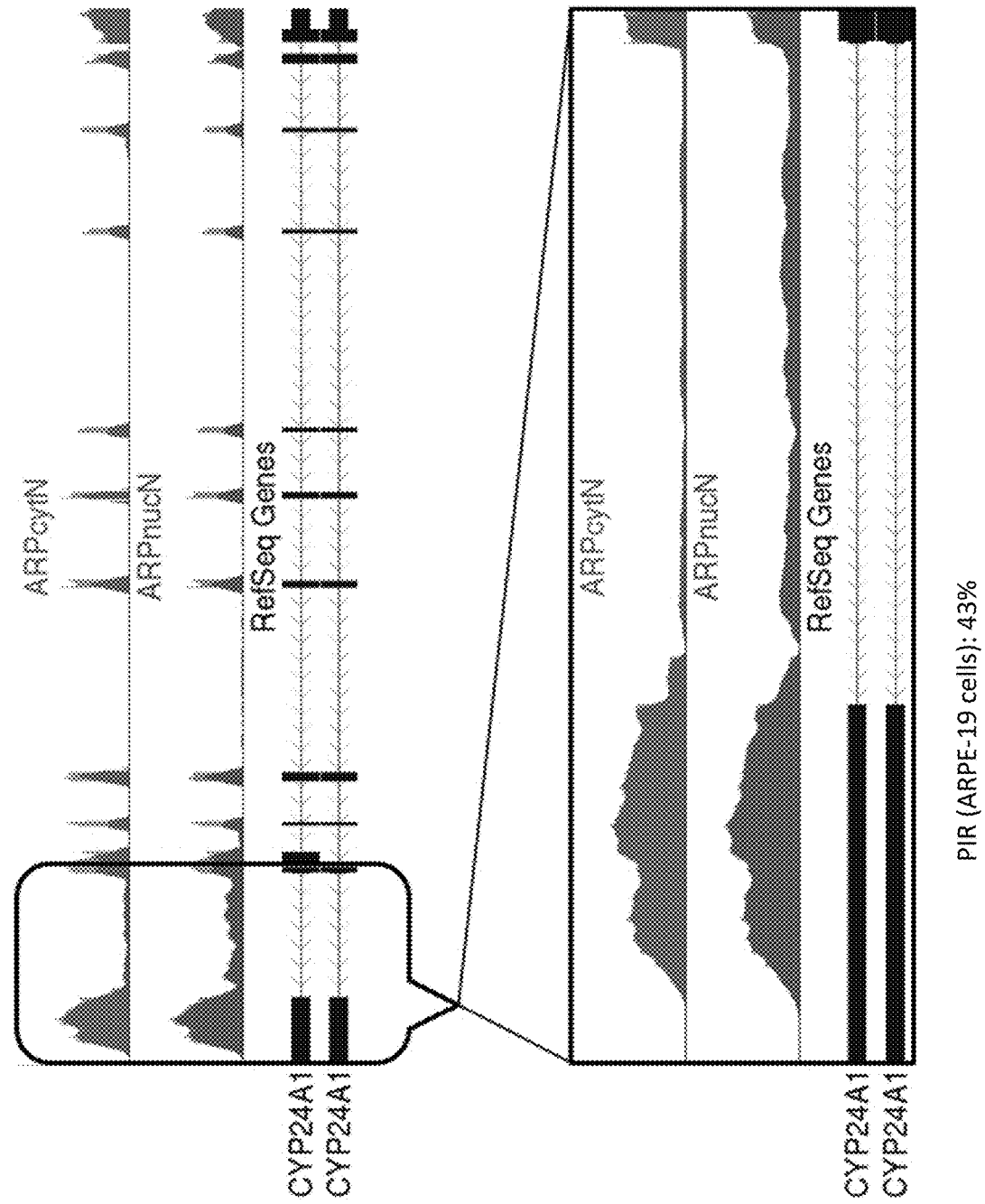

FIG. 139A depicts a schematic of the RefSeq Genes for CYP24A1 corresponding to NM_000782 and NM_001128915. The PIR of the circled intron is shown.

Figure 139B:
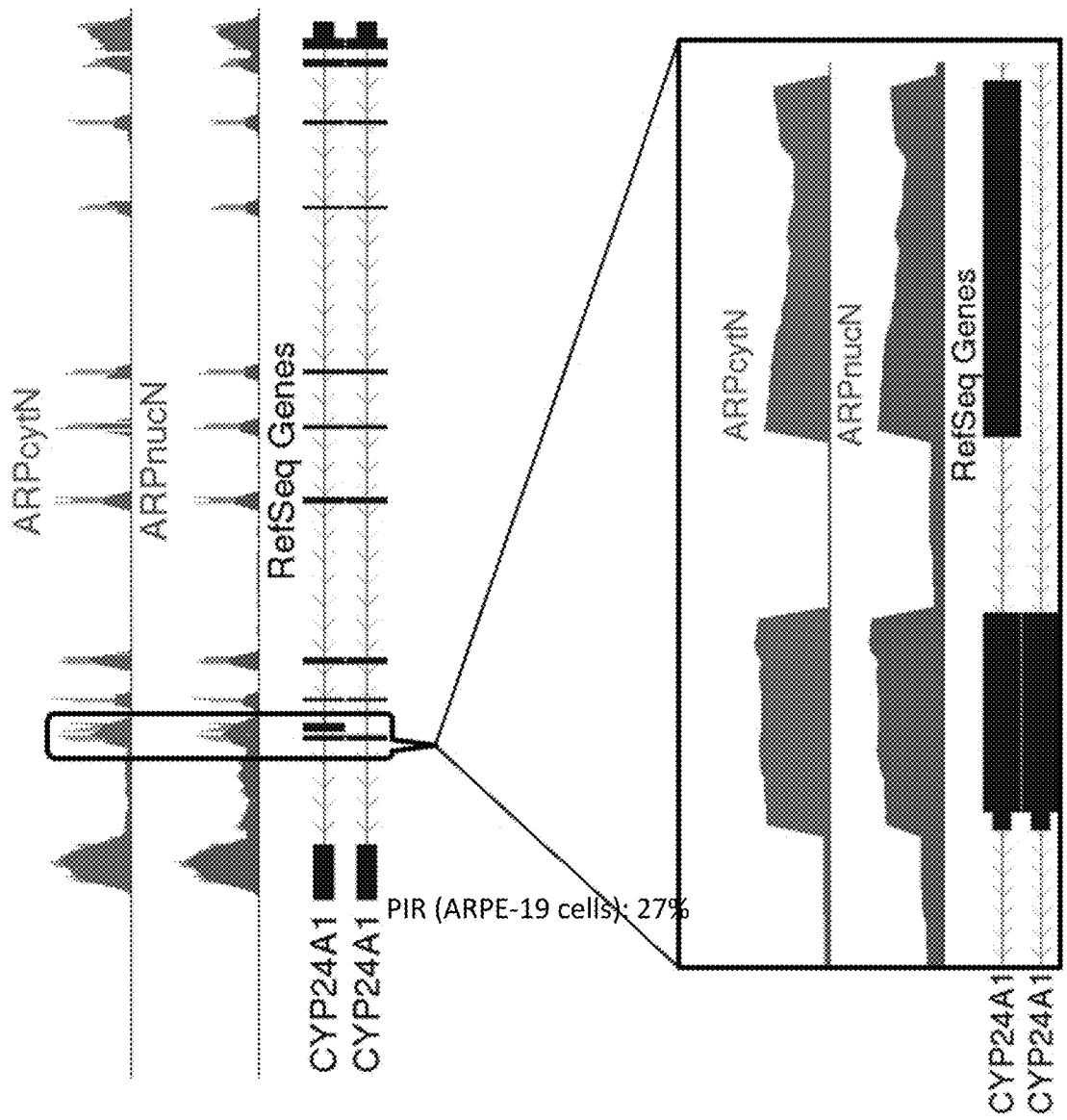

FIG. 139B depicts a schematic of the RefSeq Genes for CYP24A1 corresponding to NM_000782 and NM_001128915. The PIR of the circled intron is shown.

Figure 139C:
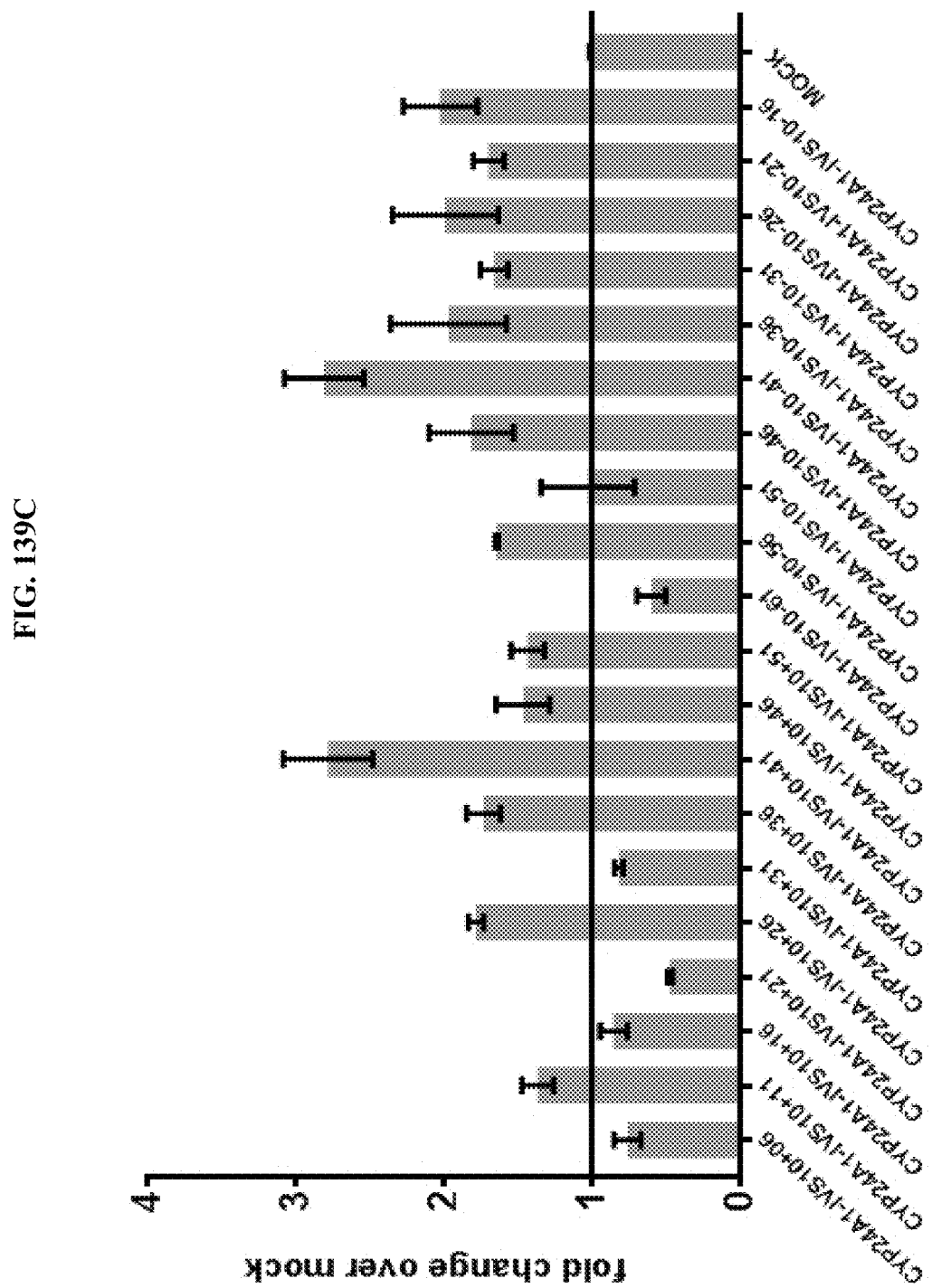

FIG. 139C depicts an exemplary graph showing the average (n=3) fold change in expression levels of CYP24A1 mRNA without intron 10 in ARPE-19 cells treated for 24 hrs with 80 nM of the indicated ASOs over mock treated cells. Data is normalized to RPL32 expression.

Figure 140:
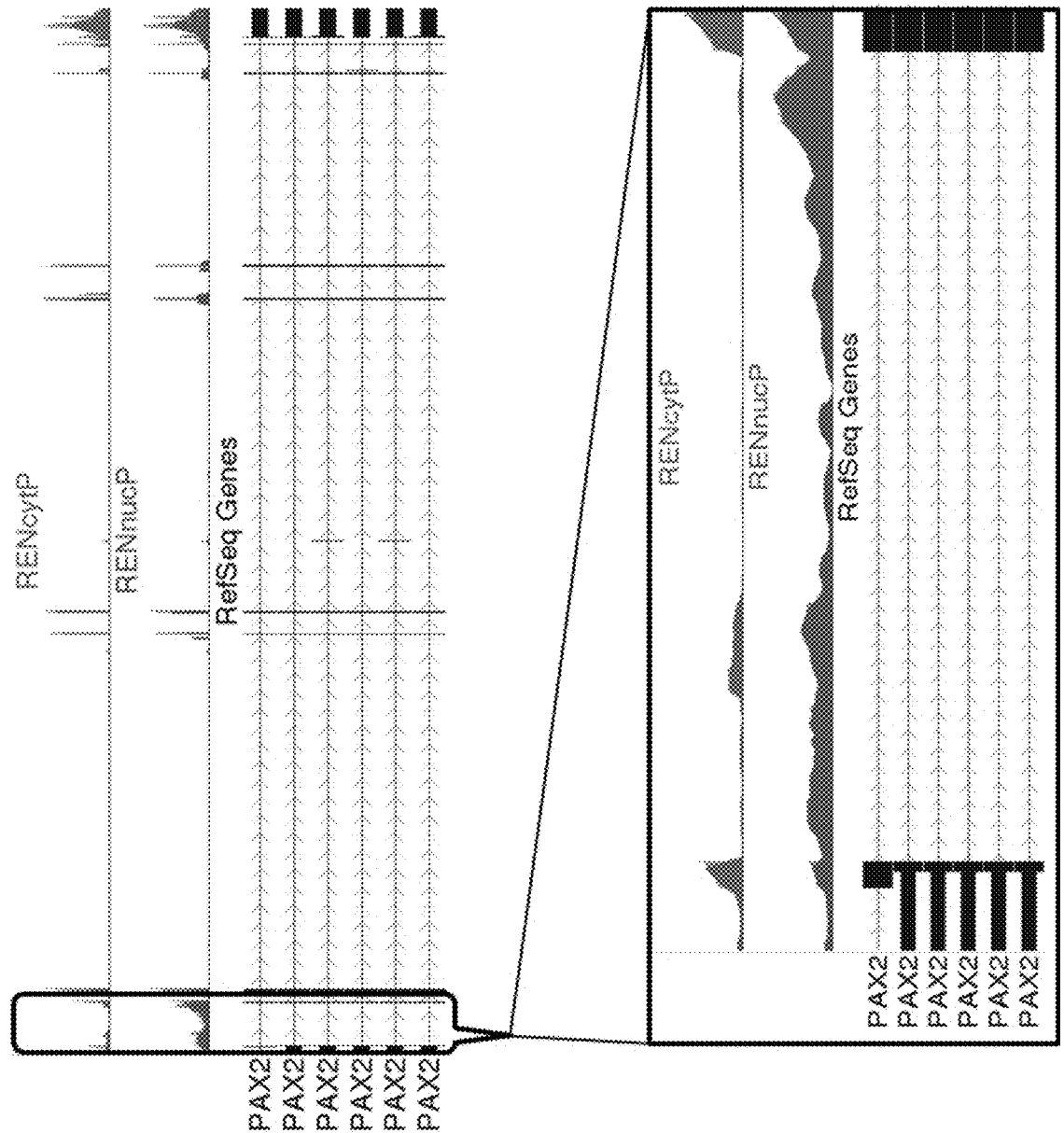

FIG. 140 depicts a schematic of the RefSeq Genes for PAX2 corresponding to NM_001304569, NM_000278, NM_003990, NM_003988, NM_003987 and NM_003989.

Figure 141A:
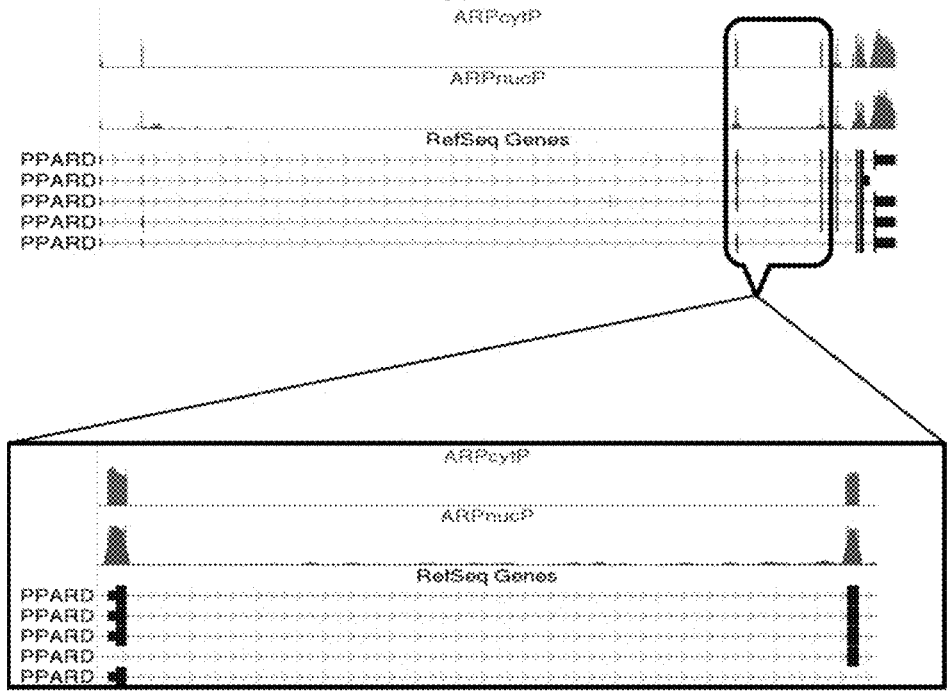

FIG. 141A depicts a schematic of the RefSeq Genes for PPARD corresponding to PPARD: NM_006238, NM_177435, NM_001171818, NM_001171819 and NM_001171820. The Percent Intron Retention (PIR) of the circled intron is shown (PPARD intron 3, NM_006238).

Figure 141B:
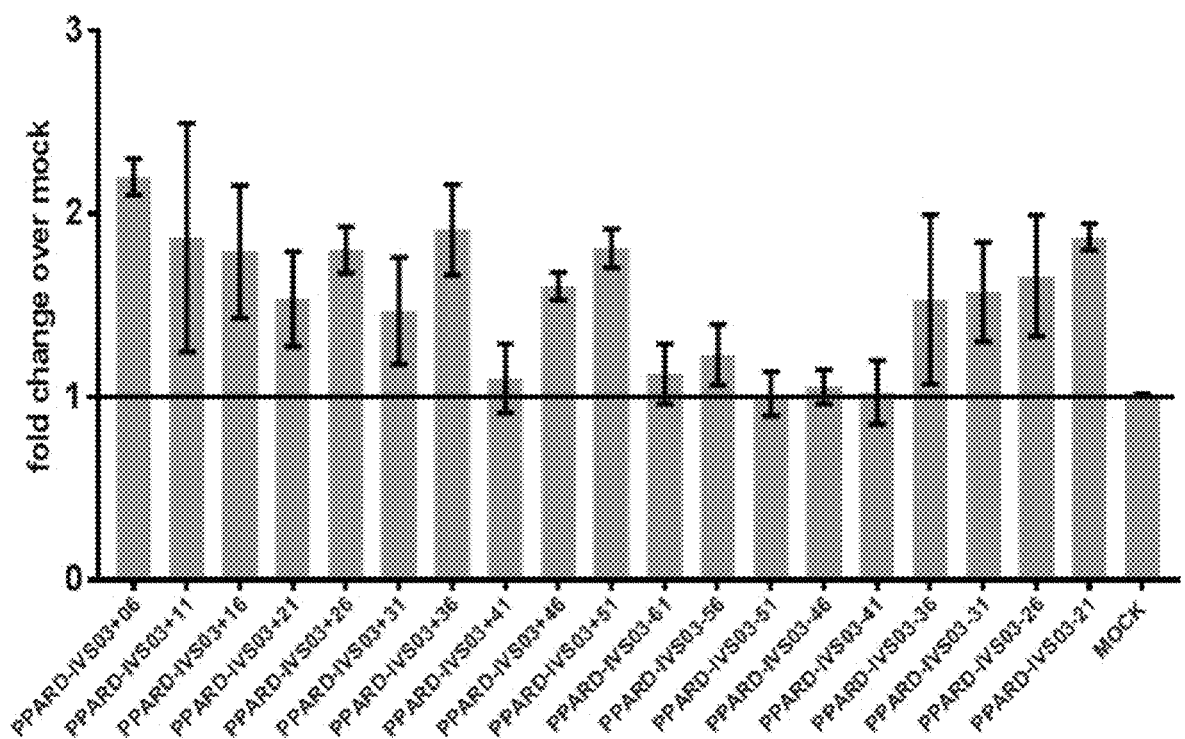

FIG. 141B depicts an exemplary graph showing the average (n=3) fold change in expression levels of PPARD mRNA without intron 3 in ARPE-19 cells treated for 24 hrs with 80 nM of the indicated ASOs over mock treated cells. Data is normalized to RPL32 expression.

Figure 141C:
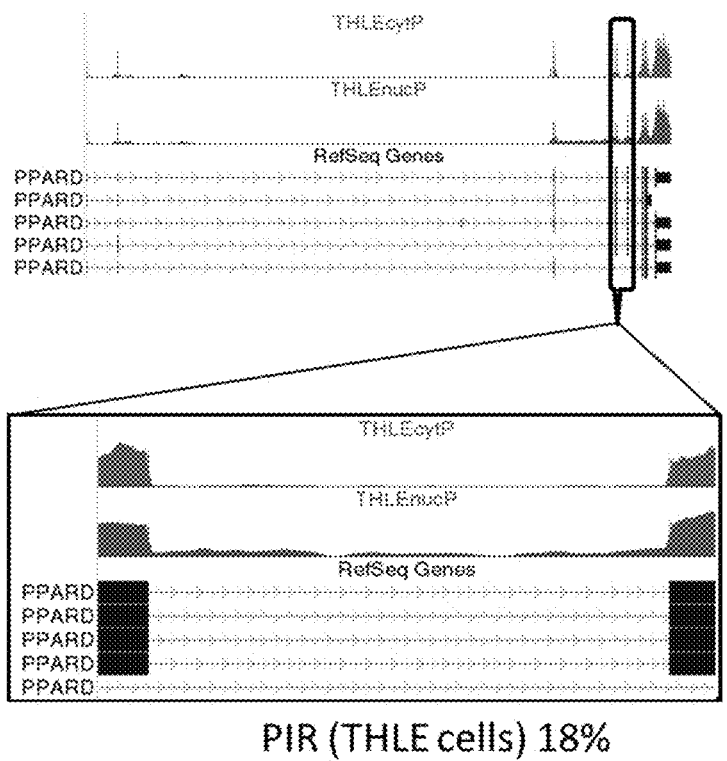

FIG. 141C depicts a schematic of the RefSeq Genes for PPARD corresponding to PPARD: NM_006238, NM_177435, NM_001171818, NM_001171819 and NM_001171820. The Percent Intron Retention (PIR) of the circled intron is shown (PPARD intron 4, NM_006238).

Figure 141D:
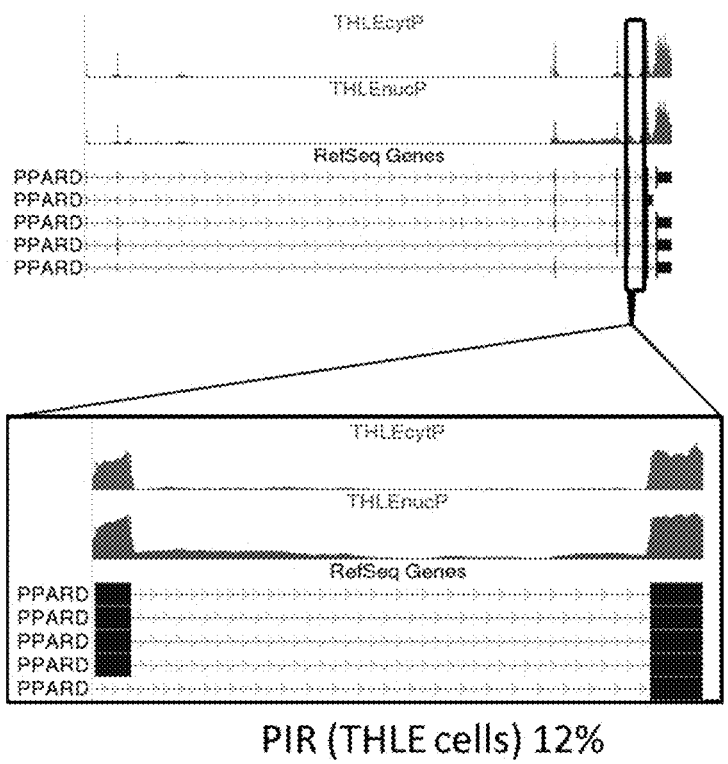

FIG. 141D depicts a schematic of the RefSeq Genes for PPARD corresponding to PPARD: NM_006238, NM_177435, NM_001171818, NM_001171819 and NM_001171820. The Percent Intron Retention (PIR) of the circled intron is shown (PPARD intron 5, NM_006238).

Figure 141E:
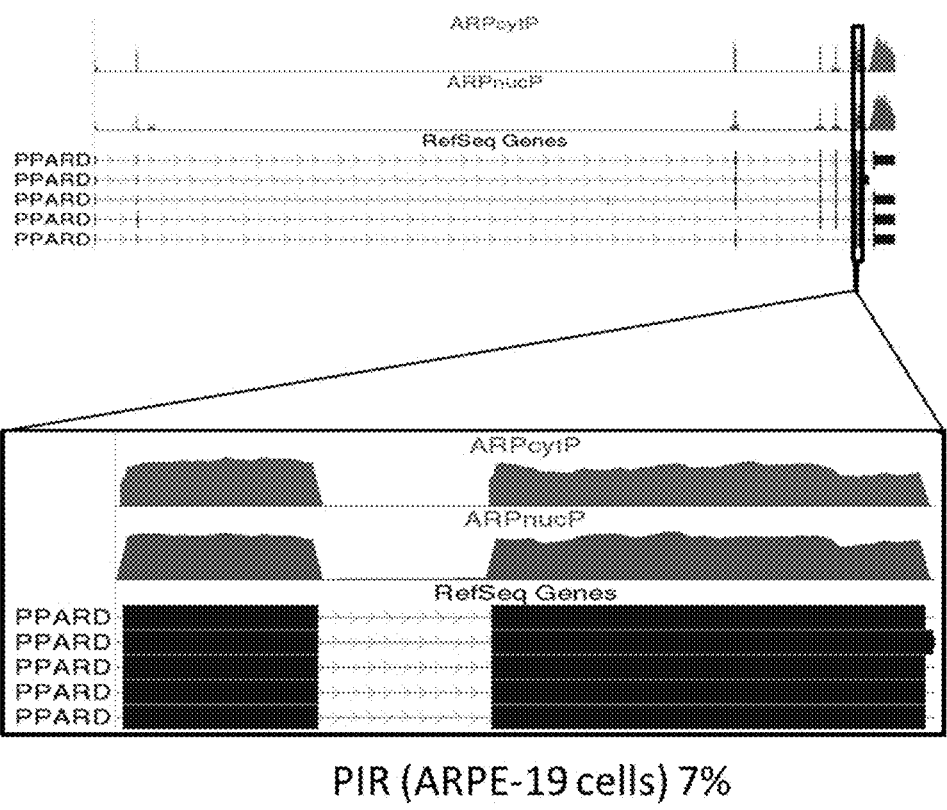

FIG. 141E depicts a schematic of the RefSeq Genes for PPARD corresponding to PPARD: NM_006238, NM_177435, NM_001171818, NM_001171819 and NM_001171820. The Percent Intron Retention (PIR) of the circled intron is shown (PPARD intron 6, NM_006238).

Figure 141F:
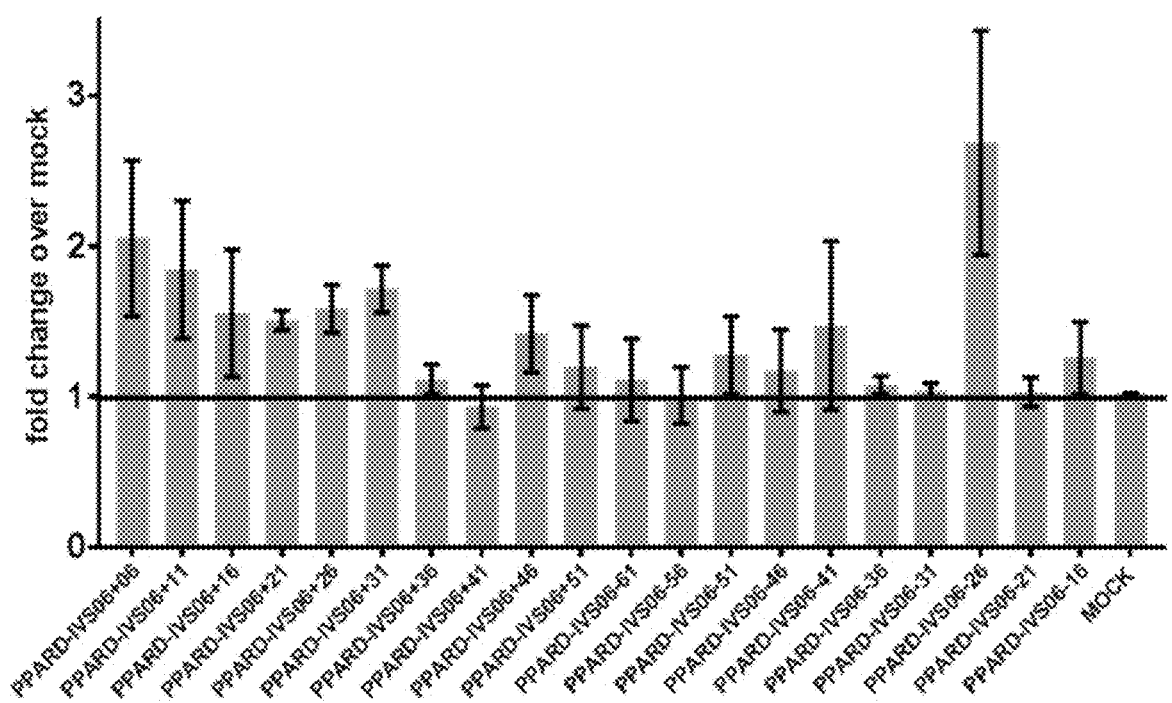

FIG. 141F depicts an exemplary graph showing the average (n=3) fold change in expression levels of PPARD mRNA without intron 6 in ARPE-19 cells treated for 24 hrs with 80 nM of the indicated ASOs over mock treated cells. Data is normalized to RPL32 expression.

Figure 141G:
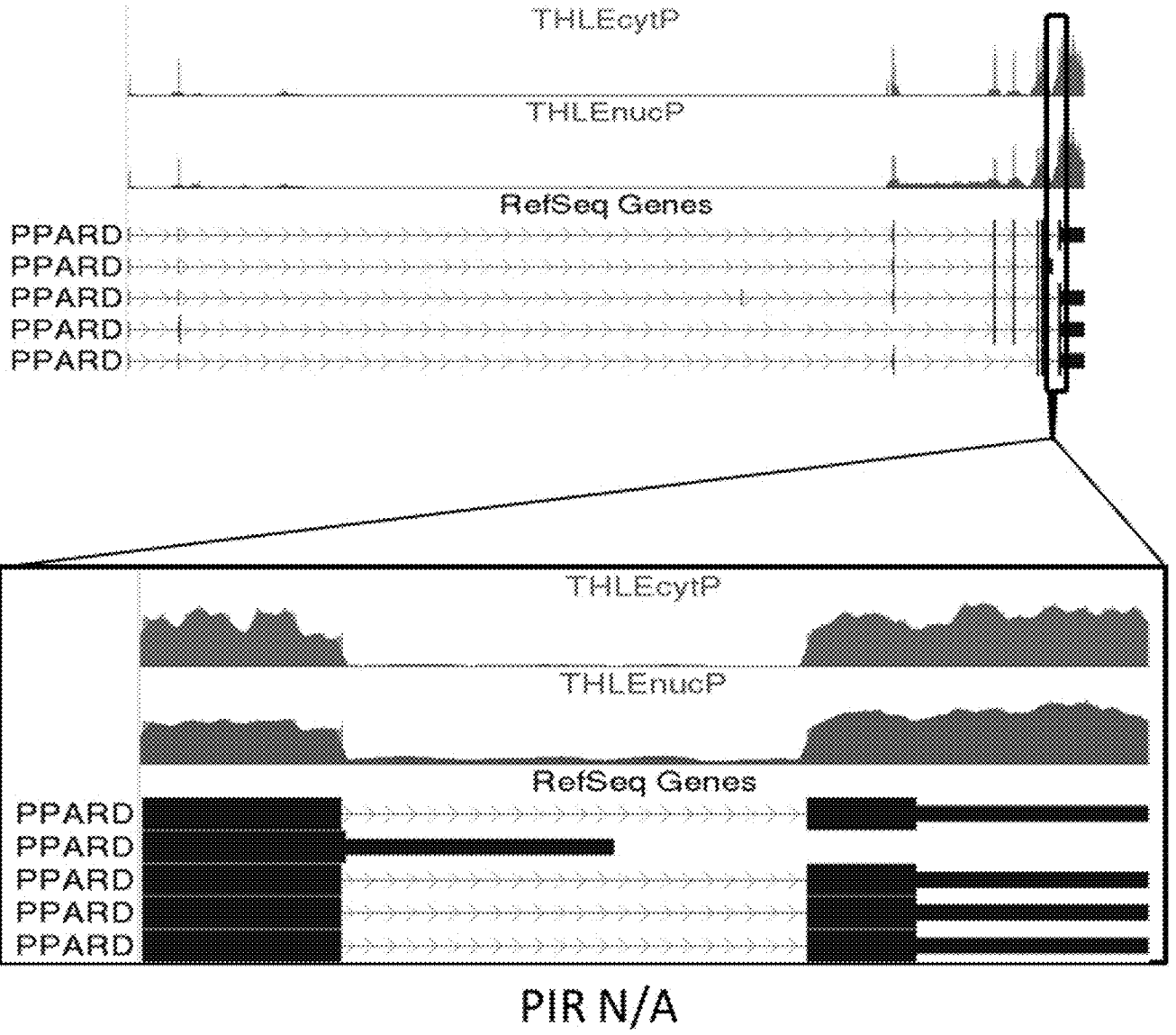

FIG. 141G depicts a schematic of the RefSeq Genes for PPARD corresponding to PPARD: NM_006238, NM_177435, NM_001171818, NM_001171819 and NM_001171820. The Percent Intron Retention (PIR) of the circled intron is shown (PPARD intron 7, NM_006238).

DETAILED DESCRIPTION OF THE INVENTION

Compositions and Methods for Treatment of Alagille Syndrome

Individual introns in primary transcripts of protein-coding genes having more than one intron are spliced from the primary transcript with different efficiencies. In most cases only the fully spliced mRNA is exported through nuclear pores for subsequent translation in the cytoplasm. Unspliced and partially spliced transcripts are detectable in the nucleus. It is generally thought that nuclear accumulation of transcripts that are not fully spliced is a mechanism to prevent the accumulation of potentially deleterious mRNAs in the cytoplasm that may be translated to protein. For some genes, splicing of the least efficient intron is a rate-limiting post-transcriptional step in gene expression, prior to translation in the cytoplasm.

Substantial levels of partially-spliced transcripts of the JAG1 gene, which encodes the JAG1 protein that is deficient in the debilitating genetic diseases, Alagille Syndrome, have been discovered in the nucleus of human cells. These JAG1 pre-mRNA species comprise at least one retained intron. The present invention provides compositions and methods for upregulating splicing of one or more retained JAG1 introns that are rate-limiting for the nuclear stages of gene expression to increase steady-state production of fully-spliced, mature mRNA, and thus, translated JAG1 protein levels. These compositions and methods utilize antisense oligomers (ASOs) that promote constitutive splicing at an intron splice site of a retained-intron-containing JAG1 pre-mRNA that accumulates in the nucleus. Thus, in embodiments, JAG1 protein is increased using the methods of the invention to treat a condition caused by JAG1 deficiency.

In other embodiments, the methods of the invention are used to increase JAG1 production to treat a condition in a subject in need thereof. In embodiments, the subject has a condition in which JAG1 is not necessarily deficient relative to wild-type, but where an increase in JAG1 mitigates the condition nonetheless. In embodiments, the subject has a muscular dystrophy. In embodiments, the subject has a dystrophin deficiency. For example, Vieira, et al., 2015, "Jagged 1 Rescues the Duchenne Muscular Dystrophy Phenotype," Cell 163:1204-1213, describe findings suggesting that increasing JAG1 expression in muscle can rescue dystrophin-deficient phenotypes in two different animal models for the disease.

Alagille Syndrome

Alagille syndrome (ALGS), also known as arteriohepatic dysplasia, is an autosomal dominant, multisystem disorder (Turnpenny and Ellard, 2012). The main clinical and pathological findings are liver disease due to paucity of intrahepatic bile ducts, heart disease, vascular anomalies, skeletal anomalies, ophthalmic features, facial features, renal anomalies, growth retardation, and pancreatic insufficiency. Clinical findings of ALGS are variable, with clinical diagnosis of "classic" ALGS based on the presence of 3 of 5 clinical features including anomalies of the liver, heart, vertebrae, eye, or face along with bile duct paucity (Lu et al., Am. J. Hum. Gen. 2003, 72, 1065-1070; Penton et al., Seminars Cell & Dev. Biol. 2012, 23, 450-457). The reported ALGS prevalence of 1:70,000 is thought to be an underestimate because of the variability and reduced penetrance of the condition.

Mutations of genes involved in Notch signaling have been reported to cause ALGS. JAG1 encodes JAG1 protein, a cell surface ligand for the Notch transmembrane receptors. The human genomic sequence of the JAG1 gene is set forth at NCBI Gene ID 182, described by, e.g., Jurkiewicz, D., et al., 2014, "Spectrum of JAG1 gene mutations in Polish patients with Alagille syndrome," J. Appl. Genetics 55:329-336, and the amino acid sequence at UniProtKB: P78504-1, Oda, T., et al., 1997, "Identification and cloning of the human homolog (JAG1) of the rat Jagged1 gene from the Alagille syndrome critical region at 20p12," Genomics 43 (3): 376-379, all incorporated by reference herein. The JAG1 canonical mRNA sequence is set forth at NCBI Reference Sequence: NM_000214.2, described by Duryagina R, et al., 2013, "Overexpression of Jagged-1 and its intracellular domain in human mesenchymal stromal cells differentially affect the interaction with hematopoietic stem and progenitor cells," Stem Cells Dev. 22 (20), 2736-2750, both incorporated by reference herein. Binding of JAG1 ligand to Notch triggers a signaling cascade that results in transcription of genes involved in cell fate determination and differentiation. Mutations in JAG1 cause ALGS type 1, the most prevalent disease type, while mutations in NOTCH2 cause ALGS type 2.

The JAG1 gene consists of 26 exons and is located on chromosome 20p11.2-20p12. JAG1 mutations in ALGS are spread across the entire protein, and there is a high de novo mutation rate of approximately 60%. 80% of mutations include frameshift, nonsense, and splice site mutations;

whole gene deletions account for 7% of mutations, and missense mutations represent 12% (Lu et al., 2003). Because whole gene deletion results in a phenotype similar to that seen for truncating and missense mutations, haploinsufficiency is the likely mechanism of disease causation in the majority of cases (Lu et al., 2003; Turnpenny and Ellard, 2012).

Mutations associated with the classic ALGS phenotype that includes liver disease displayed functional haploinsufficiency, resulting in cell surface concentrations of JAG1 that were 50% of wild-type levels (Lu et al., 2003). By contrast, a JAG1 missense mutation that results in expression of the JAG1-G274D protein has been reported to produce two protein populations, with one population exhibiting a glycosylation defect, thus preventing transport to the cell surface. The JAG1-G274D mutation was associated with a cardiac-specific phenotype in the absence of liver disease, with carriers of the mutation having more than 50% but less than 100% of the normal concentration of JAG1 on the cell surface. Thus, the developing liver may require less JAG1 than the developing heart (Lu et al., 2003).

Muscle Repair

As noted above, the potential for JAG1 to rescue dystrophin-deficient phenotypes in two animal models has been described (Vieira, et al., 2015). Deficiency of muscle dystrophin in muscular dystrophies, including Duchenne Muscular Dystrophy (DMD) and Becker Muscular Dystrophy (BMD), causes progressive muscle degeneration and wasting. In DMD, death eventually results due to respiratory or cardiac failure. Although JAG1 is not deficient in these conditions, increased levels of JAG1 may stimulate muscle cell proliferation and repair. In embodiments, the methods and compositions of the present invention are used to increase JAG1 production to stimulate muscle repair in a subject in need thereof. In embodiments, the subject has a muscular dystrophy. In embodiments, the muscular dystrophy is DMD, BMD, or limb girdle, congenital, facioscapulohumeral, myotonic, oculopharyngeal, distal, or Emery-Dreifuss muscular dystrophy. In embodiments, the subject has a dystrophin deficiency. In embodiments, the dystrophin deficiency is DMD or BMD. In embodiments, the subject has a muscular dystrophy caused by a deficiency in dysferlin (encoded by the DYSF gene), emerin (encoded by the EMD gene), DUX4, myotonin-protein kinase (MT-PK) also known as myotonic dystrophy protein kinase (MDPK) or dystrophia myotonica protein kinase (DMK) (encoded by the DMPK gene), Cellular nucleic acid-binding protein (encoded by the CNBP gene), or polyadenylate-binding protein 2 (PABP-2) also known as polyadenylate-binding nuclear protein 1 (PABPN1) (encoded by the PABPN1 gene).

Retained Intron Containing Pre-mRNA (RIC Pre-mRNA)

In embodiments, the methods of the present invention exploit the presence of retained-intron-containing pre-mRNA (RIC pre-mRNA) transcribed from the JAG1 gene and encoding JAG1 protein, in the cell nucleus. Splicing of the identified JAG1 RIC pre-mRNA species to produce mature, fully-spliced, JAG1 mRNA, is induced using ASOs that stimulate splicing out of the retained introns. The resulting mature JAG1 mRNA can be exported to the cytoplasm and translated, thereby increasing the amount of JAG1 protein in the patient's cells and alleviating symptoms of Alagille syndrome. This method, described further below, is known as Targeted Augmentation of Nuclear Gene Output (TANGO).

JAG1 Nuclear Transcripts

As described herein in the Examples, the JAG1 gene was analyzed for intron-retention events and retention of introns 13, 18, and 23 was observed. RNA sequencing (RNAseq), visualized in the UCSC genome browser, showed JAG1 transcripts expressed in THLE-3 (human liver epithelial) cells and localized in either the cytoplasmic or nuclear fraction. In both fractions, reads were not observed for the majority of the introns. However, higher read density was detected for introns 13, 18, and 23 in the nuclear fraction compared to the cytoplasmic fraction indicating that splicing efficiency of introns 13, 18, and 23 is low, resulting in intron retention. The retained-intron containing pre-mRNA transcripts accumulate primarily in the nucleus and are not translated into the JAG1 protein. The read density for introns 13, 18, and 23, indicated 12%, 14%, and 17% intron retention, respectively.

Table 1 provides a non-limiting list of target sequences of a JAG1 RIC pre-mRNA transcript by sequence ID, and ASOs by sequence ID, useful for increasing production of JAG1 protein by targeting a region of a JAG1 RIC pre-mRNA. In embodiments, other ASOs useful for this purpose are identified, using, e.g., methods described herein.

TABLE 1

List of targets and ASOs targeting the JAG1 gene

| Gene SEQ ID NO: | Pre-mRNA SEQ ID NO: | ASOs | Retained Intron | Target Sequence SEQ ID NO: |
| --- | --- | --- | --- | --- |
| JAG1 SEQ ID NO: 1 | JAG1:NM_000214 SEQ ID NO: 2 | SEQ ID NOs: 3-111 | 18 | 439 |
| | | SEQ ID NOs: 112-331 | 13 | 438 |
| | | SEQ ID NOs: 332-436 | 23 | 437 |

In some embodiments, the ASOs disclosed herein target a RIC pre-mRNA transcribed from a JAG1 genomic sequence. In some embodiments, the ASO targets a RIC pre-mRNA transcript from a JAG1 genomic sequence comprising a retained intron. In some embodiments, the ASO targets a RIC pre-mRNA transcript of SEQ ID NO: 1. In some embodiments, the ASO targets a RIC pre-mRNA transcript of SEQ ID NO: 1 comprising a retained intron. In some embodiments, the ASOs disclosed herein target a JAG1 RIC pre-mRNA sequence. In some embodiments, the ASO targets a JAG1 RIC pre-mRNA transcript comprising a retained intron at 13, 18, 23 or a combination thereof, wherein the intron numbering correspond to the mRNA sequence at NM_000214.

In some embodiments, the ASO targets a JAG1 RIC pre-mRNA sequence according to SEQ ID NO: 2. In some embodiments, the ASO targets a JAG1 RIC pre-mRNA sequence according to SEQ ID NO: 2 comprising a retained intron 13, a retained intron 18, a retained intron 23, or a combination thereof. In some embodiments, the ASOs disclosed herein target SEQ ID NOs: 437-439. In some embodiments, the ASO has a sequence according to any one of SEQ ID NOs: 3-436.

In some embodiments, the ASO targets exon 18 or exon 19 of a JAG1 RIC pre-mRNA comprising a retained intron 18, wherein the intron numbering correspond to the mRNA sequence at NM_000214. In some embodiments, the ASO targets an exon 18 sequence upstream (or 5') from the 5' splice site of a JAG1 RIC pre-mRNA comprising the retained intron 18. In some embodiments, the ASO targets an exon 18 sequence about 4 to about 99 nucleotides upstream (or 5') from the 5' splice site of a JAG1 RIC pre-mRNA comprising the retained intron 18. In some embodiments, the ASO targets an exon 19 sequence downstream (or 3') from the 3' splice site of a JAG1 RIC pre-mRNA comprising the retained intron 18. In some embodiments, the ASO targets an exon 19 sequence about 2 to about 7 nucleotides downstream (or 3') from the 3' splice site of a JAG1 RIC pre-mRNA comprising the retained intron 18.

In some embodiments, the ASO targets intron 18 in a JAG1 RIC pre-mRNA comprising a retained intron 18, wherein the intron numbering correspond to the mRNA sequence at NM_000214. In some embodiments, the ASO targets an intron 18 sequence downstream (or 3') from the 5' splice site of a JAG1 RIC pre-mRNA comprising the retained intron 18. In some embodiments, the ASO targets an intron 18 sequence about 16 to about 239 nucleotides downstream (or 3') from the 5' splice site of a JAG1 RIC pre-mRNA comprising the retained intron 18. In some embodiments, the ASO targets an intron 18 sequence upstream (or 5') from the 3' splice site of a JAG1 RIC pre-mRNA comprising the retained intron 18. In some embodiments, the ASO targets an intron 18 sequence about 16 to about 253 nucleotides upstream (or 5') from the 3' splice site of a JAG1 RIC pre-mRNA comprising the retained intron 18.

In some embodiments, the ASO targets exon 13 or exon 14 of a JAG1 RIC pre-mRNA comprising a retained intron 13, wherein the intron numbering correspond to the mRNA sequence at NM_000214. In some embodiments, the ASO targets an exon 13 sequence upstream (or 5') from the 5' splice site of a JAG1 RIC pre-mRNA comprising the retained intron 13. In some embodiments, the ASO targets an exon 13 sequence about 14 to about 131 nucleotides upstream (or 5') from the 5' splice site of a JAG/RIC pre-mRNA comprising the retained intron 13. In some embodiments, the ASO targets an exon 14 sequence downstream (or 3') from the 3' splice site of a JAG1 RIC pre-mRNA comprising the retained intron 13. In some embodiments, the ASO targets an exon 14 sequence about 2 to about 147 nucleotides downstream (or 3') from the 3' splice site of a JAG1 RIC pre-mRNA comprising the retained intron 13.

In some embodiments, the ASO targets intron 13 in a JAG1 RIC pre-mRNA comprising a retained intron 13, wherein the intron numbering correspond to the mRNA sequence at NM_000214. In some embodiments, the ASO targets an intron 13 sequence downstream (or 3') from the 5' splice site of a JAG1 RIC pre-mRNA comprising the retained intron 13. In some embodiments, the ASO targets an intron 13 sequence about 16 to about 440 nucleotides downstream (or 3') from the 5' splice site of a JAG1 RIC pre-mRNA comprising the retained intron 13. In some embodiments, the ASO targets an intron 13 sequence upstream (or 5') from the 3' splice site of a JAG1 RIC pre-mRNA comprising the retained intron 13. In some embodiments, the ASO targets an intron 13 sequence about 16 to about 441 nucleotides upstream (or 5') from the 3' splice site of a JAG1 RIC pre-mRNA comprising the retained intron 13.

In some embodiments, the ASO targets exon 23 or exon 24 of a JAG1 RIC pre-mRNA comprising a retained intron 23, wherein the intron numbering correspond to the mRNA sequence at NM_000214. In some embodiments, the ASO targets an exon 23 sequence upstream (or 5') from the 5' splice site of a JAG/RIC pre-mRNA comprising the retained intron 23. In some embodiments, the ASO targets an exon 23 sequence about 4 to about 216 nucleotides upstream (or 5') from the 5' splice site of a JAG1 RIC pre-mRNA comprising the retained intron 23. In some embodiments, the ASO targets an exon 24 sequence downstream (or 3') from the 3' splice site of a JAG1 RIC pre-mRNA comprising the retained intron 23. In some embodiments, the ASO targets an exon 24 sequence about 2 to about 114 nucleotides downstream (or 3') from the 3' splice site of a JAG1 RIC pre-mRNA comprising the retained intron 23.

In some embodiments, the ASO targets intron 23 in a JAG1 RIC pre-mRNA comprising a retained intron 23, wherein the intron numbering correspond to the mRNA sequence at NM_000214. In some embodiments, the ASO targets an intron 23 sequence downstream (or 3') from the 5' splice site of a JAG1 RIC pre-mRNA comprising the retained intron 23. In some embodiments, the ASO targets an intron 23 sequence about 6 to about 121 nucleotides downstream (or 3') from the 5' splice site of a JAG1 RIC pre-mRNA comprising the retained intron 23. In some embodiments, the ASO targets an intron 23 sequence upstream (or 5') from the 3' splice site of a JAG1 RIC pre-mRNA comprising the retained intron 23. In some embodiments, the ASO targets an intron 23 sequence about 16 to about 121 nucleotides upstream (or 5') from the 3' splice site of a JAG/RIC pre-mRNA comprising the retained intron 23.

It is understood that the intron numbering may change in reference to a different JAG1 isoform sequence. One of skill in the art can determine the corresponding intron number in any JAG1 isoform based on an intron sequence provided herein or using the intron number provided in reference to the mRNA sequence at NM_000214.2. One of skill in the art also can determine the sequences of flanking exons in any JAG1 isoform for targeting using the methods of the invention, based on an intron sequence provided herein or using the intron number provided in reference to the mRNA sequence at NM_000214.2. In embodiments, the compositions and methods of the present invention are used to increase the expression of any known JAG1 isoform.

JAG1 Protein Expression

As described above, JAG1 mutations in ALGS are spread across the entire protein, and there is a high de novo mutation rate of approximately 60%. Of the mutations characterized, 80% include frameshift, nonsense, and splice site mutations; whole gene deletions account for 7% of mutations, and missense mutations represent 12% (Lu et al., 2003).

In embodiments, the methods described herein are used to increase the production of a functional JAG1 protein. As used herein, the term "functional" refers to the amount of activity or function of a JAG1 protein that is necessary to eliminate any one or more symptoms of a treated condition, e.g., Alagille syndrome or a muscular dystrophy. In embodiments, the methods are used to increase the production of a partially functional JAG1 protein. As used herein, the term "partially functional" refers to any amount of activity or function of the JAG1 protein that is less than the amount of activity or function that is necessary to eliminate or prevent any one or more symptoms of a disease or condition. In some embodiments, a partially functional protein or RNA will have at least 10%, at least 20%, at least 30%, at least 40%, at least 50%, at least 60%, at least 70%, at least 75%, at least 80%, 85%, at least 90%, or at least 95% less activity relative to the fully functional protein or RNA.

In embodiments, the method is a method of increasing the expression of the JAG1 protein by cells of a subject having a RIC pre-mRNA encoding the JAG1 protein, wherein the subject has Alagille syndrome caused by a deficient amount of activity of JAG1 protein, and wherein the deficient amount of the JAG1 protein is caused by haploinsufficiency of the JAG1 protein. In such an embodiment, the subject has a first allele encoding a functional JAG1 protein, and a second allele from which the JAG1 protein is not produced. In another such embodiment, the subject has a first allele encoding a functional JAG1 protein, and a second allele encoding a nonfunctional JAG1 protein. In another such embodiment, the subject has a first allele encoding a functional JAG1 protein, and a second allele encoding a partially functional JAG1 protein. In any of these embodiments, the antisense oligomer binds to a targeted portion of the RIC pre-mRNA transcribed from the first allele (encoding functional JAG1 protein), thereby inducing constitutive splicing of the retained intron from the RIC pre-mRNA, and causing an increase in the level of mature mRNA encoding functional JAG1 protein, and an increase in the expression of the JAG1 protein in the cells of the subject.

In embodiments, the subject has a first allele encoding a functional JAG1 protein, and a second allele encoding a partially functional JAG1 protein, and the antisense oligomer binds to a targeted portion of the RIC pre-mRNA transcribed from the first allele (encoding functional JAG1 protein) or a targeted portion of the RIC pre-mRNA transcribed from the second allele (encoding partially functional JAG1 protein), thereby inducing constitutive splicing of the retained intron from the RIC pre-mRNA, and causing an increase in the level of mature mRNA encoding the JAG1 protein, and an increase in the expression of functional or partially functional JAG1 protein in the cells of the subject.

In related embodiments, the method is a method of using an ASO to increase the expression of a protein or functional RNA. In embodiments, an ASO is used to increase the expression of JAG1 protein in cells of a subject having a RIC pre-mRNA encoding JAG1 protein, wherein the subject has a deficiency, e.g., Alagille syndrome, in the amount or function of a JAG1 protein.

In embodiments, the RIC pre-mRNA transcript that encodes the protein that is causative of the disease or condition is targeted by the ASOs described herein. In some embodiments, a RIC pre-mRNA transcript that encodes a protein that is not causative of the disease is targeted by the ASOs. For example, a disease that is the result of a mutation or deficiency of a first protein in a particular pathway may be ameliorated by targeting a RIC pre-mRNA that encodes a second protein, thereby increasing production of the second protein. In some embodiments, the function of the second protein is able to compensate for the mutation or deficiency of the first protein (which is causative of the disease or condition). In embodiments, the first protein is a protein deficient in a muscular dystrophy and the second protein is JAG1. In embodiments, the first protein is a dystrophin and the second protein is JAG1.

In embodiments, the subject has:
a. a first mutant allele from which
  i) the JAG1 protein is produced at a reduced level compared to production from a wild-type allele,
  ii) the JAG1 protein is produced in a form having reduced function compared to an equivalent wild-type protein, or
  iii) the JAG1 protein or functional RNA is not produced; and
b. a second mutant allele from which
  i) the JAG1 protein is produced at a reduced level compared to production from a wild-type allele,
  ii) the JAG1 protein is produced in a form having reduced function compared to an equivalent wild-type protein, or
  iii) the JAG1 protein is not produced, and
wherein the RIC pre-mRNA is transcribed from the first allele and/or the second allele. In these embodiments, the ASO binds to a targeted portion of the RIC pre-mRNA transcribed from the first allele or the second allele, thereby inducing constitutive splicing of the retained intron from the RIC pre-mRNA, and causing an increase in the level of mRNA encoding JAG1 protein and an increase in the expression of the target protein or functional RNA in the cells of the subject. In these embodiments, the target protein or functional RNA having an increase in expression level resulting from the constitutive splicing of the retained intron from the RIC pre-mRNA is either in a form having reduced function compared to the equivalent wild-type protein (partially-functional), or having full function compared to the equivalent wild-type protein (fully-functional).

In embodiments, the level of mRNA encoding JAG1 protein is increased 1.1 to 10-fold, when compared to the amount of mRNA encoding JAG1 that is produced in a control cell, e.g., one that is not treated with the antisense oligomer or one that is treated with an antisense oligomer that does not bind to the targeted portion of the JAG1 RIC pre-mRNA.

In embodiments, the condition caused by a deficient amount or activity of JAG1 protein is not a condition caused by alternative or aberrant splicing of the retained intron to which the ASO is targeted. In embodiments, the condition caused by a deficient amount or activity of the JAG1 protein is not a condition caused by alternative or aberrant splicing of any retained intron in a RIC pre-mRNA encoding the JAG1 protein. In embodiments, alternative or aberrant splicing may occur in a pre-mRNA transcribed from the gene, however the compositions and methods of the invention do not prevent or correct this alternative or aberrant splicing.

In embodiments, a subject treated using the methods of the invention expresses a partially functional JAG1 protein from one allele, wherein the partially functional JAG1 protein is caused by a frameshift mutation, a nonsense mutation, a missense mutation, or a partial gene deletion. In embodiments, a subject treated using the methods of the invention expresses a nonfunctional JAG1 protein from one allele, wherein the nonfunctional JAG1 protein is caused by a frameshift mutation, a nonsense mutation, a missense mutation, a partial gene deletion, in one allele. In embodiments, a subject treated using the methods of the invention has a JAG1 whole gene deletion, in one allele.

In embodiments, the subject has a JAG1 missense mutation selected from G274D, L37S, R184H, P163L, P871R, C234Y, C664S, P810L, or R937Q. In embodiments, the subject has JAG1 deletion mutation 1485-1486delCT. In embodiments, the subject has JAG1 duplication mutation 414-415dupGT. In embodiments, a subject having any JAG1 mutation known in the art and described in the literature, e.g., by Lu, et al., 2003, Penton, et al., 2012, referenced above, is treated using the methods and compositions of the present invention.

Use of TANGO for Increasing JAG1 Protein Expression

As described above, in embodiments, Targeted Augmentation of Nuclear Gene Output (TANGO) is used in the methods of the invention to increase expression of a JAG1 protein. In these embodiments, a retained-intron-containing pre-mRNA (RIC pre-mRNA) encoding JAG 1 protein is present in the nucleus of a cell. Cells having a JAG1 RIC pre-mRNA that comprises a retained intron, an exon flanking the 5' splice site, and an exon flanking the 3' splice site, encoding the JAG1 protein, are contacted with antisense oligomers (ASOs) that are complementary to a targeted portion of the RIC pre-mRNA. Hybridization of the ASOs to the targeted portion of the RIC pre-mRNA results in enhanced splicing at the splice site (5' splice site or 3' splice site) of the retained intron and subsequently increases target protein production.

The terms "pre-mRNA," and "pre-mRNA transcript" may be used interchangeably and refer to any pre-mRNA species that contains at least one intron. In embodiments, pre-mRNA or pre-mRNA transcripts comprise a 5'-7-methylguanosine cap and/or a poly-A tail. In embodiments, pre-mRNA or pre-mRNA transcripts comprise both a 5'-7-methylguanosine cap and a poly-A tail. In some embodiments, the pre-mRNA transcript does not comprise a 5'-7-methylguanosine cap and/or a poly-A tail. A pre-mRNA transcript is a non-productive messenger RNA (mRNA) molecule if it is not translated into a protein (or transported into the cytoplasm from the nucleus).

As used herein, a "retained-intron-containing pre-mRNA" ("RIC pre-mRNA") is a pre-mRNA transcript that contains at least one retained intron. The RIC pre-mRNA contains a retained intron, an exon flanking the 5' splice site of the retained intron, an exon flanking the 3' splice site of the retained intron, and encodes the target protein. An "RIC pre-mRNA encoding a target protein" is understood to encode the target protein when fully spliced. A "retained intron" is any intron that is present in a pre-mRNA transcript when one or more other introns, such as an adjacent intron, encoded by the same gene have been spliced out of the same pre-mRNA transcript. In some embodiments, the retained intron is the most abundant intron in RIC pre-mRNA encoding the target protein. In embodiments, the retained intron is the most abundant intron in a population of RIC pre-mRNAs transcribed from the gene encoding the target protein in a cell, wherein the population of RIC pre-mRNAs comprises two or more retained introns. In embodiments, an antisense oligomer targeted to the most abundant intron in the population of RIC pre-mRNAs encoding the target protein induces splicing out of two or more retained introns in the population, including the retained intron to which the antisense oligomer is targeted or binds. In embodiments, a mature mRNA encoding the target protein is thereby produced. The terms "mature mRNA," and "fully-spliced mRNA," are used interchangeably herein to describe a fully processed mRNA encoding a target protein (e.g., mRNA that is exported from the nucleus into the cytoplasm and translated into target protein) or a fully processed functional RNA. The term "productive mRNA," also can be used to describe a fully processed mRNA encoding a target protein. In embodiments, the targeted region is in a retained intron that is the most abundant intron in a population of RIC pre-mRNA encoding the JAG1 protein. In embodiments, the most retained intron in a population of RIC pre-mRNA encoding the JAG1 protein is intron 23.

In embodiments, a retained intron is an intron that is identified as a retained intron based on a determination of at least about 5%, at least about 10%, at least about 15%, at least about 20%, at least about 25%, at least about 30%, at least about 35%, at least about 40%, at least about 45%, or at least about 50%, retention. In embodiments, a retained intron is an intron that is identified as a retained intron based on a determination of about 5% to about 100%, about 5% to about 95%, about 5% to about 90%, about 5% to about 85%, about 5% to about 80%, about 5% to about 75%, about 5% to about 70%, about 5% to about 65%, about 5% to about 60%, about 5% to about 65%, about 5% to about 60%, about 5% to about 55%, about 5% to about 50%, about 5% to about 45%, about 5% to about 40%, about 5% to about 35%, about 5% to about 30%, about 5% to about 25%, about 5% to about 20%, about 5% to about 15%, about 10% to about 100%, about 10% to about 95%, about 10% to about 90%, about 10% to about 85%, about 10% to about 80%, about 10% to about 75%, about 10% to about 70%, about 10% to about 65%, about 10% to about 60%, about 10% to about 65%, about 10% to about 60%, about 10% to about 55%, about 10% to about 50%, about 10% to about 45%, about 10% to about 40%, about 10% to about 35%, about 10% to about 30%, about 10% to about 25%, about 10% to about 20%, about 15% to about 100%, about 15% to about 95%, about 15% to about 90%, about 15% to about 85%, about 15% to about 80%, about 15% to about 75%, about 15% to about 70%, about 15% to about 65%, about 15% to about 60%, about 15% to about 65%, about 15% to about 60%, about 15% to about 55%, about 15% to about 50%, about 15% to about 45%, about 15% to about 40%, about 15% to about 35%, about 15% to about 30%, about 15% to about 25%, about 20% to about 100%, about 20% to about 95%, about 20% to about 90%, about 20% to about 85%, about 20% to about 80%, about 20% to about 75%, about 20% to about 70%, about 20% to about 65%, about 20% to about 60%, about 20% to about 65%, about 20% to about 60%, about 20% to about 55%, about 20% to about 50%, about 20% to about 45%, about 20% to about 40%, about 20% to about 35%, about 20% to about 30%, about 25% to about 100%, about 25% to about 95%, about 25% to about 90%, about 25% to about 85%, about 25% to about 80%, about 25% to about 75%, about 25% to about 70%, about 25% to about 65%, about 25% to about 60%, about 25% to about 65%, about 25% to about 60%, about 25% to about 55%, about 25% to about 50%, about 25% to about 45%, about 25% to about 40%, or about 25% to about 35%, retention. ENCODE data (described by, e.g., Tilgner, et al., 2012, "Deep sequencing of subcellular RNA fractions shows splicing to be predominantly co-transcriptional in the human genome but inefficient for lncRNAs," Genome Research 22(9):1616-25) can be used to aid in identifying retained introns.

As used herein, the term "comprise" or variations thereof such as "comprises" or "comprising" are to be read to indicate the inclusion of any recited feature (e.g. in the case of an antisense oligomer, a defined nucleobase sequence) but not the exclusion of any other features. Thus, as used herein, the term "comprising" is inclusive and does not exclude additional, unrecited features (e.g. in the case of an antisense oligomer, the presence of additional, unrecited nucleobases).

In embodiments of any of the compositions and methods provided herein, "comprising" may be replaced with "consisting essentially of" or "consisting of" The phrase "consisting essentially of" is used herein to require the specified feature(s) (e.g. nucleobase sequence) as well as those which do not materially affect the character or function of the claimed invention. As used herein, the term "consisting" is used to indicate the presence of the recited feature (e.g. nucleobase sequence) alone (so that in the case of an antisense oligomer consisting of a specified nucleobase sequence, the presence of additional, unrecited nucleobases is excluded).

In embodiments, the targeted region is in a retained intron that is the second most abundant intron in a population of RIC pre-mRNA encoding the JAG1 protein. For example, the second most abundant retained intron may be targeted rather than the most abundant retained intron due to the uniqueness of the nucleotide sequence of the second most abundant retained intron, ease of ASO design to target a particular nucleotide sequence, and/or amount of increase in protein production resulting from targeting the intron with an ASO. In embodiments, the retained intron is the second most abundant intron in a population of RIC pre-mRNAs transcribed from the gene encoding the target protein in a cell, wherein the population of RIC pre-mRNAs comprises two or more retained introns. In embodiments, an antisense oligomer targeted to the second most abundant intron in the population of RIC pre-mRNAs encoding the target protein induces splicing out of two or more retained introns in the population, including the retained intron to which the antisense oligomer is targeted or binds. In embodiments, fully-spliced (mature) RNA encoding the target protein is thereby produced. In embodiments, the second-most retained intron in a population of RIC pre-mRNA encoding the JAG1 protein is intron 18. In embodiments, the second-most retained intron in a population of RIC pre-mRNA encoding the JAG1 protein is intron 13.

In embodiments, an ASO is complementary to a targeted region that is within a non-retained intron in a RIC pre-mRNA. In embodiments, the targeted portion of the RIC pre-mRNA is within: the region +6 to +100 relative to the 5' splice site of the non-retained intron; or the region −16 to −100 relative to the 3' splice site of the non-retained intron. In embodiments, the targeted portion of the RIC pre-mRNA is within the region +100 relative to the 5' splice site of the non-retained intron to −100 relative to the 3' splice site of the non-retained intron. As used to identify the location of a region or sequence, "within" is understood to include the residues at the positions recited. For example, a region +6 to +100 includes the residues at positions +6 and +100. In embodiments, fully-spliced (mature) RNA encoding the target protein is thereby produced.

In embodiments, the retained intron of the RIC pre-mRNA is an inefficiently spliced intron. As used herein, "inefficiently spliced" may refer to a relatively low frequency of splicing at a splice site adjacent to the retained intron (5' splice site or 3' splice site) as compared to the frequency of splicing at another splice site in the RIC pre-mRNA. The term "inefficiently spliced" may also refer to the relative rate or kinetics of splicing at a splice site, in which an "inefficiently spliced" intron may be spliced or removed at a slower rate as compared to another intron in a RIC pre-mRNA.

In embodiments, the 9-nucleotide sequence at −3e to −1e of the exon flanking the 5' splice site and +1 to +6 of the retained intron is identical to the corresponding wild-type sequence. In embodiments, the 16 nucleotide sequence at −15 to −1 of the retained intron and +1e of the exon flanking the 3' splice site is identical to the corresponding wild-type sequence. As used herein, the "wild-type sequence" refers to the nucleotide sequence for the JAG1 gene in the published reference genome deposited in the NCBI repository of biological and scientific information (operated by National Center for Biotechnology Information, National Library of Medicine, 8600 Rockville Pike, Bethesda, Md. USA 20894). As used herein, the "wild-type sequence" refers to the canonical sequence available at NCBI Gene ID 182. Also used herein, a nucleotide position denoted with an "e" indicates the nucleotide is present in the sequence of an exon (e.g., the exon flanking the 5' splice site or the exon flanking the 3' splice site).

The methods involve contacting cells with an ASO that is complementary to a portion of a pre-mRNA encoding JAG1 protein, resulting in increased expression of JAG1. As used herein, "contacting" or administering to cells refers to any method of providing an ASO in immediate proximity with the cells such that the ASO and the cells interact. A cell that is contacted with an ASO will take up or transport the ASO into the cell. The method involves contacting a condition or disease-associated or condition or disease-relevant cell with any of the ASOs described herein. In some embodiments, the ASO may be further modified or attached (e.g., covalently attached) to another molecule to target the ASO to a cell type, enhance contact between the ASO and the condition or disease-associated or condition or disease-relevant cell, or enhance uptake of the ASO.

As used herein, the term "increasing protein production" or "increasing expression of a target protein" means enhancing the amount of protein that is translated from an mRNA in a cell. A "target protein" may be any protein for which increased expression/production is desired.

In embodiments, contacting a cell that expresses a JAG1 RIC pre-mRNA with an ASO that is complementary to a targeted portion of the JAG1 RIC pre-mRNA transcript results in a measurable increase in the amount of the JAG1 protein (e.g., a target protein) encoded by the pre-mRNA. Methods of measuring or detecting production of a protein will be evident to one of skill in the art and include any known method, for example, Western blotting, flow cytometry, immunofluorescence microscopy, and ELISA.

In embodiments, contacting cells with an ASO that is complementary to a targeted portion of a JAG1 RIC pre-mRNA transcript results in an increase in the amount of JAG1 protein produced by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of JAG1 protein produced by the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the amount of target protein produced by an control compound. A control compound can be, for example, an oligonucleotide that is not complementary to the targeted portion of the RIC pre-mRNA.

In some embodiments, contacting cells with an ASO that is complementary to a targeted portion of a JAG1 RIC pre-mRNA transcript results in an increase in the amount of mRNA encoding JAG1, including the mature mRNA encoding the target protein. In some embodiments, the amount of mRNA encoding JAG1 protein, or the mature mRNA encoding the JAG1 protein, is increased by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of the mRNA encoding JAG1 protein, or the mature mRNA encoding JAG1 protein produced in the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold compared to the amount of mature RNA produced in an untreated cell, e.g., an untreated cell or a cell treated with a control compound. A control compound can be, for example, an oligonucleotide that is not complementary to the targeted portion of the JAG1 RIC pre-mRNA.

Constitutive Splicing of a Retained Intron from a RIC pre-mRNA

The methods and antisense oligonucleotide compositions provided herein are useful for increasing the expression of JAG1 protein in cells, for example, in a subject having Alagille syndrome caused by a deficiency in the amount or activity of JAG1 protein, by increasing the level of mRNA encoding JAG1 protein, or the mature mRNA encoding JAG1 protein. In particular, the methods and compositions as described herein induce the constitutive splicing of a retained intron from a JAG1 RIC pre-mRNA transcript encoding JAG1 protein, thereby increasing the level of mRNA encoding JAG1 protein, or the mature mRNA encoding JAG1 protein and increasing the expression of JAG1 protein.

Constitutive splicing of a retained intron from a RIC pre-mRNA correctly removes the retained intron from the RIC pre-mRNA, wherein the retained intron has wild-type splice sequences. Constitutive splicing, as used herein, does not encompass splicing of a retained intron from a RIC pre-mRNA transcribed from a gene or allele having a mutation that causes alternative splicing or aberrant splicing of a pre-mRNA transcribed from the gene or allele. For example, constitutive splicing of a retained intron, as induced using the methods and antisense oligonucleotides provided herein, does not correct aberrant splicing in or influence alternative splicing of a pre-mRNA to result in an increased expression of a target protein or functional RNA.

In embodiments, constitutive splicing correctly removes a retained intron from a JAG1 RIC pre-mRNA, wherein the JAG1 RIC pre-mRNA is transcribed from a wild-type gene or allele, or a polymorphic gene or allele, that encodes a fully-functional target protein or functional RNA, and wherein the gene or allele does not have a mutation that causes alternative splicing or aberrant splicing of the retained intron.

In some embodiments, constitutive splicing of a retained intron from a JAG1 RIC pre-mRNA encoding JAG1 protein correctly removes a retained intron from a JAG1 RIC pre-mRNA encoding JAG1 protein, wherein the JAG1 RIC pre-mRNA is transcribed from a gene or allele from which the target gene or functional RNA is produced at a reduced level compared to production from a wild-type allele, and wherein the gene or allele does not have a mutation that causes alternative splicing or aberrant splicing of the retained intron. In these embodiments, the correct removal of the constitutively spliced retained intron results in production of target protein or functional RNA that is functional when compared to an equivalent wild-type protein or functional RNA.

In other embodiments, constitutive splicing correctly removes a retained intron from a JAG1 RIC pre-mRNA, wherein the JAG1 RIC pre-mRNA is transcribed from a gene or allele that encodes a target protein or functional RNA produced in a form having reduced function compared to an equivalent wild-type protein or functional RNA, and wherein the gene or allele does not have a mutation that causes alternative splicing or aberrant splicing of the retained intron. In these embodiments, the correct removal of the constitutively spliced retained intron results in production of partially functional target protein, or functional RNA that is partially functional when compared to an equivalent wild-type protein or functional RNA.

"Correct removal" of the retained intron by constitutive splicing refers to removal of the entire intron, without removal of any part of an exon.

In embodiments, an antisense oligomer as described herein or used in any method described herein does not increase the amount of mRNA encoding JAG1 protein or the amount of JAG1 protein by modulating alternative splicing or aberrant splicing of a pre-mRNA transcribed from the JAG1 gene. Modulation of alternative splicing or aberrant splicing can be measured using any known method for analyzing the sequence and length of RNA species, e.g., by RT-PCR and using methods described elsewhere herein and in the literature. In embodiments, modulation of alternative or aberrant splicing is determined based on an increase or decrease in the amount of the spliced species of interest of at least 10% or 1.1-fold. In embodiments, modulation is determined based on an increase or decrease at a level that is at least 10% to 100% or 1.1 to 10-fold, as described herein regarding determining an increase in mRNA encoding JAG1 protein in the methods of the invention.

In embodiments, the method is a method wherein the JAG1 RIC pre-mRNA was produced by partial splicing of a wild-type JAG1 pre-mRNA. In embodiments, the method is a method wherein the JAG1 RIC pre-mRNA was produced by partial splicing of a full-length wild-type JAG1 pre-mRNA. In embodiments, the JAG1 RIC pre-mRNA was produced by partial splicing of a full-length JAG1 pre-mRNA. In these embodiments, a full-length JAG1 pre-mRNA may have a polymorphism in a splice site of the retained intron that does not impair correct splicing of the retained intron as compared to splicing of the retained intron having the wild-type splice site sequence.

In embodiments, the mRNA encoding JAG1 protein is a full-length mature mRNA, or a wild-type mature mRNA. In these embodiments, a full-length mature mRNA may have a polymorphism that does not affect the activity of the target protein or the functional RNA encoded by the mature mRNA, as compared to the activity of JAG1 protein encoded by the wild-type mature mRNA.

Antisense Oligomers

One aspect of the present disclosure is a composition comprising antisense oligomers that enhances splicing by binding to a targeted portion of a JAG1 RIC pre-mRNA. As used herein, the terms "ASO" and "antisense oligomer" are used interchangeably and refer to an oligomer such as a polynucleotide, comprising nucleobases that hybridizes to a target nucleic acid (e.g., a JAG1 RIC pre-mRNA) sequence by Watson-Crick base pairing or wobble base pairing (G-U). The ASO may have exact sequence complementary to the target sequence or near complementarity (e.g., sufficient complementarity to bind the target sequence and enhancing splicing at a splice site). ASOs are designed so that they bind (hybridize) to a target nucleic acid (e.g., a targeted portion of a pre-mRNA transcript) and remain hybridized under physiological conditions. Typically, if they hybridize to a site other than the intended (targeted) nucleic acid sequence, they hybridize to a limited number of sequences that are not a target nucleic acid (to a few sites other than a target nucleic acid). Design of an ASO can take into consideration the occurrence of the nucleic acid sequence of the targeted portion of the pre-mRNA transcript or a sufficiently similar nucleic acid sequence in other locations in the genome or cellular pre-mRNA or transcriptome, such that the likelihood the ASO will bind other sites and cause "off-target" effects is limited. Any antisense oligomers known in the art, for example in PCT Application No. PCT/US2014/054151, published as WO 2015/035091, titled "Reducing Nonsense-Mediated mRNA Decay," can be used to practice the methods described herein.

In some embodiments, ASOs "specifically hybridize" to or are "specific" to a target nucleic acid or a targeted portion of a RIC pre-mRNA. Typically such hybridization occurs with a Tm substantially greater than 37° C., preferably at least 50° C., and typically between 60° C. to approximately 90° C. Such hybridization preferably corresponds to stringent hybridization conditions. At a given ionic strength and pH, the Tm is the temperature at which 50% of a target sequence hybridizes to a complementary oligonucleotide.

Oligomers, such as oligonucleotides, are "complementary" to one another when hybridization occurs in an antiparallel configuration between two single-stranded polynucleotides. A double-stranded polynucleotide can be "complementary" to another polynucleotide, if hybridization can occur between one of the strands of the first polynucleotide and the second. Complementarity (the degree to which one polynucleotide is complementary with another) is quantifiable in terms of the proportion (e.g., the percentage) of bases in opposing strands that are expected to form hydrogen bonds with each other, according to generally accepted base-pairing rules. The sequence of an antisense oligomer (ASO) need not be 100% complementary to that of its target nucleic acid to hybridize. In certain embodiments, ASOs can comprise at least 70%, at least 75%, at least 80%, at least 85%, at least 90%, at least 95%, at least 96%, at least 97%, at least 98%, or at least 99% sequence complementarity to a target region within the target nucleic acid sequence to which they are targeted. For example, an ASO in which 18 of 20 nucleobases of the oligomeric compound are complementary to a target region, and would therefore specifically hybridize, would represent 90 percent complementarity. In this example, the remaining non-complementary nucleobases may be clustered together or interspersed with complementary nucleobases and need not be contiguous to each other or to complementary nucleobases. Percent complementarity of an ASO with a region of a target nucleic acid can be determined routinely using BLAST programs (basic local alignment search tools) and PowerBLAST programs known in the art (Altschul et al., J. Mol. Biol., 1990, 215, 403-410; Zhang and Madden, Genome Res., 1997, 7, 649-656).

An ASO need not hybridize to all nucleobases in a target sequence and the nucleobases to which it does hybridize may be contiguous or noncontiguous. ASOs may hybridize over one or more segments of a pre-mRNA transcript, such that intervening or adjacent segments are not involved in the hybridization event (e.g., a loop structure or hairpin structure may be formed). In certain embodiments, an ASO hybridizes to noncontiguous nucleobases in a target pre-mRNA transcript. For example, an ASO can hybridize to nucleobases in a pre-mRNA transcript that are separated by one or more nucleobase(s) to which the ASO does not hybridize.

The ASOs described herein comprise nucleobases that are complementary to nucleobases present in a target portion of a RIC pre-mRNA. The term ASO embodies oligonucleotides and any other oligomeric molecule that comprises nucleobases capable of hybridizing to a complementary nucleobase on a target mRNA but does not comprise a sugar moiety, such as a peptide nucleic acid (PNA). The ASOs may comprise naturally-occurring nucleotides, nucleotide analogs, modified nucleotides, or any combination of two or three of the preceding. The term "naturally occurring nucleotides" includes deoxyribonucleotides and ribonucleotides. The term "modified nucleotides" includes nucleotides with modified or substituted sugar groups and/or having a modified backbone. In some embodiments, all of the nucleotides of the ASO are modified nucleotides. Chemical modifications of ASOs or components of ASOs that are compatible with the methods and compositions described herein will be evident to one of skill in the art and can be found, for example, in U.S. Pat. No. 8,258,109 B2, U.S. Pat. No. 5,656,612, U.S. Patent Publication No. 2012/0190728, and Dias and Stein, Mol. Cancer Ther. 2002, 1, 347-355, herein incorporated by reference in their entirety.

The nucleobase of an ASO may be any naturally occurring, unmodified nucleobase such as adenine, guanine, cytosine, thymine and uracil, or any synthetic or modified nucleobase that is sufficiently similar to an unmodified nucleobase such that it is capable of hydrogen bonding with a nucleobase present on a target pre-mRNA. Examples of modified nucleobases include, without limitation, hypoxanthine, xanthine, 7-methylguanine, 5,6-dihydrouracil, 5-methylcytosine, and 5-hydroxymethoylcytosine.

The ASOs described herein also comprise a backbone structure that connects the components of an oligomer. The term "backbone structure" and "oligomer linkages" may be used interchangeably and refer to the connection between monomers of the ASO. In naturally occurring oligonucleotides, the backbone comprises a 3'-5' phosphodiester linkage connecting sugar moieties of the oligomer. The backbone structure or oligomer linkages of the ASOs described herein may include (but are not limited to) phosphorothioate, phosphorodithioate, phosphoroselenoate, phosphorodiselenoate, phosphoroanilothioate, phosphoraniladate, phosphoramidate, and the like. See e.g., LaPlanche et al., Nucleic Acids Res. 14:9081 (1986); Stec et al., J. Am. Chem. Soc. 106:6077 (1984), Stein et al., Nucleic Acids Res. 16:3209 (1988), Zon et al., Anti Cancer Drug Design 6:539 (1991); Zon et al., Oligonucleotides and Analogues: A Practical Approach, pp. 87-108 (F. Eckstein, Ed., Oxford University Press, Oxford England (1991)); Stec et al., U.S. Pat. No. 5,151,510; Uhlmann and Peyman, Chemical Reviews 90:543 (1990). In some embodiments, the backbone structure of the ASO does not contain phosphorous but rather contains peptide bonds, for example in a peptide nucleic acid (PNA), or linking groups including carbamate, amides, and linear and cyclic hydrocarbon groups. In some embodiments, the backbone modification is a phosphorothioate linkage. In some embodiments, the backbone modification is a phosphoramidate linkage.

In embodiments, the stereochemistry at each of the phosphorus internucleotide linkages of the ASO backbone is random. In embodiments, the stereochemistry at each of the phosphorus internucleotide linkages of the ASO backbone is controlled and is not random. For example, U.S. Pat. App. Pub. No. 2014/0194610, "Methods for the Synthesis of Functionalized Nucleic Acids," incorporated herein by reference, describes methods for independently selecting the handedness of chirality at each phosphorous atom in a nucleic acid oligomer. In embodiments, an ASO used in the methods of the invention, including, but not limited to, any of the ASOs set forth herein in Table 1, comprises an ASO having phosphorus internucleotide linkages that are not random. In embodiments, a composition used in the methods of the invention comprises a pure diastereomeric ASO. In embodiments, a composition used in the methods of the invention comprises an ASO that has diastereomeric purity of at least about 90%, at least about 91%, at least about 92%, at least about 93%, at least about 94%, at least about 95%, at least about 96%, at least about 97%, at least about 98%, at least about 99%, about 100%, about 90% to about 100%, about 91% to about 100%, about 92% to about 100%, about 93% to about 100%, about 94% to about 100%, about 95% to about 100%, about 96% to about 100%, about 97% to about 100%, about 98% to about 100%, or about 99% to about 100%.

In embodiments, the ASO has a nonrandom mixture of Rp and Sp configurations at its phosphorus internucleotide linkages. For example, it has been suggested that a mix of Rp and Sp is required in antisense oligonucleotides to achieve a balance between good activity and nuclease stability (Wan, et al., 2014, "Synthesis, biophysical properties and biological activity of second generation antisense oligonucleotides containing chiral phosphorothioate linkages," Nucleic Acids Research 42(22): 13456-13468, incorporated herein by reference). In embodiments, an ASO used in the methods of the invention, including, but not limited to, any of the ASOs set forth herein in Table 1, comprises about 5-100% Rp, at least about 5% Rp, at least about 10% Rp, at least about 15% Rp, at least about 20% Rp, at least about 25% Rp, at least about 30% Rp, at least about 35% Rp, at least about 40% Rp, at least about 45% Rp, at least about 50% Rp, at least about 55% Rp, at least about 60% Rp, at least about 65% Rp, at least about 70% Rp, at least about 75% Rp, at least about 80% Rp, at least about 85% Rp, at least about 90% Rp, or at least about 95% Rp, with the remainder Sp, or about 100% Rp. In embodiments, an ASO used in the methods of the invention, including, but not limited to, any of the ASOs set forth herein in Table 1, comprises about 10% to about 100% Rp, about 15% to about 100% Rp, about 20% to about 100% Rp, about 25% to about 100% Rp, about 30% to about 100% Rp, about 35% to about 100% Rp, about 40% to about 100% Rp, about 45% to about 100% Rp, about 50% to about 100% Rp, about 55% to about 100% Rp, about 60% to about 100% Rp, about 65% to about 100% Rp, about 70% to about 100% Rp, about 75% to about 100% Rp, about 80% to about 100% Rp, about 85% to about 100% Rp, about 90% to about 100% Rp, or about 95% to about 100% Rp, about 20% to about 80% Rp, about 25% to about 75% Rp, about 30% to about 70% Rp, about 40% to about 60% Rp, or about 45% to about 55% Rp, with the remainder Sp.

In embodiments, an ASO used in the methods of the invention, including, but not limited to, any of the ASOs set forth herein in Table 1, comprises about 5-100% Sp, at least about 5% Sp, at least about 10% Sp, at least about 15% Sp, at least about 20% Sp, at least about 25% Sp, at least about 30% Sp, at least about 35% Sp, at least about 40% Sp, at least about 45% Sp, at least about 50% Sp, at least about 55% Sp, at least about 60% Sp, at least about 65% Sp, at least about 70% Sp, at least about 75% Sp, at least about 80% Sp, at least about 85% Sp, at least about 90% Sp, or at least about 95% Sp, with the remainder Rp, or about 100% Sp. In embodiments, an ASO used in the methods of the invention, including, but not limited to, any of the ASOs set forth herein in Table 1, comprises about 10% to about 100% Sp, about 15% to about 100% Sp, about 20% to about 100% Sp, about 25% to about 100% Sp, about 30% to about 100% Sp, about 35% to about 100% Sp, about 40% to about 100% Sp, about 45% to about 100% Sp, about 50% to about 100% Sp, about 55% to about 100% Sp, about 60% to about 100% Sp, about 65% to about 100% Sp, about 70% to about 100% Sp, about 75% to about 100% Sp, about 80% to about 100% Sp, about 85% to about 100% Sp, about 90% to about 100% Sp, or about 95% to about 100% Sp, about 20% to about 80% Sp, about 25% to about 75% Sp, about 30% to about 70% Sp, about 40% to about 60% Sp, or about 45% to about 55% Sp, with the remainder Rp.

Any of the ASOs described herein may contain a sugar moiety that comprises ribose or deoxyribose, as present in naturally occurring nucleotides, or a modified sugar moiety or sugar analog, including a morpholine ring. Non-limiting examples of modified sugar moieties include 2' substitutions such as 2'-O-methyl (2'-O-Me), 2'-O-methoxyethyl (2'MOE), 2'-O-aminoethyl, 2'F; N3'→P5' phosphoramidate, 2'dimethylaminooxyethoxy, 2'dimethylaminoethoxyethoxy, 2'-guanidinidium, 2'-O-guanidinium ethyl, carbamate modified sugars, and bicyclic modified sugars. In some embodiments, the sugar moiety modification is selected from 2'-O-Me, 2'F, and 2'MOE. In some embodiments, the sugar moiety modification is an extra bridge bond, such as in a locked nucleic acid (LNA). In some embodiments the sugar analog contains a morpholine ring, such as phosphorodiamidate morpholino (PMO). In some embodiments, the sugar moiety comprises a ribofuransyl or 2'deoxyribofuransyl modification. In some embodiments, the sugar moiety comprises 2'4'-constrained 2'O-methyloxyethyl (cMOE) modifications. In some embodiments, the sugar moiety comprises cEt 2', 4' constrained 2'-O ethyl BNA modifications. In some embodiments, the sugar moiety comprises tricycloDNA (tcDNA) modifications. In some embodiments, the sugar moiety comprises ethylene nucleic acid (ENA) modifications. In some embodiments, the sugar moiety comprises MCE modifications. Modifications are known in the art and described in the literature, e.g., by Jarver, et al., 2014, "A Chemical View of Oligonucleotides for Exon Skipping and Related Drug Applications," Nucleic Acid Therapeutics 24(1): 37-47, incorporated by reference for this purpose herein.

In some examples, each monomer of the ASO is modified in the same way, for example each linkage of the backbone of the ASO comprises a phosphorothioate linkage or each ribose sugar moiety comprises a 2'O-methyl modification. Such modifications that are present on each of the monomer components of an ASO are referred to as "uniform modifications." In some examples, a combination of different modifications may be desired, for example, an ASO may comprise a combination of phosphorodiamidate linkages and sugar moieties comprising morpholine rings (morpholinos). Combinations of different modifications to an ASO are referred to as "mixed modifications" or "mixed chemistries."

In some embodiments, the ASO comprises one or more backbone modification. In some embodiments, the ASO comprises one or more sugar moiety modification. In some embodiments, the ASO comprises one or more backbone modification and one or more sugar moiety modification. In some embodiments, the ASO comprises 2'MOE modifications and a phosphorothioate backbone. In some embodiments, the ASO comprises a phosphorodiamidate morpholino (PMO). In some embodiments, the ASO comprises a peptide nucleic acid (PNA). Any of the ASOs or any component of an ASO (e.g., a nucleobase, sugar moiety, backbone) described herein may be modified in order to achieve desired properties or activities of the ASO or reduce undesired properties or activities of the ASO. For example, an ASO or one or more component of any ASO may be modified to enhance binding affinity to a target sequence on a pre-mRNA transcript; reduce binding to any non-target sequence; reduce degradation by cellular nucleases (i.e., RNase H); improve uptake of the ASO into a cell and/or into the nucleus of a cell; alter the pharmacokinetics or pharmacodynamics of the ASO; and modulate the half-life of the ASO.

In some embodiments, the ASOs are comprised of 2'-O-(2-methoxyethyl) (MOE) phosphorothioate-modified nucleotides. ASOs comprised of such nucleotides are especially well-suited to the methods disclosed herein; oligomers having such modifications have been shown to have significantly enhanced resistance to nuclease degradation and increased bioavailability, making them suitable, for example, for oral delivery in some embodiments described herein. See e.g., Geary et al., J Pharmacol Exp Ther. 2001; 296(3):890-7; Geary et al., J Pharmacol Exp Ther. 2001; 296(3):898-904.

Methods of synthesizing ASOs will be known to one of skill in the art. Alternatively or in addition, ASOs may be obtained from a commercial source.

Unless specified otherwise, the left-hand end of single-stranded nucleic acid (e.g., pre-mRNA transcript, oligonucleotide, ASO, etc.) sequences is the 5' end and the left-hand direction of single or double-stranded nucleic acid sequences is referred to as the 5' direction. Similarly, the right-hand end or direction of a nucleic acid sequence (single or double stranded) is the 3' end or direction. Generally, a region or sequence that is 5' to a reference point in a nucleic acid is referred to as "upstream," and a region or sequence that is 3' to a reference point in a nucleic acid is referred to as "downstream." Generally, the 5' direction or end of an mRNA is where the initiation or start codon is located, while the 3' end or direction is where the termination codon is located. In some aspects, nucleotides that are upstream of a reference point in a nucleic acid may be designated by a negative number, while nucleotides that are downstream of a reference point may be designated by a positive number. For example, a reference point (e.g., an exon-exon junction in mRNA) may be designated as the "zero" site, and a nucleotide that is directly adjacent and upstream of the reference point is designated "minus one," e.g., "−1," while a nucleotide that is directly adjacent and downstream of the reference point is designated "plus one," e.g., "+1."

Figure 1:
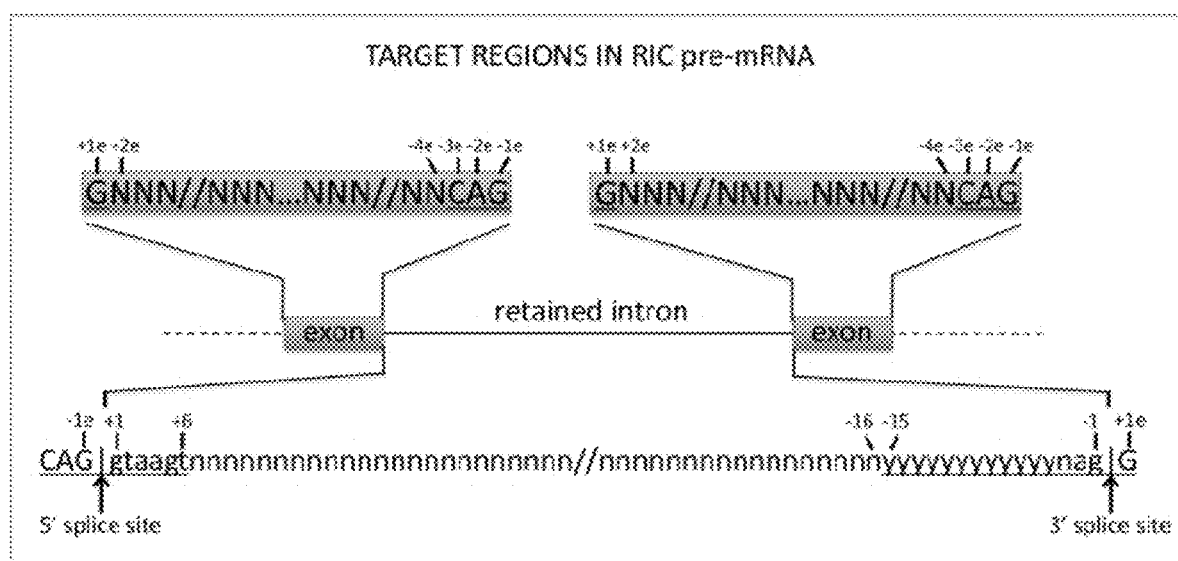
FIG. 1 illustrates a schematic representation of an exemplary retained-intron-containing (RIC) pre-mRNA transcript. The 5' splice site consensus sequence is indicated with underlined letters (letters are nucleotides; upper case: exonic portion and lower case: intronic portion) from −3e to −1e and +1 to +6 (numbers labeled "e" are exonic and unlabeled numbers are intronic). The 3' splice site consensus sequence is indicated with underlined letters (letters are nucleotides; upper case: exonic portion and lower case: intronic portion) from −15 to −1 and +1e (numbers labeled "e" are exonic and unlabeled numbers are intronic). Intronic target regions for ASO screening comprise nucleotides +6 relative to the 5' splice site of the retained intron (arrow at left) to −16 relative to the 3' splice site of the retained intron (arrow at right). In embodiments, intronic target regions for ASO screening comprise nucleotides +6 to +100 relative to the 5' splice site of the retained intron and −16 to −100 relative to the 3' splice site of the retained intron. Exonic target regions comprise nucleotides +2e to −4e in the exon flanking the 5' splice site of the retained intron and +2e to −4e in the exon flanking the 3' splice site of the retained intron. "n" or "N" denote any nucleotide, "y" denotes pyrimidine. The sequences shown represent consensus sequences for mammalian splice sites and individual introns and exons need not match the consensus sequences at every position.
Figure 2A:
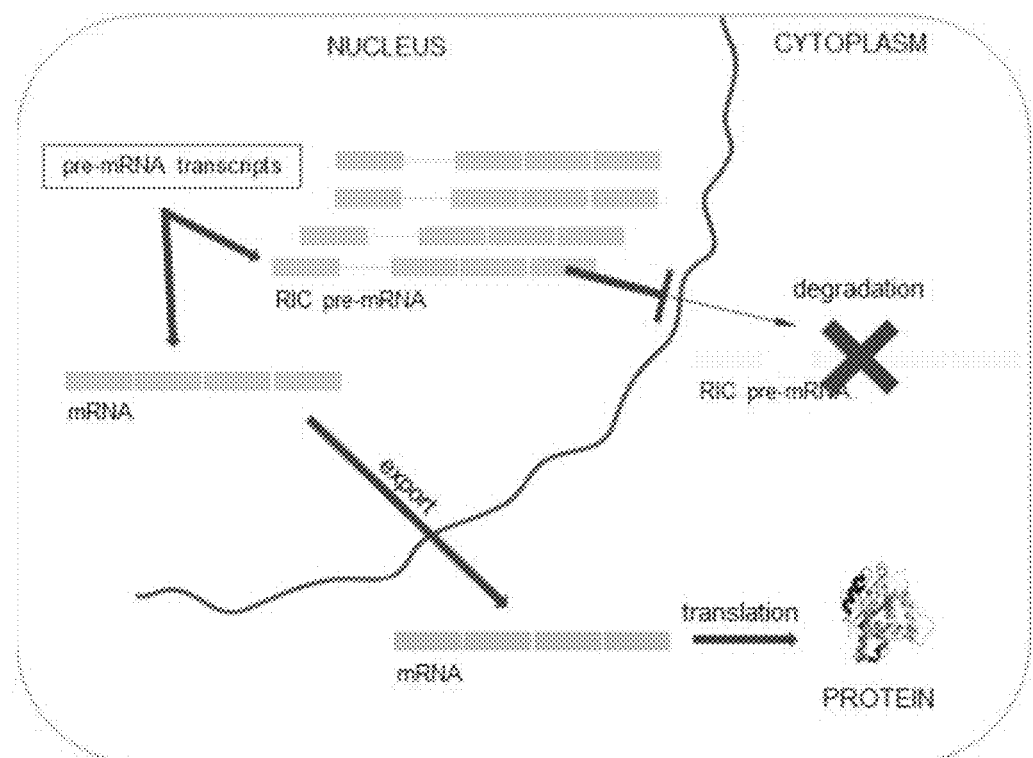
FIG. 2A-FIG. 2B illustrates schematic representations of the Targeted Augmentation of Nuclear Gene Output (TANGO) approach.
Figure 2B:
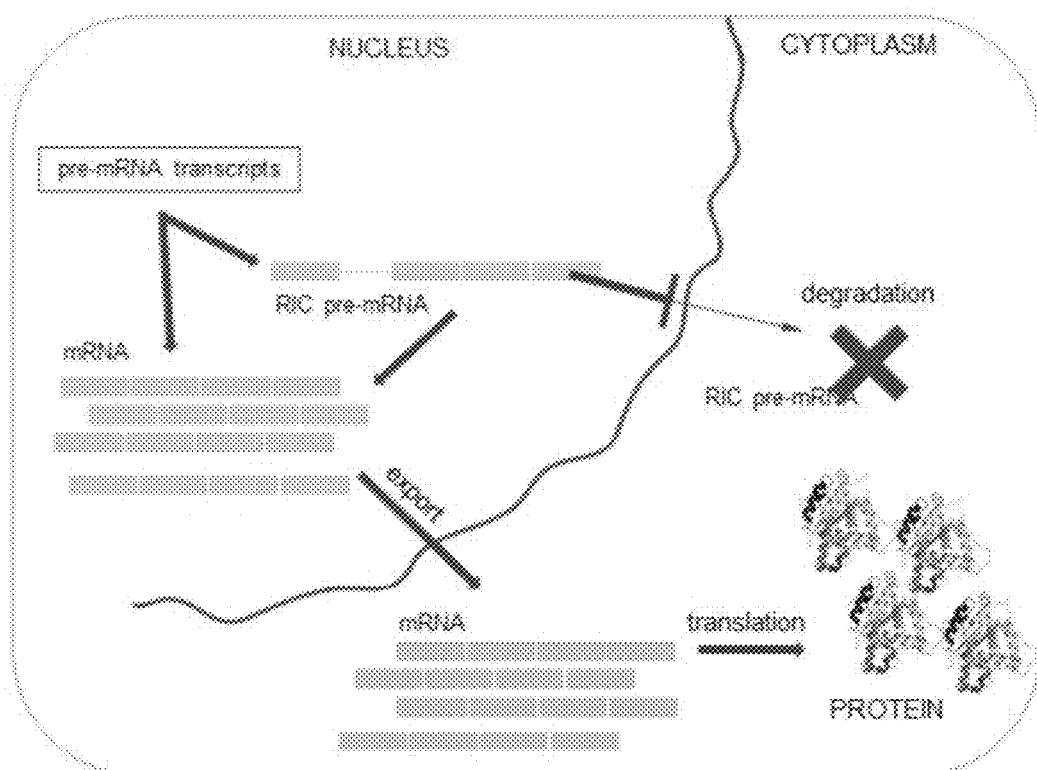

In other embodiments, the ASOs are complementary to (and bind to) a targeted portion of a JAG1 RIC pre-mRNA that is downstream (in the 3' direction) of the 5' splice site of the retained intron in a JAG1 RIC pre-mRNA (e.g., the direction designated by positive numbers relative to the 5' splice site) (FIG. 1). In some embodiments, the ASOs are complementary to a targeted portion of the JAG1 RIC pre-mRNA that is within the region +6 to +500, +6 to +400, +6 to +300, +6 to +200, or +6 to +100 relative to the 5' splice site of the retained intron. In some embodiments, the ASO is not complementary to nucleotides +1 to +5 relative to the 5' splice site (the first five nucleotides located downstream of the 5' splice site). In some embodiments, the ASOs may be complementary to a targeted portion of a JAG1 RIC pre-mRNA that is within the region between nucleotides +6 and +50 relative to the 5' splice site of the retained intron. In some aspects, the ASOs are complementary to a targeted portion that is within the region +6 to +90, +6 to +80, +6 to +70, +6 to +60, +6 to +50, +6 to +40, +6 to +30, or +6 to +20 relative to 5' splice site of the retained intron.

In some embodiments, the ASOs are complementary to a targeted region of a JAG1 RIC pre-mRNA that is upstream (5' relative) of the 3' splice site of the retained intron in a JAG1 RIC pre-mRNA (e.g., in the direction designated by negative numbers) (FIG. 1). In some embodiments, the ASOs are complementary to a targeted portion of the JAG1 RIC pre-mRNA that is within the region −16 to −500, −16 to −400, −16 to −300, −6 to −200, or −16 to −100 relative to the 3' splice site of the retained intron. In some embodiments, the ASO is not complementary to nucleotides −1 to −15 relative to the 3' splice site (the first 15 nucleotides located upstream of the 3' splice site). In some embodiments, the ASOs are complementary to a targeted portion of the JAG1 RIC pre-mRNA that is within the region −16 to −50 relative to the 3' splice site of the retained intron. In some aspects, the ASOs are complementary to a targeted portion that is within the region −16 to −90, −16 to −80, −16 to −70, −16 to −60, −16 to −50, −16 to −40, or −16 to −30 relative to 3' splice site of the retained intron.

In embodiments, the targeted portion of the JAG1 RIC pre-mRNA is within the region +6 relative to the 5' splice site of the retained intron to −16 relative to the 3' splice site of the retained intron.

In some embodiments, the ASOs are complementary to a targeted portion of a JAG1 RIC pre-mRNA that is within the exon flanking the 5' splice site (upstream) of the retained intron (FIG. 1). In some embodiments, the ASOs are complementary to a targeted portion of the JAG1 RIC pre-mRNA that is within the region +2e to −4e in the exon flanking the 5' splice site of the retained intron. In some embodiments, the ASOs are not complementary to nucleotides −1e to −3e relative to the 5' splice site of the retained intron. In some embodiments, the ASOs are complementary to a targeted portion of the JAG1 RIC pre-mRNA that is within the region −4e to −100e, −4e to −90e, −4e to −80e, −4e to −70e, −4e to −60e, −4e to −50e, −4 to −40e, −4e to −30e, or −4e to −20e relative to the 5' splice site of the retained intron.

In some embodiments, the ASOs are complementary to a targeted portion of a JAG1 RIC pre-mRNA that is within the exon flanking the 3' splice site (downstream) of the retained intron (FIG. 1). In some embodiments, the ASOs are complementary to a targeted portion to the JAG1 RIC pre-mRNA that is within the region +2e to −4e in the exon flanking the 3' splice site of the retained intron. In some embodiments, the ASOs are not complementary to nucleotide +1e relative to the 3' splice site of the retained intron. In some embodiments, the ASOs are complementary to a targeted portion of the JAG1 RIC pre-mRNA that is within the region +2e to +100e, +2e to +90e, +2e to +80e, +2e to +70e, +2e to +60e, +2e to +50e, +2e to +40e, +2e to +30e, or +2 to +20e relative to the 3' splice site of the retained intron. The ASOs may be of any length suitable for specific binding and effective enhancement of splicing. In some embodiments, the ASOs consist of 8 to 50 nucleobases. For example, the ASO may be 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, or 50 nucleobases in length. In some embodiments, the ASOs consist of more than 50 nucleobases. In some embodiments, the ASO is from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, 12 to 15 nucleobases, 13 to 50 nucleobases, 13 to 40 nucleobases, 13 to 35 nucleobases, 13 to 30 nucleobases, 13 to 25 nucleobases, 13 to 20 nucleobases, 14 to 50 nucleobases, 14 to 40 nucleobases, 14 to 35 nucleobases, 14 to 30 nucleobases, 14 to 25 nucleobases, 14 to 20 nucleobases, 15 to 50 nucleobases, 15 to 40 nucleobases, 15 to 35 nucleobases, 15 to 30 nucleobases, 15 to 25 nucleobases, 15 to 20 nucleobases, 20 to 50 nucleobases, 20 to 40 nucleobases, 20 to 35 nucleobases, 20 to 30 nucleobases, 20 to 25 nucleobases, 25 to 50 nucleobases, 25 to 40 nucleobases, 25 to 35 nucleobases, or 25 to 30 nucleobases in length. In some embodiments, the ASOs are 30 nucleotides in length. In some embodiments, the ASOs are 29 nucleotides in length. In some embodiments, the ASOs are 28 nucleotides in length. In some embodiments, the ASOs are 27 nucleotides in length. In some embodiments, the ASOs are 26 nucleotides in length. In some embodiments, the ASOs are 25 nucleotides in length. In some embodiments, the ASOs are 24 nucleotides in length. In some embodiments, the ASOs are 23 nucleotides in length. In some embodiments, the ASOs are 22 nucleotides in length. In some embodiments, the ASOs are 21 nucleotides in length. In some embodiments, the ASOs are 20 nucleotides in length. In some embodiments, the ASOs are 19 nucleotides in length. In some embodiments, the ASOs are 18 nucleotides in length. In some embodiments, the ASOs are 17 nucleotides in length. In some embodiments, the ASOs are 16 nucleotides in length. In some embodiments, the ASOs are 15 nucleotides in length. In some embodiments, the ASOs are 14 nucleotides in length. In some embodiments, the ASOs are 13 nucleotides in length. In some embodiments, the ASOs are 12 nucleotides in length. In some embodiments, the ASOs are 11 nucleotides in length. In some embodiments, the ASOs are 10 nucleotides in length.

In some embodiments, two or more ASOs with different chemistries but complementary to the same targeted portion of the RIC pre-mRNA are used. In some embodiments, two or more ASOs that are complementary to different targeted portions of the RIC pre-mRNA are used.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties, and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

In some embodiments, the nucleic acid to be targeted by an ASO is a JAG1 RIC pre-mRNA expressed in a cell, such as a eukaryotic cell. In some embodiments, the term "cell" may refer to a population of cells. In some embodiments, the cell is in a subject. In some embodiments, the cell is isolated from a subject. In some embodiments, the cell is ex vivo. In some embodiments, the cell is a condition or disease-relevant cell or a cell line. In some embodiments, the cell is in vitro (e.g., in cell culture).

Pharmaceutical Compositions

Pharmaceutical compositions or formulations comprising the antisense oligonucleotide of the described compositions and for use in any of the described methods can be prepared according to conventional techniques well known in the pharmaceutical industry and described in the published literature. In embodiments, a pharmaceutical composition or formulation for treating a subject comprises an effective amount of any antisense oligomer as described above, or a pharmaceutically acceptable salt, solvate, hydrate or ester thereof, and a pharmaceutically acceptable diluent. The antisense oligomer of a pharmaceutical formulation may further comprise a pharmaceutically acceptable excipient, diluent or carrier.

Pharmaceutically acceptable salts are suitable for use in contact with the tissues of humans and lower animals without undue toxicity, irritation, allergic response, etc., and are commensurate with a reasonable benefit/risk ratio. (See, e.g., S. M. Berge, et al., J. Pharmaceutical Sciences, 66: 1-19 (1977), incorporated herein by reference for this purpose. The salts can be prepared in situ during the final isolation and purification of the compounds, or separately by reacting the free base function with a suitable organic acid. Examples of pharmaceutically acceptable, nontoxic acid addition salts are salts of an amino group formed with inorganic acids such as hydrochloric acid, hydrobromic acid, phosphoric acid, sulfuric acid and perchloric acid or with organic acids such as acetic acid, oxalic acid, maleic acid, tartaric acid, citric acid, succinic acid or malonic acid or by using other documented methodologies such as ion exchange. Other pharmaceutically acceptable salts include adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, lower alkyl sulfonate and aryl sulfonate.

In embodiments, the compositions are formulated into any of many possible dosage forms such as, but not limited to, tablets, capsules, gel capsules, liquid syrups, soft gels, suppositories, and enemas. In embodiments, the compositions are formulated as suspensions in aqueous, non-aqueous or mixed media. Aqueous suspensions may further contain substances that increase the viscosity of the suspension including, for example, sodium carboxymethylcellulose, sorbitol and/or dextran. The suspension may also contain stabilizers. In embodiments, a pharmaceutical formulation or composition of the present invention includes, but is not limited to, a solution, emulsion, microemulsion, foam or liposome-containing formulation (e.g., cationic or noncationic liposomes).

The pharmaceutical composition or formulation of the present invention may comprise one or more penetration enhancer, carrier, excipients or other active or inactive ingredients as appropriate and well known to those of skill in the art or described in the published literature. In embodiments, liposomes also include sterically stabilized liposomes, e.g., liposomes comprising one or more specialized lipids. These specialized lipids result in liposomes with enhanced circulation lifetimes. In embodiments, a sterically stabilized liposome comprises one or more glycolipids or is derivatized with one or more hydrophilic polymers, such as a polyethylene glycol (PEG) moiety. In embodiments, a surfactant is included in the pharmaceutical formulation or compositions. The use of surfactants in drug products, formulations and emulsions is well known in the art. In embodiments, the present invention employs a penetration enhancer to effect the efficient delivery of the antisense oligonucleotide, e.g., to aid diffusion across cell membranes and/or enhance the permeability of a lipophilic drug. In embodiments, the penetration enhancers is a surfactant, fatty acid, bile salt, chelating agent, or non-chelating nonsurfactant.

In embodiments, the pharmaceutical formulation comprises multiple antisense oligonucleotides. In embodiments, the antisense oligonucleotide is administered in combination with another drug or therapeutic agent. In embodiments, the antisense oligonucleotide is administered with one or more agents capable of promoting penetration of the subject antisense oligonucleotide across the blood-brain barrier by any method known in the art. For example, delivery of agents by administration of an adenovirus vector to motor neurons in muscle tissue is described in U.S. Pat. No. 6,632,427, "Adenoviral-vector-mediated gene transfer into medullary motor neurons," incorporated herein by reference. Delivery of vectors directly to the brain, e.g., the striatum, the thalamus, the hippocampus, or the substantia nigra, is described, e.g., in U.S. Pat. No. 6,756,523, "Adenovirus vectors for the transfer of foreign genes into cells of the central nervous system particularly in brain," incorporated herein by reference.

In embodiments, the antisense oligonucleotides are linked or conjugated with agents that provide desirable pharmaceutical or pharmacodynamic properties. In embodiments, the antisense oligonucleotide is coupled to a substance, known in the art to promote penetration or transport across the blood-brain barrier, e.g., an antibody to the transferrin receptor. In embodiments, the antisense oligonucleotide is linked with a viral vector, e.g., to render the antisense compound more effective or increase transport across the blood-brain barrier. In embodiments, osmotic blood brain barrier disruption is assisted by infusion of sugars, e.g., meso erythritol, xylitol, D(+) galactose, D(+) lactose, D(+) xylose, dulcitol, myo-inositol, L(−) fructose, D(−) mannitol, D(+) glucose, D(+) arabinose, D(−) arabinose, cellobiose, D(+) maltose, D(+) raffinose, L(+) rhamnose, D(+) melibiose, D(−) ribose, adonitol, D(+) arabitol, L(−) arabitol, D(+) fucose, L(−) fucose, D(−) lyxose, L(+) lyxose, and L(−) lyxose, or amino acids, e.g., glutamine, lysine, arginine, asparagine, aspartic acid, cysteine, glutamic acid, glycine, histidine, leucine, methionine, phenylalanine, proline, serine, threonine, tyrosine, valine, and taurine. Methods and materials for enhancing blood brain barrier penetration are described, e.g., in U.S. Pat. No. 4,866,042, "Method for the delivery of genetic material across the blood brain barrier," U.S. Pat. No. 6,294,520, "Material for passage through the blood-brain barrier," and U.S. Pat. No. 6,936,589, "Parenteral delivery systems," each incorporated herein by reference.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties, and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

Treatment of Subjects

Any of the compositions provided herein may be administered to an individual. "Individual" may be used interchangeably with "subject" or "patient." An individual may be a mammal, for example a human or animal such as a non-human primate, a rodent, a rabbit, a rat, a mouse, a horse, a donkey, a goat, a cat, a dog, a cow, a pig, or a sheep. In embodiments, the individual is a human. In embodiments, the individual is a fetus, an embryo, or a child. In other embodiments, the individual may be another eukaryotic organism, such as a plant. In some embodiments, the compositions provided herein are administered to a cell ex vivo.

In some embodiments, the compositions provided herein are administered to an individual as a method of treating a disease or disorder. In some embodiments, the individual has a genetic disease, such as any of the diseases described herein. In some embodiments, the individual is at risk of having the disease, such as any of the diseases described herein. In some embodiments, the individual is at increased risk of having a disease or disorder caused by insufficient amount of a protein or insufficient activity of a protein. If an individual is "at an increased risk" of having a disease or disorder caused insufficient amount of a protein or insufficient activity of a protein, the method involves preventative or prophylactic treatment. For example, an individual may be at an increased risk of having such a disease or disorder because of family history of the disease. Typically, individuals at an increased risk of having such a disease or disorder benefit from prophylactic treatment (e.g., by preventing or delaying the onset or progression of the disease or disorder).

Suitable routes for administration of ASOs of the present invention may vary depending on cell type to which delivery of the ASOs is desired. Multiple tissues and organs are affected by Alagille syndrome, with the liver being the most significantly affected tissue. The ASOs of the present invention may be administered to patients parenterally. In embodiments, the ASOs of the present invention are administered to patients by intraperitoneal injection, intramuscular injection, subcutaneous injection, or intravenous injection. In embodiments, delivery is to the heart or liver. In embodiments, a fetus is treated in utero, e.g., by administering the ASO composition to the fetus directly or indirectly (e.g., via the mother).

In the treatment of subjects having muscular dystrophy, the compositions of the present invention may be provided to muscle cells by any suitable means, including direct administration (e.g., locally by injection or topical administration at a treatment site) or systemically (e.g., parenterally or orally), intranasally, orally, or by inhalational, enteral, topical, intrauterine, vaginal, sublingual, rectal, intramuscular, intrapleural, intraventricular, intraperitoneal, ophthalmic, intravenous, or subcutaneous means.

Methods of Identifying Additional ASOs that Enhance Splicing

Also within the scope of the present invention are methods for identifying (determining) additional ASOs that enhance splicing of a JAG1 RIC pre-mRNA, specifically at the target intron. ASOs that specifically hybridize to different nucleotides within the target region of the pre-mRNA may be screened to identify (determine) ASOs that improve the rate and/or extent of splicing of the target intron. In some embodiments, the ASO may block or interfere with the binding site(s) of a splicing repressor(s)/silencer. Any method known in the art may be used to identify (determine) an ASO that when hybridized to the target region of the intron results in the desired effect (e.g., enhanced splicing, protein or functional RNA production). These methods also can be used for identifying ASOs that enhance splicing of the retained intron by binding to a targeted region in an exon flanking the retained intron, or in a non-retained intron. An example of a method that may be used is provided below.

A round of screening, referred to as an ASO "walk" may be performed using ASOs that have been designed to hybridize to a target region of a pre-mRNA. For example, the ASOs used in the ASO walk can be tiled every 5 nucleotides from approximately 100 nucleotides upstream of the 5' splice site of the retained intron (e.g., a portion of sequence of the exon located upstream of the target/retained intron) to approximately 100 nucleotides downstream of the 5' splice site of the target/retained intron and/or from approximately 100 nucleotides upstream of the 3' splice site of the retained intron to approximately 100 nucleotides downstream of the 3' splice site of the target/retained intron (e.g., a portion of sequence of the exon located downstream of the target/retained intron). For example, a first ASO of 15 nucleotides in length may be designed to specifically hybridize to nucleotides +6 to +20 relative to the 5' splice site of the target/retained intron. A second ASO is designed to specifically hybridize to nucleotides +11 to +25 relative to the 5' splice site of the target/retained intron. ASOs are designed as such spanning the target region of the pre-mRNA. In embodiments, the ASOs can be tiled more closely, e.g., every 1, 2, 3, or 4 nucleotides. Further, the ASOs can be tiled from 100 nucleotides downstream of the 5' splice site, to 100 nucleotides upstream of the 3' splice site.

One or more ASOs, or a control ASO (an ASO with a scrambled sequence, sequence that is not expected to hybridize to the target region) are delivered, for example by transfection, into a disease-relevant cell line that expresses the target pre-mRNA (e.g., the RIC pre-mRNA described elsewhere herein). The splicing-inducing effects of each of the ASOs may be assessed by any method known in the art, for example by reverse transcriptase (RT)-PCR using primers that span the splice junction, as described herein (see "Identification of intron-retention events"). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

A second round of screening, referred to as an ASO "micro-walk" may be performed using ASOs that have been designed to hybridize to a target region of a pre-mRNA. The ASOs used in the ASO micro-walk are tiled every 1 nucleotide to further refine the nucleotide acid sequence of the pre-mRNA that when hybridized with an ASO results in enhanced splicing.

Regions defined by ASOs that promote splicing of the target intron are explored in greater detail by means of an ASO "micro-walk", involving ASOs spaced in 1-nt steps, as well as longer ASOs, typically 18-25 nt.

As described for the ASO walk above, the ASO micro-walk is performed by delivering one or more ASOs, or a control ASO (an ASO with a scrambled sequence, sequence that is not expected to hybridize to the target region), for example by transfection, into a disease-relevant cell line that expresses the target pre-mRNA. The splicing-inducing effects of each of the ASOs may be assessed by any method known in the art, for example by reverse transcriptase (RT)-PCR using primers that span the splice junction, as described herein (see "Identification of intron-retention events"). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

ASOs that when hybridized to a region of a pre-mRNA result in enhanced splicing and increased protein production may be tested in vivo using animal models, for example transgenic mouse models in which the full-length human gene has been knocked-in or in humanized mouse models of disease. Suitable routes for administration of ASOs may vary depending on the disease and/or the cell types to which delivery of the ASOs is desired. ASOs may be administered, for example, by intraperitoneal injection, intramuscular injection, subcutaneous injection, or intravenous injection. Following administration, the cells, tissues, and/or organs of the model animals may be assessed to determine the effect of the ASO treatment by for example evaluating splicing (efficiency, rate, extent) and protein production by methods known in the art and described herein. The animal models may also be any phenotypic or behavioral indication of the disease or disease severity.

Compositions and Methods for Treatment of Tuberous Sclerosis

Individual introns in primary transcripts of protein-coding genes having more than one intron are spliced from the primary transcript with different efficiencies. In most cases only the fully spliced mRNA is exported through nuclear pores for subsequent translation in the cytoplasm. Unspliced and partially spliced transcripts are detectable in the nucleus. It is generally thought that nuclear accumulation of transcripts that are not fully spliced is a mechanism to prevent the accumulation of potentially deleterious mRNAs in the cytoplasm that may be translated to protein. For some genes, splicing of the least efficient intron is a rate-limiting post-transcriptional step in gene expression, prior to translation in the cytoplasm.

The present invention provides compositions and methods for upregulating splicing of one or more retained TSC2 introns that are rate-limiting for the nuclear stages of gene expression to increase steady-state production of fully-spliced, mature mRNA, and thus, translated tuberin protein levels. These compositions and methods utilize antisense oligomers (ASOs) that promote constitutive splicing at an intron splice sites of a retained-intron-containing TSC2 pre-mRNA that accumulates in the nucleus. Thus, in embodiments, TSC2 protein is increased using the methods of the invention to treat a condition caused by TSC2 deficiency.

In other embodiments, the methods of the invention are used to increase TSC2 production to treat a condition in a subject in need thereof. In embodiments, the subject has condition in which TSC2 is not necessarily deficient relative to wild-type, but where an increase in TSC2 mitigates the condition nonetheless. In embodiments, the condition is a caused by a TSC2 haploinsufficiency. In embodiments, the condition is an autosomal dominant disorder. In embodiments, the condition is an autosomal recessive disorder.

Tuberous Sclerosis Complex

Tuberous sclerosis complex is a disease characterized by tumor growth in multiple organ systems (Au et al., J. Child Neurol. 2004, 19, 699-709). Tumors are usually benign but are occasionally malignant. Approximately 90% of tuberous sclerosis complex cases display cortical tuber; facial angiofibroma and renal angiomyolipoma occur in more than 80% of cases. In addition, approximately 80% of cases display subependymal nodule, approximately 50% of cases display cardiac rhabdomyoma, and 51% to approximately 88% of cases display ungual/subungual fibroma. Tumors of the central nervous system (CNS) are the leading cause of morbidity and mortality, followed by renal disease (Au et al., J. Child Neurol. 2004, 19, 699-709).

Tuberous sclerosis complex is a genetic disorder with an autosomal dominant inheritance pattern and a high mutation rate (Au et al., J. Child Neurol. 2004, 19, 699-709). Linkage of tuberous sclerosis complex to chromosomal regions 9q34.3 and 16p13.3 led to the identification of the TSC1 and TSC2 genes, respectively. More than 69% of tuberous sclerosis complex cases result from haploinsufficency of TSC2, and disease in approximately two thirds of patients results from de novo mutation or deletion (Au et al., J. Child Neurol. 2004, 19, 699-709). Severe disease is thought to require a "second hit" reduction of the other allele. The prevalence of tuberous sclerosis complex is as high as one in 5,800 live births, or approximately 300 births per year in the United States, with 200 cases per year resulting from mutation of TSC2. The disease is described, e.g., by OMIM #613254 (Online Mendelian Inheritance in Man, Johns Hopkins University, 1966-2015), incorporated by reference herein.

The TSC2 gene codes for a protein named tuberin. The TSC2 gene contains 41 exons, two of which are alternatively spliced, and spans approximately 40 kb on chromosome 16 (Au et al., J. Child Neurol. 2004, 19, 699-709). Tuberin is a 200 kDa protein that forms a complex with the TSC1 gene product hamartin. The tuberin-hamartin complex plays a role in the regulation of cell growth, translation, cell size, and cell adhesion and migration through a variety of signal cascades. For example, the tuberin-hamartin complex functions in the phosphatidyl-inositol-3-kinase and protein B pathway (PI3K/PKB) that regulates translation. Specifically, the tuberin-hamartin complex suppresses cell growth and translation by suppressing mTOR kinase activity, resulting in suppression of the p70 ribosomal protein S6 kinase (S6K) 1 and activation of eukaryotic translation initiation factor 4E binding protein 1 (4E-BP1). Moreover, the GAP domain of tuberin hydrolyzes guanosine triphosphate (GTP) bound to the small G protein Rheb, a Ras homolog enriched in brain, thus preventing mTOR activation.

Additionally, tuberin and hamartin regulate cell growth and cell adhesion through the MAP kinase (MAPK) and E-cadherin-beta-catenin pathways, respectively. Initially discovered through identification of loss of heterozygosity for portions of chromosome 16p13, numerous mutations have been described for TSC2 (Au et al., J. Child Neurol. 2004, 19, 699-709). Mutations include frameshift and protein truncations, nonsense mutations, mutations that affect splicing, in-frame mutations, deletions, insertions, duplications, and large deletions and rearrangement. Mutations of TSC2 that yield truncated protein products fail to form the tuberin-hamartin complex, thus resulting in loss of cell growth regulation. The role of the tuberin-hamartin complex as a key regulator of multiple signaling pathways is consistent with the wide spectrum of clinical findings among patients with tuberous sclerosis complex that involve multiple organ systems, including neurological and neurobehavioral abnormalities such as seizures, intellectual disability, and developmental delay (Au et al., J. Child Neurol. 2004, 19, 699-709).

Retained Intron Containing Pre-mRNA (RIC Pre-mRNA)

In embodiments, the methods of the present invention exploit the presence of retained-intron-containing pre-mRNA (RIC pre-mRNA) transcribed from the TSC2 gene and encoding tuberin protein, in the cell nucleus. Splicing of the identified TSC2 RIC pre-mRNA species to produce mature, fully-spliced, TSC2 mRNA, is induced using ASOs that stimulate splicing out of the retained introns. The resulting mature TSC2 mRNA can be exported to the cytoplasm and translated, thereby increasing the amount of tuberin protein in the patient's cells and alleviating symptoms of tuberous sclerosis complex. This method, described further below, is known as Targeted Augmentation of Nuclear Gene Output (TANGO).

TSC2 Nuclear Transcripts

As described herein in the Examples, the TSC2 gene was analyzed for intron-retention events and retention of introns 4, 25, 26, 31, and 32 was observed. RNA sequencing (RNAseq), visualized in the UCSC genome browser, showed TSC2 transcripts expressed in HCN (human cortical neurons) cells and localized in either the cytoplasmic or nuclear fraction. In both fractions, reads were not observed for the majority of the introns. However, higher read density was detected for introns 4, 25, 26, 31, and 32 in the nuclear fraction compared to the cytoplasmic fraction indicating that splicing efficiency of introns 4, 25, 26, 31, and 32 is low, resulting in intron retention. The retained-intron containing pre-mRNA transcripts accumulate primarily in the nucleus and not translated into the tuberin protein. The read density for intron 26 in AST is shown in detail in the lower panel indicating 51% intron retention as calculated by bioinformatic analysis. The percent intron retention (PIR) value for intron 26 was obtained by averaging four values (87, 83, 20, and 12), each determined in renal epithelial cells using one of four different algorithms. The read density for intron 31 in AST is shown in detail in the lower panel indicating 43% intron retention. The percent intron retention (PIR) value for intron 31 was obtained by averaging four values (78, 71, 16, and 8), each determined in renal epithelial cells using one of four different algorithms. Introns 4 and 32 were not mapped. Analysis of the ENCODE data (described by, e.g., Tilgner, et al., 2012, "Deep sequencing of subcellular RNA fractions shows splicing to be predominantly co-transcriptional in the human genome but inefficient for lncRNAs," Genome Research 22(9):1616-25) to identify intron retention events did not identify intron 25, 26, or 31 as retained, and did not map introns 4 and 32.

Table 3 provides a non-limiting list of target sequences of a TSC2 RIC pre-mRNA transcript by sequence ID, and ASOs by sequence ID, useful for increasing production of tuberin protein by targeting a region of a TSC2 RIC pre-mRNA. In embodiments, other ASOs useful for these purposes are identified, using, e.g., methods described herein.

TABLE 3

List of targets and ASOs targeting the TSC2 gene

| Gene SEQ ID NO: | Pre-mRNA SEQ ID NO: | ASOs | Retained Intron | Target Sequence SEQ ID NO: |
|---|---|---|---|---|
| TSC2 SEQ ID NO: 440 | TSC2: NM_001318829 SEQ ID NO: 441 | SEQ ID NOs: 448-669 | 24 | 5539 |
| | | SEQ ID NOs: 670-866 | 3 | 5536 |
| | | SEQ ID NOs: 867-1099 | 29 | 5540 |
| | TSC2: NM_000548 SEQ ID NO: 442 | SEQ ID NOs: 1100-1303 | 32 | 5544 |
| | | SEQ ID NOs: 1304-1513 | 25 | 5542 |
| | | SEQ ID NOs: 1514-1740 | 26 | 5538 |
| | | SEQ ID NOs: 1741-1937 | 4 | 5536 |
| | | SEQ ID NOs: 1938-2101 | 31 | 5543 |
| | TSC2: NM_001077183 SEQ ID NO: 443 | SEQ ID NOs: 2102-2323 | 25 | 5537 |
| | | SEQ ID NOs: 2324-2520 | 4 | 5536 |
| | | SEQ ID NOs: 2521-2753 | 30 | 5540 |
| | TSC2: NM_001114382 SEQ ID NO: 444 | SEQ ID NOs: 2754-2963 | 25 | 5542 |
| | | SEQ ID NOs: 2964-3190 | 26 | 5538 |
| | | SEQ ID NOs: 3191-3387 | 4 | 5536 |
| | | SEQ ID NOs: 3388-3620 | 31 | 5540 |
| | TSC2: NM_001318831 SEQ ID NO: 445 | SEQ ID NOs: 3621-3784 | 27 | 5543 |
| | | SEQ ID NOs: 3785-3988 | 28 | 5544 |
| | | SEQ ID NOs: 3989-4210 | 22 | 5537 |
| | TSC2: NM_001318832 SEQ ID NO: 446 | SEQ ID NOs: 4211-4432 | 25 | 5537 |
| | | SEQ ID NOs: 4433-4629 | 4 | 5536 |
| | | SEQ ID NOs: 4630-4862 | 30 | 5540 |

TABLE 3-continued

List of targets and ASOs targeting the TSC2 gene

| Gene SEQ ID NO: | Pre-mRNA SEQ ID NO: | ASOs | Retained Intron | Target Sequence SEQ ID NO: |
|---|---|---|---|---|
| | TSC2: NM_001318827 SEQ ID NO: 447 | SEQ ID NOs: 4863-5084 | 24 | 5539 |
| | | SEQ ID NOs: 5085-5302 | 3 | 5541 |
| | | SEQ ID NOs: 5303-5302 | 29 | 5540 |

In some embodiments, the ASOs disclosed herein target a RIC pre-mRNA transcribed from a TSC2 genomic sequence. In some embodiments, the ASO targets a RIC pre-mRNA transcript from a TSC2 genomic sequence comprising a retained intron. In some embodiments, the ASO targets a RIC pre-mRNA transcript of SEQ ID NO: 440. In some embodiments, the ASO targets a RIC pre-mRNA transcript of SEQ ID NO: 440 comprising a retained intron. In some embodiments, the ASOs disclosed herein target a TSC2 RIC pre-mRNA sequence. In some embodiments, the ASO targets a TSC2 RIC pre-mRNA transcript comprising a retained intron at 3, 24, 29 or a combination thereof, wherein the intron numbering correspond to the mRNA sequence at NM_001318829. In some embodiments, the ASO targets a TSC2 RIC pre-mRNA transcript comprising a retained intron at 4, 25, 26, 31, 32 or a combination thereof, wherein the intron numbering correspond to the mRNA sequence at NM_000548. In some embodiments, the ASO targets a TSC2 RIC pre-mRNA transcript comprising a retained intron at 4, 25, 30 or a combination thereof, wherein the intron numbering correspond to the mRNA sequence at NM_001077183. In some embodiments, the ASO targets a TSC2 RIC pre-mRNA transcript comprising a retained intron at 4, 25, 26, 31, or a combination thereof, wherein the intron numbering correspond to the mRNA sequence at NM_001114382. In some embodiments, the ASO targets a TSC2 RIC pre-mRNA transcript comprising a retained intron at 22, 27, 28 or a combination thereof, wherein the intron numbering correspond to the mRNA sequence at NM_001318831. In some embodiments, the ASO targets a TSC2 RIC pre-mRNA transcript comprising a retained intron at 4, 25, 30 or a combination thereof, wherein the intron numbering correspond to the mRNA sequence at NM_001318832. In some embodiments, the ASO targets a TSC2 RIC pre-mRNA transcript comprising a retained intron at 3, 24, 29 or a combination thereof, wherein the intron numbering correspond to the mRNA sequence at NM_001318827.

In some embodiments, the ASO targets a TSC2 RIC pre-mRNA sequence according to SEQ ID NO: 441. In some embodiments, the ASO targets a TSC2 RIC pre-mRNA sequence according to SEQ ID NO: 441 comprising a retained intron 24, a retained intron 3, a retained intron 29, or a combination thereof. In some embodiments, the ASO targets a TSC2 RIC pre-mRNA sequence according to SEQ ID NO: 442. In some embodiments, the ASO targets a TSC2 RIC pre-mRNA sequence according to SEQ ID NO: 442 comprising a retained intron 32, a retained intron 25, a retained intron 26, a retained intron 4, a retained intron 31 or a combination thereof. In some embodiments, the ASO targets a TSC2 RIC pre-mRNA sequence according to SEQ ID NO: 443. In some embodiments, the ASO targets a TSC2 RIC pre-mRNA sequence according to SEQ ID NO: 443 comprising a retained intron 25, a retained intron 4, a retained intron 30 or a combination thereof. In some embodiments, the ASO targets a TSC2 RIC pre-mRNA sequence according to SEQ ID NO: 444. In some embodiments, the ASO targets a TSC2 RIC pre-mRNA sequence according to SEQ ID NO: 444 comprising a retained intron 25, a retained intron 26, a retained intron 4, a retained intron 31 or a combination thereof. In some embodiments, the ASO targets a TSC2 RIC pre-mRNA sequence according to SEQ ID NO: 445. In some embodiments, the ASO targets a TSC2 RIC pre-mRNA sequence according to SEQ ID NO: 445 comprising a retained intron 27, a retained intron 28, a retained intron 22 or a combination thereof. In some embodiments, the ASO targets a TSC2 RIC pre-mRNA sequence according to SEQ ID NO: 446. In some embodiments, the ASO targets a TSC2 RIC pre-mRNA sequence according to SEQ ID NO: 446 comprising a retained intron 25, a retained intron 4, a retained intron 30 or a combination thereof. In some embodiments, the ASO targets a TSC2 RIC pre-mRNA sequence according to SEQ ID NO: 447. In some embodiments, the ASO targets a TSC2 RIC pre-mRNA sequence according to SEQ ID NO: 447 comprising a retained intron 24, a retained intron 3, a retained intron 29 or a combination thereof. In some embodiments, the ASOs disclosed herein target SEQ ID NOs: 5536-5544. In some embodiments, the ASO has a sequence according to any one of SEQ ID NOs: 448-5535.

In some embodiments, the ASO targets exon 24 or exon 25 of a TSC2 RIC pre-mRNA comprising a retained intron 24, wherein the intron numbering correspond to the mRNA sequence at NM_001318829. In some embodiments, the ASO targets an exon 24 sequence upstream (or 5') from the 5' splice site of a TSC2 RIC pre-mRNA comprising the retained intron 24. In some embodiments, the ASO targets an exon 24 sequence about 2 to about 75 or about 4 to about 74 nucleotides upstream (or 5') from the 5' splice site of a TSC2 RIC pre-mRNA comprising the retained intron 24. In some embodiments, the ASO targets an exon 25 sequence downstream (or 3') from the 3' splice site of a TSC2 RIC pre-mRNA comprising the retained intron 24. In some embodiments, the ASO targets an exon 25 sequence about 2 to about 150 or about 2 to about 147 nucleotides downstream (or 3') from the 3' splice site of a TSC2 RIC pre-mRNA comprising the retained intron 24.

In some embodiments, the ASO targets intron 24 in a TSC2 RIC pre-mRNA comprising a retained intron 24, wherein the intron numbering correspond to the mRNA sequence at NM_001318829. In some embodiments, the ASO targets an intron 24 sequence downstream (or 3') from the 5' splice site of a TSC2 RIC pre-mRNA comprising the retained intron 24. In some embodiments, the ASO targets an intron 24 sequence about 6 to about 497 nucleotides downstream (or 3') from the 5' splice site of a TSC2 RIC pre-mRNA comprising the retained intron 24. In some embodiments, the ASO targets an intron 24 sequence upstream (or 5') from the 3' splice site of a TSC2 RIC pre-mRNA comprising the retained intron 24. In some embodiments, the ASO targets an intron 24 sequence about 16 to about 496 nucleotides upstream (or 5') from the 3' splice site of a TSC2 RIC pre-mRNA comprising the retained intron 24.

In some embodiments, the ASO targets exon 3 or exon 4 of a TSC2 RIC pre-mRNA comprising a retained intron 3, wherein the intron numbering correspond to the mRNA sequence at NM_001318829. In some embodiments, the ASO targets an exon 3 sequence upstream (or 5') from the 5' splice site of a TSC2 RIC pre-mRNA comprising the retained intron 3. In some embodiments, the ASO targets an exon 3 sequence about 4 to about 94 nucleotides upstream (or 5') from the 5' splice site of a TSC2 RIC pre-mRNA comprising the retained intron 3. In some embodiments, the ASO targets an exon 4 sequence downstream (or 3') from the 3' splice site of a TSC2 RIC pre-mRNA comprising the retained intron 3. In some embodiments, the ASO targets an exon 4 sequence about 2 to about 127 nucleotides downstream (or 3') from the 3' splice site of a TSC2 RIC pre-mRNA comprising the retained intron 3.

In some embodiments, the ASO targets intron 3 in a TSC2 RIC pre-mRNA comprising a retained intron 3, wherein the intron numbering correspond to the mRNA sequence at NM_001318829. In some embodiments, the ASO targets an intron 3 sequence downstream (or 3') from the 5' splice site of a TSC2 RIC pre-mRNA comprising the retained intron 3. In some embodiments, the ASO targets an intron 3 sequence about 6 to about 435 nucleotides downstream (or 3') from the 5' splice site of a TSC2 RIC pre-mRNA comprising the retained intron 3. In some embodiments, the ASO targets an intron 3 sequence upstream (or 5') from the 3' splice site of a TSC2 RIC pre-mRNA comprising the retained intron 3. In some embodiments, the ASO targets an intron 3 sequence about 16 to about 432 nucleotides upstream (or 5') from the 3' splice site of a TSC2 RIC pre-mRNA comprising the retained intron 3.

In some embodiments, the ASO targets exon 29 or exon 30 of a TSC2 RIC pre-mRNA comprising a retained intron 29, wherein the intron numbering correspond to the mRNA sequence at NM_001318829. In some embodiments, the ASO targets an exon 29 sequence upstream (or 5') from the 5' splice site of a TSC2 RIC pre-mRNA comprising the retained intron 29. In some embodiments, the ASO targets an exon 29 sequence about 4 to about 184 nucleotides upstream (or 5') from the 5' splice site of a TSC2 RIC pre-mRNA comprising the retained intron 29. In some embodiments, the ASO targets an exon 30 sequence downstream (or 3') from the 3' splice site of a TSC2 RIC pre-mRNA comprising the retained intron 29. In some embodiments, the ASO targets an exon 30 sequence about 2 to about 102 nucleotides downstream (or 3') from the 3' splice site of a TSC2 RIC pre-mRNA comprising the retained intron 29.

In some embodiments, the ASO targets intron 29 in a TSC2 RIC pre-mRNA comprising a retained intron 29, wherein the intron numbering correspond to the mRNA sequence at NM_001318829. In some embodiments, the ASO targets an intron 29 sequence downstream (or 3') from the 5' splice site of a TSC2 RIC pre-mRNA comprising the retained intron 29. In some embodiments, the ASO targets an intron 29 sequence about 6 to about 492 nucleotides downstream (or 3') from the 5' splice site of a TSC2 RIC pre-mRNA comprising the retained intron 29. In some embodiments, the ASO targets an intron 29 sequence upstream (or 5') from the 3' splice site of a TSC2 RIC pre-mRNA comprising the retained intron 29. In some embodiments, the ASO targets an intron 29 sequence about 16 to about 500 or about 36 to about 500 nucleotides upstream (or 5') from the 3' splice site of a TSC2 RIC pre-mRNA comprising the retained intron 29.

In some embodiments, the ASO targets exon 32 or exon 33 of a TSC2 RIC pre-mRNA comprising a retained intron 32, wherein the intron numbering correspond to the mRNA sequence at NM_000548. In some embodiments, the ASO targets an exon 32 sequence upstream (or 5') from the 5' splice site of a TSC2 RIC pre-mRNA comprising the retained intron 32. In some embodiments, the ASO targets an exon 32 sequence about 4 to about 49 nucleotides upstream (or 5') from the 5' splice site of a TSC2 RIC pre-mRNA comprising the retained intron 32. In some embodiments, the ASO targets an exon 33 sequence downstream (or 3') from the 3' splice site of a TSC2 RIC pre-mRNA comprising the retained intron 32. In some embodiments, the ASO targets an exon 33 sequence about 2 to about 102 nucleotides downstream (or 3') from the 3' splice site of a TSC2 RIC pre-mRNA comprising the retained intron 32.

In some embodiments, the ASO targets intron 32 in a TSC2 RIC pre-mRNA comprising a retained intron 32, wherein the intron numbering correspond to the mRNA sequence at NM_000548. In some embodiments, the ASO targets an intron 32 sequence downstream (or 3') from the 5' splice site of a TSC2 RIC pre-mRNA comprising the retained intron 32. In some embodiments, the ASO targets an intron 32 sequence about 6 to about 495 nucleotides downstream (or 3') from the 5' splice site of a TSC2 RIC pre-mRNA comprising the retained intron 32. In some embodiments, the ASO targets an intron 32 sequence upstream (or 5') from the 3' splice site of a TSC2 RIC pre-mRNA comprising the retained intron 32. In some embodiments, the ASO targets an intron 32 sequence about 16 to about 500 or about 36 to about 500 nucleotides upstream (or 5') from the 3' splice site of a TSC2 RIC pre-mRNA comprising the retained intron 32.

In some embodiments, the ASO targets exon 25 or exon 26 of a TSC2 RIC pre-mRNA comprising a retained intron 25, wherein the intron numbering correspond to the mRNA sequence at NM_000548. In some embodiments, the ASO targets an exon 25 sequence upstream (or 5') from the 5' splice site of a TSC2 RIC pre-mRNA comprising the retained intron 25. In some embodiments, the ASO targets an exon 25 sequence about 4 to about 74 nucleotides upstream (or 5') from the 5' splice site of a TSC2 RIC pre-mRNA comprising the retained intron 25. In some embodiments, the ASO targets an exon 26 sequence downstream (or 3') from the 3' splice site of a TSC2 RIC pre-mRNA comprising the retained intron 25. In some embodiments, the ASO targets an exon 26 sequence about 2 to about 112 nucleotides downstream (or 3') from the 3' splice site of a TSC2 RIC pre-mRNA comprising the retained intron 25.

In some embodiments, the ASO targets intron 25 in a TSC2 RIC pre-mRNA comprising a retained intron 25, wherein the intron numbering correspond to the mRNA sequence at NM_000548. In some embodiments, the ASO targets an intron 25 sequence downstream (or 3') from the 5' splice site of a TSC2 RIC pre-mRNA comprising the retained intron 25. In some embodiments, the ASO targets an intron 25 sequence about 6 to about 497 nucleotides downstream (or 3') from the 5' splice site of a TSC2 RIC pre-mRNA comprising the retained intron 25. In some embodiments, the ASO targets an intron 25 sequence upstream (or 5') from the 3' splice site of a TSC2 RIC pre-mRNA comprising the retained intron 25. In some embodiments, the ASO targets an intron 25 sequence about 16 to about 498 nucleotides upstream (or 5') from the 3' splice site of a TSC2 RIC pre-mRNA comprising the retained intron 25.

In some embodiments, the ASO targets exon 26 or exon 27 of a TSC2 RIC pre-mRNA comprising a retained intron 26, wherein the intron numbering correspond to the mRNA sequence at NM_000548. In some embodiments, the ASO targets an exon 26 sequence upstream (or 5') from the 5' splice site of a TSC2 RIC pre-mRNA comprising the retained intron 26. In some embodiments, the ASO targets an exon 26 sequence about 4 to about 111 nucleotides upstream (or 5') from the 5' splice site of a TSC2 RIC pre-mRNA comprising the retained intron 26. In some embodiments, the ASO targets an exon 27 sequence downstream (or 3') from the 3' splice site of a TSC2 RIC pre-mRNA comprising the retained intron 26. In some embodiments, the ASO targets an exon 27 sequence about 2 to about 147 nucleotides downstream (or 3') from the 3' splice site of a TSC2 RIC pre-mRNA comprising the retained intron 26.

In some embodiments, the ASO targets intron 26 in a TSC2 RIC pre-mRNA comprising a retained intron 26, wherein the intron numbering correspond to the mRNA sequence at NM_000548. In some embodiments, the ASO targets an intron 26 sequence downstream (or 3') from the 5' splice site of a TSC2 RIC pre-mRNA comprising the retained intron 26. In some embodiments, the ASO targets an intron 26 sequence about 6 to about 500 nucleotides downstream (or 3') from the 5' splice site of a TSC2 RIC pre-mRNA comprising the retained intron 26. In some embodiments, the ASO targets an intron 26 sequence upstream (or 5') from the 3' splice site of a TSC2 RIC pre-mRNA comprising the retained intron 26. In some embodiments, the ASO targets an intron 26 sequence about 16 to about 496 nucleotides upstream (or 5') from the 3' splice site of a TSC2 RIC pre-mRNA comprising the retained intron 26.

In some embodiments, the ASO targets exon 4 or exon 5 of a TSC2 RIC pre-mRNA comprising a retained intron 4, wherein the intron numbering correspond to the mRNA sequence at NM_000548. In some embodiments, the ASO targets an exon 4 sequence upstream (or 5') from the 5' splice site of a TSC2 RIC pre-mRNA comprising the retained intron 4. In some embodiments, the ASO targets an exon 4 sequence about 4 to about 94 nucleotides upstream (or 5') from the 5' splice site of a TSC2 RIC pre-mRNA comprising the retained intron 4. In some embodiments, the ASO targets an exon 5 sequence downstream (or 3') from the 3' splice site of a TSC2 RIC pre-mRNA comprising the retained intron 4. In some embodiments, the ASO targets an exon 5 sequence about 2 to about 127 nucleotides downstream (or 3') from the 3' splice site of a TSC2 RIC pre-mRNA comprising the retained intron 4.

In some embodiments, the ASO targets intron 4 in a TSC2 RIC pre-mRNA comprising a retained intron 4, wherein the intron numbering correspond to the mRNA sequence at NM_000548. In some embodiments, the ASO targets an intron 4 sequence downstream (or 3') from the 5' splice site of a TSC2 RIC pre-mRNA comprising the retained intron 4. In some embodiments, the ASO targets an intron 4 sequence about 6 to about 435 nucleotides downstream (or 3') from the 5' splice site of a TSC2 RIC pre-mRNA comprising the retained intron 4. In some embodiments, the ASO targets an intron 4 sequence upstream (or 5') from the 3' splice site of a TSC2 RIC pre-mRNA comprising the retained intron 4. In some embodiments, the ASO targets an intron 4 sequence about 16 to about 432 nucleotides upstream (or 5') from the 3' splice site of a TSC2 RIC pre-mRNA comprising the retained intron 4.

In some embodiments, the ASO targets exon 31 or exon 32 of a TSC2 RIC pre-mRNA comprising a retained intron 31, wherein the intron numbering correspond to the mRNA sequence at NM_000548. In some embodiments, the ASO targets an exon 31 sequence upstream (or 5') from the 5' splice site of a TSC2 RIC pre-mRNA comprising the retained intron 31. In some embodiments, the ASO targets an exon 31 sequence about 4 to about 184 nucleotides upstream (or 5') from the 5' splice site of a TSC2 RIC pre-mRNA comprising the retained intron 31. In some embodiments, the ASO targets an exon 32 sequence downstream (or 3') from the 3' splice site of a TSC2 RIC pre-mRNA comprising the retained intron 31. In some embodiments, the ASO targets an exon 32 sequence about 2 to about 52 nucleotides downstream (or 3') from the 3' splice site of a TSC2 RIC pre-mRNA comprising the retained intron 31.

In some embodiments, the ASO targets intron 31 in a TSC2 RIC pre-mRNA comprising a retained intron 31, wherein the intron numbering correspond to the mRNA sequence at NM_000548. In some embodiments, the ASO targets an intron 31 sequence downstream (or 3') from the 5' splice site of a TSC2 RIC pre-mRNA comprising the retained intron 31. In some embodiments, the ASO targets an intron 31 sequence about 6 to about 331 nucleotides downstream (or 3') from the 5' splice site of a TSC2 RIC pre-mRNA comprising the retained intron 31. In some embodiments, the ASO targets an intron 31 sequence upstream (or 5') from the 3' splice site of a TSC2 RIC pre-mRNA comprising the retained intron 31. In some embodiments, the ASO targets an intron 31 sequence about 16 to about 333 nucleotides upstream (or 5') from the 3' splice site of a TSC2 RIC pre-mRNA comprising the retained intron 31.

In some embodiments, the ASO targets exon 25 or exon 26 of a TSC2 RIC pre-mRNA comprising a retained intron 25, wherein the intron numbering correspond to the mRNA sequence at NM_001077183. In some embodiments, the ASO targets an exon 25 sequence upstream (or 5') from the 5' splice site of a TSC2 RIC pre-mRNA comprising the retained intron 25. In some embodiments, the ASO targets an exon 25 sequence about 4 to about 74 nucleotides upstream (or 5') from the 5' splice site of a TSC2 RIC pre-mRNA comprising the retained intron 25. In some embodiments, the ASO targets an exon 26 sequence downstream (or 3') from the 3' splice site of a TSC2 RIC pre-mRNA comprising the retained intron 25. In some embodiments, the ASO targets an exon 26 sequence about 2 to about 142 nucleotides downstream (or 3') from the 3' splice site of a TSC2 RIC pre-mRNA comprising the retained intron 25.

In some embodiments, the ASO targets intron 25 in a TSC2 RIC pre-mRNA comprising a retained intron 25, wherein the intron numbering correspond to the mRNA sequence at NM_001077183. In some embodiments, the ASO targets an intron 25 sequence downstream (or 3') from the 5' splice site of a TSC2 RIC pre-mRNA comprising the retained intron 25. In some embodiments, the ASO targets an intron 25 sequence about 6 to about 497 nucleotides downstream (or 3') from the 5' splice site of a TSC2 RIC pre-mRNA comprising the retained intron 25. In some embodiments, the ASO targets an intron 25 sequence upstream (or 5') from the 3' splice site of a TSC2 RIC pre-mRNA comprising the retained intron 25. In some embodiments, the ASO targets an intron 25 sequence about 16 to about 499 nucleotides upstream (or 5') from the 3' splice site of a TSC2 RIC pre-mRNA comprising the retained intron 25.

In some embodiments, the ASO targets exon 4 or exon 5 of a TSC2 RIC pre-mRNA comprising a retained intron 4, wherein the intron numbering correspond to the mRNA sequence at NM_001077183. In some embodiments, the ASO targets an exon 4 sequence upstream (or 5') from the 5' splice site of a TSC2 RIC pre-mRNA comprising the retained intron 4. In some embodiments, the ASO targets an exon 4 sequence about 4 to about 94 nucleotides upstream (or 5') from the 5' splice site of a TSC2 RIC pre-mRNA comprising the retained intron 4. In some embodiments, the ASO targets an exon 5 sequence downstream (or 3') from the 3' splice site of a TSC2 RIC pre-mRNA comprising the retained intron 4. In some embodiments, the ASO targets an exon 5 sequence about 2 to about 127 nucleotides downstream (or 3') from the 3' splice site of a TSC2 RIC pre-mRNA comprising the retained intron 4.

In some embodiments, the ASO targets intron 4 in a TSC2 RIC pre-mRNA comprising a retained intron 4, wherein the intron numbering correspond to the mRNA sequence at NM_001077183. In some embodiments, the ASO targets an intron 4 sequence downstream (or 3') from the 5' splice site of a TSC2 RIC pre-mRNA comprising the retained intron 4. In some embodiments, the ASO targets an intron 4 sequence about 6 to about 435 nucleotides downstream (or 3') from the 5' splice site of a TSC2 RIC pre-mRNA comprising the retained intron 4. In some embodiments, the ASO targets an intron 4 sequence upstream (or 5') from the 3' splice site of a TSC2 RIC pre-mRNA comprising the retained intron 4. In some embodiments, the ASO targets an intron 4 sequence about 16 to about 432 nucleotides upstream (or 5') from the 3' splice site of a TSC2 RIC pre-mRNA comprising the retained intron 4.

In some embodiments, the ASO targets exon 30 or exon 31 of a TSC2 RIC pre-mRNA comprising a retained intron 30, wherein the intron numbering correspond to the mRNA sequence at NM_001077183. In some embodiments, the ASO targets an exon 30 sequence upstream (or 5') from the 5' splice site of a TSC2 RIC pre-mRNA comprising the retained intron 30. In some embodiments, the ASO targets an exon 30 sequence about 4 to about 184 nucleotides upstream (or 5') from the 5' splice site of a TSC2 RIC pre-mRNA comprising the retained intron 30. In some embodiments, the ASO targets an exon 31 sequence downstream (or 3') from the 3' splice site of a TSC2 RIC pre-mRNA comprising the retained intron 30. In some embodiments, the ASO targets an exon 31 sequence about 2 to about 102 nucleotides downstream (or 3') from the 3' splice site of a TSC2 RIC pre-mRNA comprising the retained intron 30.

In some embodiments, the ASO targets intron 30 in a TSC2 RIC pre-mRNA comprising a retained intron 30, wherein the intron numbering correspond to the mRNA sequence at NM_001077183. In some embodiments, the ASO targets an intron 30 sequence downstream (or 3') from the 5' splice site of a TSC2 RIC pre-mRNA comprising the retained intron 30. In some embodiments, the ASO targets an intron 30 sequence about 6 to about 492 nucleotides downstream (or 3') from the 5' splice site of a TSC2 RIC pre-mRNA comprising the retained intron 30. In some embodiments, the ASO targets an intron 30 sequence upstream (or 5') from the 3' splice site of a TSC2 RIC pre-mRNA comprising the retained intron 30. In some embodiments, the ASO targets an intron 30 sequence about 16 to about 500 or about 36 to about 500 nucleotides upstream (or 5') from the 3' splice site of a TSC2 RIC pre-mRNA comprising the retained intron 30.

In some embodiments, the ASO targets exon 25 or exon 26 of a TSC2 RIC pre-mRNA comprising a retained intron 25, wherein the intron numbering correspond to the mRNA sequence at NM_001114382. In some embodiments, the ASO targets an exon 25 sequence upstream (or 5') from the 5' splice site of a TSC2 RIC pre-mRNA comprising the retained intron 25. In some embodiments, the ASO targets an exon 25 sequence about 4 to about 74 nucleotides upstream (or 5') from the 5' splice site of a TSC2 RIC pre-mRNA comprising the retained intron 25. In some embodiments, the ASO targets an exon 26 sequence downstream (or 3') from the 3' splice site of a TSC2 RIC pre-mRNA comprising the retained intron 25. In some embodiments, the ASO targets an exon 26 sequence about 2 to about 112 nucleotides downstream (or 3') from the 3' splice site of a TSC2 RIC pre-mRNA comprising the retained intron 25.

In some embodiments, the ASO targets intron 25 in a TSC2 RIC pre-mRNA comprising a retained intron 25, wherein the intron numbering correspond to the mRNA sequence at NM_001114382. In some embodiments, the ASO targets an intron 25 sequence downstream (or 3') from the 5' splice site of a TSC2 RIC pre-mRNA comprising the retained intron 25. In some embodiments, the ASO targets an intron 25 sequence about 6 to about 497 nucleotides downstream (or 3') from the 5' splice site of a TSC2 RIC pre-mRNA comprising the retained intron 25. In some embodiments, the ASO targets an intron 25 sequence upstream (or 5') from the 3' splice site of a TSC2 RIC pre-mRNA comprising the retained intron 25. In some embodiments, the ASO targets an intron 25 sequence about 16 to about 498 nucleotides upstream (or 5') from the 3' splice site of a TSC2 RIC pre-mRNA comprising the retained intron 25.

In some embodiments, the ASO targets exon 26 or exon 27 of a TSC2 RIC pre-mRNA comprising a retained intron 26, wherein the intron numbering correspond to the mRNA sequence at NM_001114382. In some embodiments, the ASO targets an exon 26 sequence upstream (or 5') from the 5' splice site of a TSC2 RIC pre-mRNA comprising the retained intron 26. In some embodiments, the ASO targets an exon 26 sequence about 4 to about 111 nucleotides upstream (or 5') from the 5' splice site of a TSC2 RIC pre-mRNA comprising the retained intron 26. In some embodiments, the ASO targets an exon 27 sequence downstream (or 3') from the 3' splice site of a TSC2 RIC pre-mRNA comprising the retained intron 26. In some embodiments, the ASO targets an exon 27 sequence about 2 to about 147 nucleotides downstream (or 3') from the 3' splice site of a TSC2 RIC pre-mRNA comprising the retained intron 26.

In some embodiments, the ASO targets intron 26 in a TSC2 RIC pre-mRNA comprising a retained intron 26, wherein the intron numbering correspond to the mRNA sequence at NM_001114382. In some embodiments, the ASO targets an intron 26 sequence downstream (or 3') from the 5' splice site of a TSC2 RIC pre-mRNA comprising the retained intron 26. In some embodiments, the ASO targets an intron 26 sequence about 6 to about 500 nucleotides downstream (or 3') from the 5' splice site of a TSC2 RIC pre-mRNA comprising the retained intron 26. In some embodiments, the ASO targets an intron 26 sequence upstream (or 5') from the 3' splice site of a TSC2 RIC pre-mRNA comprising the retained intron 26. In some embodiments, the ASO targets an intron 26 sequence about 16 to about 496 nucleotides upstream (or 5') from the 3' splice site of a TSC2 RIC pre-mRNA comprising the retained intron 26.

In some embodiments, the ASO targets exon 4 or exon 5 of a TSC2 RIC pre-mRNA comprising a retained intron 4, wherein the intron numbering correspond to the mRNA sequence at NM_001114382. In some embodiments, the ASO targets an exon 4 sequence upstream (or 5') from the 5' splice site of a TSC2 RIC pre-mRNA comprising the retained intron 4. In some embodiments, the ASO targets an exon 4 sequence about 4 to about 94 nucleotides upstream (or 5') from the 5' splice site of a TSC2 RIC pre-mRNA comprising the retained intron 4. In some embodiments, the ASO targets an exon 5 sequence downstream (or 3') from the 3' splice site of a TSC2 RIC pre-mRNA comprising the retained intron 4. In some embodiments, the ASO targets an exon 5 sequence about 2 to about 127 nucleotides downstream (or 3') from the 3' splice site of a TSC2 RIC pre-mRNA comprising the retained intron 4.

In some embodiments, the ASO targets intron 4 in a TSC2 RIC pre-mRNA comprising a retained intron 4, wherein the intron numbering correspond to the mRNA sequence at NM_001114382. In some embodiments, the ASO targets an intron 4 sequence downstream (or 3') from the 5' splice site of a TSC2 RIC pre-mRNA comprising the retained intron 4. In some embodiments, the ASO targets an intron 4 sequence about 6 to about 435 nucleotides downstream (or 3') from the 5' splice site of a TSC2 RIC pre-mRNA comprising the retained intron 4. In some embodiments, the ASO targets an intron 4 sequence upstream (or 5') from the 3' splice site of a TSC2 RIC pre-mRNA comprising the retained intron 4. In some embodiments, the ASO targets an intron 4 sequence about 16 to about 432 nucleotides upstream (or 5') from the 3' splice site of a TSC2 RIC pre-mRNA comprising the retained intron 4.

In some embodiments, the ASO targets exon 31 or exon 32 of a TSC2 RIC pre-mRNA comprising a retained intron 31, wherein the intron numbering correspond to the mRNA sequence at NM_001114382. In some embodiments, the ASO targets an exon 31 sequence upstream (or 5') from the 5' splice site of a TSC2 RIC pre-mRNA comprising the retained intron 31. In some embodiments, the ASO targets an exon 31 sequence about 4 to about 184 nucleotides upstream (or 5') from the 5' splice site of a TSC2 RIC pre-mRNA comprising the retained intron 31. In some embodiments, the ASO targets an exon 32 sequence downstream (or 3') from the 3' splice site of a TSC2 RIC pre-mRNA comprising the retained intron 31. In some embodiments, the ASO targets an exon 32 sequence about 2 to about 102 nucleotides downstream (or 3') from the 3' splice site of a TSC2 RIC pre-mRNA comprising the retained intron 31.

In some embodiments, the ASO targets intron 31 in a TSC2 RIC pre-mRNA comprising a retained intron 31, wherein the intron numbering correspond to the mRNA sequence at NM_001114382. In some embodiments, the ASO targets an intron 31 sequence downstream (or 3') from the 5' splice site of a TSC2 RIC pre-mRNA comprising the retained intron 31. In some embodiments, the ASO targets an intron 31 sequence about 6 to about 492 nucleotides downstream (or 3') from the 5' splice site of a TSC2 RIC pre-mRNA comprising the retained intron 31. In some embodiments, the ASO targets an intron 31 sequence upstream (or 5') from the 3' splice site of a TSC2 RIC pre-mRNA comprising the retained intron 31. In some embodiments, the ASO targets an intron 31 sequence about 16 to about 500 or about 36 to about 500 nucleotides upstream (or 5') from the 3' splice site of a TSC2 RIC pre-mRNA comprising the retained intron 31.

In some embodiments, the ASO targets exon 27 or exon 28 of a TSC2 RIC pre-mRNA comprising a retained intron 27, wherein the intron numbering correspond to the mRNA sequence at NM_001318831. In some embodiments, the ASO targets an exon 27 sequence upstream (or 5') from the 5' splice site of a TSC2 RIC pre-mRNA comprising the retained intron 27. In some embodiments, the ASO targets an exon 27 sequence about 4 to about 184 nucleotides upstream (or 5') from the 5' splice site of a TSC2 RIC pre-mRNA comprising the retained intron 27. In some embodiments, the ASO targets an exon 28 sequence downstream (or 3') from the 3' splice site of a TSC2 RIC pre-mRNA comprising the retained intron 27. In some embodiments, the ASO targets an exon 28 sequence about 2 to about 52 nucleotides downstream (or 3') from the 3' splice site of a TSC2 RIC pre-mRNA comprising the retained intron 27.

In some embodiments, the ASO targets intron 27 in a TSC2 RIC pre-mRNA comprising a retained intron 27, wherein the intron numbering correspond to the mRNA sequence at NM_001318831. In some embodiments, the ASO targets an intron 27 sequence downstream (or 3') from the 5' splice site of a TSC2 RIC pre-mRNA comprising the retained intron 27. In some embodiments, the ASO targets an intron 27 sequence about 6 to about 331 nucleotides downstream (or 3') from the 5' splice site of a TSC2 RIC pre-mRNA comprising the retained intron 27. In some embodiments, the ASO targets an intron 27 sequence upstream (or 5') from the 3' splice site of a TSC2 RIC pre-mRNA comprising the retained intron 27. In some embodiments, the ASO targets an intron 27 sequence about 16 to about 333 nucleotides upstream (or 5') from the 3' splice site of a TSC2 RIC pre-mRNA comprising the retained intron 27.

In some embodiments, the ASO targets exon 28 or exon 29 of a TSC2 RIC pre-mRNA comprising a retained intron 28, wherein the intron numbering correspond to the mRNA sequence at NM_001318831. In some embodiments, the ASO targets an exon 28 sequence upstream (or 5') from the 5' splice site of a TSC2 RIC pre-mRNA comprising the retained intron 28. In some embodiments, the ASO targets an exon 28 sequence about 4 to about 49 nucleotides upstream (or 5') from the 5' splice site of a TSC2 RIC pre-mRNA comprising the retained intron 28. In some embodiments, the ASO targets an exon 29 sequence downstream (or 3') from the 3' splice site of a TSC2 RIC pre-mRNA comprising the retained intron 28. In some embodiments, the ASO targets an exon 29 sequence about 2 to about 102 nucleotides downstream (or 3') from the 3' splice site of a TSC2 RIC pre-mRNA comprising the retained intron 28.

In some embodiments, the ASO targets intron 28 in a TSC2 RIC pre-mRNA comprising a retained intron 28, wherein the intron numbering correspond to the mRNA sequence at NM_001318831. In some embodiments, the ASO targets an intron 28 sequence downstream (or 3') from the 5' splice site of a TSC2 RIC pre-mRNA comprising the retained intron 28. In some embodiments, the ASO targets an intron 28 sequence about 6 to about 495 nucleotides downstream (or 3') from the 5' splice site of a TSC2 RIC pre-mRNA comprising the retained intron 28. In some embodiments, the ASO targets an intron 28 sequence upstream (or 5') from the 3' splice site of a TSC2 RIC pre-mRNA comprising the retained intron 28. In some embodiments, the ASO targets an intron 28 sequence about 16 to about 500 or about 36 to about 500 nucleotides upstream (or 5') from the 3' splice site of a TSC2 RIC pre-mRNA comprising the retained intron 28.

In some embodiments, the ASO targets exon 22 or exon 23 of a TSC2 RIC pre-mRNA comprising a retained intron 22, wherein the intron numbering correspond to the mRNA sequence at NM_001318831. In some embodiments, the ASO targets an exon 22 sequence upstream (or 5') from the 5' splice site of a TSC2 RIC pre-mRNA comprising the retained intron 22. In some embodiments, the ASO targets an exon 22 sequence about 4 to about 74 nucleotides upstream (or 5') from the 5' splice site of a TSC2 RIC pre-mRNA comprising the retained intron 22. In some embodiments, the ASO targets an exon 23 sequence downstream (or 3') from the 3' splice site of a TSC2 RIC pre-mRNA comprising the retained intron 22. In some embodiments, the ASO targets an exon 23 sequence about 2 to about 142 nucleotides downstream (or 3') from the 3' splice site of a TSC2 RIC pre-mRNA comprising the retained intron 22.

In some embodiments, the ASO targets intron 22 in a TSC2 RIC pre-mRNA comprising a retained intron 22, wherein the intron numbering correspond to the mRNA sequence at NM_001318831. In some embodiments, the ASO targets an intron 22 sequence downstream (or 3') from the 5' splice site of a TSC2 RIC pre-mRNA comprising the retained intron 22. In some embodiments, the ASO targets an intron 22 sequence about 6 to about 497 nucleotides downstream (or 3') from the 5' splice site of a TSC2 RIC pre-mRNA comprising the retained intron 22. In some embodiments, the ASO targets an intron 22 sequence upstream (or 5') from the 3' splice site of a TSC2 RIC pre-mRNA comprising the retained intron 22. In some embodiments, the ASO targets an intron 22 sequence about 16 to about 499 nucleotides upstream (or 5') from the 3' splice site of a TSC2 RIC pre-mRNA comprising the retained intron 22.

In some embodiments, the ASO targets exon 25 or exon 26 of a TSC2 RIC pre-mRNA comprising a retained intron 25, wherein the intron numbering correspond to the mRNA sequence at NM_001318832. In some embodiments, the ASO targets an exon 25 sequence upstream (or 5') from the 5' splice site of a TSC2 RIC pre-mRNA comprising the retained intron 25. In some embodiments, the ASO targets an exon 25 sequence about 4 to about 74 nucleotides upstream (or 5') from the 5' splice site of a TSC2 RIC pre-mRNA comprising the retained intron 25. In some embodiments, the ASO targets an exon 26 sequence downstream (or 3') from the 3' splice site of a TSC2 RIC pre-mRNA comprising the retained intron 25. In some embodiments, the ASO targets an exon 26 sequence about 2 to about 142 nucleotides downstream (or 3') from the 3' splice site of a TSC2 RIC pre-mRNA comprising the retained intron 25.

In some embodiments, the ASO targets intron 25 in a TSC2 RIC pre-mRNA comprising a retained intron 25, wherein the intron numbering correspond to the mRNA sequence at NM_001318832. In some embodiments, the ASO targets an intron 25 sequence downstream (or 3') from the 5' splice site of a TSC2 RIC pre-mRNA comprising the retained intron 25. In some embodiments, the ASO targets an intron 25 sequence about 6 to about 497 nucleotides downstream (or 3') from the 5' splice site of a TSC2 RIC pre-mRNA comprising the retained intron 25. In some embodiments, the ASO targets an intron 25 sequence upstream (or 5') from the 3' splice site of a TSC2 RIC pre-mRNA comprising the retained intron 25. In some embodiments, the ASO targets an intron 25 sequence about 16 to about 499 nucleotides upstream (or 5') from the 3' splice site of a TSC2 RIC pre-mRNA comprising the retained intron 25.

In some embodiments, the ASO targets exon 4 or exon 5 of a TSC2 RIC pre-mRNA comprising a retained intron 4, wherein the intron numbering correspond to the mRNA sequence at NM_001318832. In some embodiments, the ASO targets an exon 4 sequence upstream (or 5') from the 5' splice site of a TSC2 RIC pre-mRNA comprising the retained intron 4. In some embodiments, the ASO targets an exon 4 sequence about 4 to about 94 nucleotides upstream (or 5') from the 5' splice site of a TSC2 RIC pre-mRNA comprising the retained intron 4. In some embodiments, the ASO targets an exon 5 sequence downstream (or 3') from the 3' splice site of a TSC2 RIC pre-mRNA comprising the retained intron 4. In some embodiments, the ASO targets an exon 5 sequence about 2 to about 127 nucleotides downstream (or 3') from the 3' splice site of a TSC2 RIC pre-mRNA comprising the retained intron 4.

In some embodiments, the ASO targets intron 4 in a TSC2 RIC pre-mRNA comprising a retained intron 4, wherein the intron numbering correspond to the mRNA sequence at NM_001318832. In some embodiments, the ASO targets an intron 4 sequence downstream (or 3') from the 5' splice site of a TSC2 RIC pre-mRNA comprising the retained intron 4. In some embodiments, the ASO targets an intron 4 sequence about 6 to about 435 nucleotides downstream (or 3') from the 5' splice site of a TSC2 RIC pre-mRNA comprising the retained intron 4. In some embodiments, the ASO targets an intron 4 sequence upstream (or 5') from the 3' splice site of a TSC2 RIC pre-mRNA comprising the retained intron 4. In some embodiments, the ASO targets an intron 4 sequence about 16 to about 432 nucleotides upstream (or 5') from the 3' splice site of a TSC2 RIC pre-mRNA comprising the retained intron 4.

In some embodiments, the ASO targets exon 30 or exon 31 of a TSC2 RIC pre-mRNA comprising a retained intron 30, wherein the intron numbering correspond to the mRNA sequence at NM_001318832. In some embodiments, the ASO targets an exon 30 sequence upstream (or 5') from the 5' splice site of a TSC2 RIC pre-mRNA comprising the retained intron 30. In some embodiments, the ASO targets an exon 30 sequence about 4 to about 184 nucleotides upstream (or 5') from the 5' splice site of a TSC2 RIC pre-mRNA comprising the retained intron 30. In some embodiments, the ASO targets an exon 31 sequence downstream (or 3') from the 3' splice site of a TSC2 RIC pre-mRNA comprising the retained intron 30. In some embodiments, the ASO targets an exon 31 sequence about 2 to about 102 nucleotides downstream (or 3') from the 3' splice site of a TSC2 RIC pre-mRNA comprising the retained intron 30.

In some embodiments, the ASO targets intron 30 in a TSC2 RIC pre-mRNA comprising a retained intron 30, wherein the intron numbering correspond to the mRNA sequence at NM_001318832. In some embodiments, the ASO targets an intron 30 sequence downstream (or 3') from the 5' splice site of a TSC2 RIC pre-mRNA comprising the retained intron 30. In some embodiments, the ASO targets an intron 30 sequence about 6 to about 492 nucleotides downstream (or 3') from the 5' splice site of a TSC2 RIC pre-mRNA comprising the retained intron 30. In some embodiments, the ASO targets an intron 30 sequence upstream (or 5') from the 3' splice site of a TSC2 RIC pre-mRNA comprising the retained intron 30. In some embodiments, the ASO targets an intron 30 sequence about 16 to about 500 or about 36 to about 500 nucleotides upstream (or 5') from the 3' splice site of a TSC2 RIC pre-mRNA comprising the retained intron 30.

In some embodiments, the ASO targets exon 24 or exon 25 of a TSC2 RIC pre-mRNA comprising a retained intron 24, wherein the intron numbering correspond to the mRNA sequence at NM_001318827. In some embodiments, the ASO targets an exon 24 sequence upstream (or 5') from the 5' splice site of a TSC2 RIC pre-mRNA comprising the retained intron 24. In some embodiments, the ASO targets an exon 24 sequence about 4 to about 74 nucleotides upstream (or 5') from the 5' splice site of a TSC2 RIC pre-mRNA comprising the retained intron 24. In some embodiments, the ASO targets an exon 25 sequence downstream (or 3') from the 3' splice site of a TSC2 RIC pre-mRNA comprising the retained intron 24. In some embodiments, the ASO targets an exon 25 sequence about 2 to about 147 nucleotides downstream (or 3') from the 3' splice site of a TSC2 RIC pre-mRNA comprising the retained intron 24.

In some embodiments, the ASO targets intron 24 in a TSC2 RIC pre-mRNA comprising a retained intron 24, wherein the intron numbering correspond to the mRNA sequence at NM_001318827. In some embodiments, the ASO targets an intron 24 sequence downstream (or 3') from the 5' splice site of a TSC2 RIC pre-mRNA comprising the retained intron 24. In some embodiments, the ASO targets an intron 24 sequence about 6 to about 497 nucleotides downstream (or 3') from the 5' splice site of a TSC2 RIC pre-mRNA comprising the retained intron 24. In some embodiments, the ASO targets an intron 24 sequence upstream (or 5') from the 3' splice site of a TSC2 RIC pre-mRNA comprising the retained intron 24. In some embodiments, the ASO targets an intron 24 sequence about 16 to about 496 nucleotides upstream (or 5') from the 3' splice site of a TSC2 RIC pre-mRNA comprising the retained intron 24.

In some embodiments, the ASO targets exon 3 or exon 4 of a TSC2 RIC pre-mRNA comprising a retained intron 3, wherein the intron numbering correspond to the mRNA sequence at NM_001318827. In some embodiments, the ASO targets an exon 3 sequence upstream (or 5') from the 5' splice site of a TSC2 RIC pre-mRNA comprising the retained intron 3. In some embodiments, the ASO targets an exon 3 sequence about 4 to about 69 nucleotides upstream (or 5') from the 5' splice site of a TSC2 RIC pre-mRNA comprising the retained intron 3. In some embodiments, the ASO targets an exon 4 sequence downstream (or 3') from the 3' splice site of a TSC2 RIC pre-mRNA comprising the retained intron 3. In some embodiments, the ASO targets an exon 4 sequence about 2 to about 127 nucleotides downstream (or 3') from the 3' splice site of a TSC2 RIC pre-mRNA comprising the retained intron 3.

In some embodiments, the ASO targets intron 3 in a TSC2 RIC pre-mRNA comprising a retained intron 3, wherein the intron numbering correspond to the mRNA sequence at NM_001318827. In some embodiments, the ASO targets an intron 3 sequence downstream (or 3') from the 5' splice site of a TSC2 RIC pre-mRNA comprising the retained intron 3. In some embodiments, the ASO targets an intron 3 sequence about 6 to about 499 nucleotides downstream (or 3') from the 5' splice site of a TSC2 RIC pre-mRNA comprising the retained intron 3. In some embodiments, the ASO targets an intron 3 sequence upstream (or 5') from the 3' splice site of a TSC2 RIC pre-mRNA comprising the retained intron 3. In some embodiments, the ASO targets an intron 3 sequence about 16 to about 497 nucleotides upstream (or 5') from the 3' splice site of a TSC2 RIC pre-mRNA comprising the retained intron 3.

In some embodiments, the ASO targets exon 29 or exon 30 of a TSC2 RIC pre-mRNA comprising a retained intron 29, wherein the intron numbering correspond to the mRNA sequence at NM_001318827. In some embodiments, the ASO targets an exon 29 sequence upstream (or 5') from the 5' splice site of a TSC2 RIC pre-mRNA comprising the retained intron 29. In some embodiments, the ASO targets an exon 29 sequence about 4 to about 184 nucleotides upstream (or 5') from the 5' splice site of a TSC2 RIC pre-mRNA comprising the retained intron 29. In some embodiments, the ASO targets an exon 30 sequence downstream (or 3') from the 3' splice site of a TSC2 RIC pre-mRNA comprising the retained intron 29. In some embodiments, the ASO targets an exon 30 sequence about 2 to about 102 nucleotides downstream (or 3') from the 3' splice site of a TSC2 RIC pre-mRNA comprising the retained intron 29.

In some embodiments, the ASO targets intron 29 in a TSC2 RIC pre-mRNA comprising a retained intron 29, wherein the intron numbering correspond to the mRNA sequence at NM_001318827. In some embodiments, the ASO targets an intron 29 sequence downstream (or 3') from the 5' splice site of a TSC2 RIC pre-mRNA comprising the retained intron 29. In some embodiments, the ASO targets an intron 29 sequence about 6 to about 492 nucleotides downstream (or 3') from the 5' splice site of a TSC2 RIC pre-mRNA comprising the retained intron 29. In some embodiments, the ASO targets an intron 29 sequence upstream (or 5') from the 3' splice site of a TSC2 RIC pre-mRNA comprising the retained intron 29. In some embodiments, the ASO targets an intron 29 sequence about 16 to about 500 or about 36 to about 500 nucleotides upstream (or 5') from the 3' splice site of a TSC2 RIC pre-mRNA comprising the retained intron 29.

The degree of intron retention can be represented using the metric percent intron retention (PIR), the percentage of transcripts in which a given intron is retained. In brief, PIR can be calculated as the percentage of the average number of reads mapping to the exon-intron junctions, over the sum of the average of the exon-intron junction reads plus the exon-exon junction reads.

Tuberin Protein Expression

More than 69% of tuberous sclerosis complex cases result from haploinsufficiency of TSC2, and disease in approximately two thirds of patients results from de novo mutation or deletion (Au, K., et al., J. Child Neurol., 2004, 19: 699-709)

In embodiments, the methods described herein are used to increase the production of a functional tuberin protein. As used herein, the term "functional" refers to the amount of activity or function of a tuberin protein that is necessary to eliminate any one or more symptoms of tuberous sclerosis complex. In embodiments, the methods are used to increase the production of a partially functional tuberin protein. As used herein, the term "partially functional" refers to any amount of activity or function of the tuberin protein that is less than the amount of activity or function that is necessary to eliminate or prevent any one or more symptoms of a disease or condition. In some embodiments, a partially functional protein or RNA will have at least 10%, at least 20%, at least 30%, at least 40%, at least 50%, at least 60%, at least 70%, at least 75%, at least 80%, 85%, at least 90%, or at least 95% less activity relative to the fully functional protein or RNA.

In embodiments, the method is a method of increasing the expression of the tuberin protein by cells of a subject having a RIC pre-mRNA encoding the tuberin protein, wherein the subject has tuberous sclerosis complex caused by a deficient amount of activity of tuberin protein, and wherein the deficient amount of the tuberin protein is caused by haploinsufficiency of the tuberin protein. In such an embodiment, the subject has a first allele encoding a functional tuberin protein, and a second allele from which the tuberin protein is not produced. In another such embodiment, the subject has a first allele encoding a functional tuberin protein, and a second allele encoding a nonfunctional tuberin protein. In another such embodiment, the subject has a first allele encoding a functional tuberin protein, and a second allele encoding a partially functional tuberin protein. In any of these embodiments, the antisense oligomer binds to a targeted portion of the RIC pre-mRNA transcribed from the first allele (encoding functional tuberin protein), thereby inducing constitutive splicing of the retained intron from the RIC pre-mRNA, and causing an increase in the level of mature mRNA encoding functional tuberin protein, and an increase in the expression of the tuberin protein in the cells of the subject.

In embodiments, the subject has a first allele encoding a functional tuberin protein, and a second allele encoding a partially functional tuberin protein, and the antisense oligomer binds to a targeted portion of the RIC pre-mRNA transcribed from the first allele (encoding functional tuberin protein) or a targeted portion of the RIC pre-mRNA transcribed from the second allele (encoding partially functional tuberin protein), thereby inducing constitutive splicing of the retained intron from the RIC pre-mRNA, and causing an increase in the level of mature mRNA encoding the tuberin protein, and an increase in the expression of functional or partially functional tuberin protein in the cells of the subject.

In related embodiments, the method is a method of using an ASO to increase the expression of a protein or functional RNA. In embodiments, an ASO is used to increase the expression of tuberin protein in cells of a subject having a RIC pre-mRNA encoding tuberin protein, wherein the subject has a deficiency, e.g., tuberous sclerosis complex, in the amount or function of a tuberin protein.

In embodiments, the RIC pre-mRNA transcript that encodes the protein that is causative of the disease or condition is targeted by the ASOs described herein. In some embodiments, a RIC pre-mRNA transcript that encodes a protein that is not causative of the disease is targeted by the ASOs. For example, a disease or condition that is the result of a mutation or deficiency of a first protein in a particular pathway may be ameliorated by targeting a RIC pre-mRNA that encodes a second protein, thereby increasing production of the second protein. In some embodiments, the function of the second protein is able to compensate for the mutation or deficiency of the first protein (which is causative of the disease or condition).

In embodiments, the subject has:

a. a first mutant allele from which i) the tuberin protein is produced at a reduced level compared to production from a wild-type allele, ii) the tuberin protein is produced in a form having reduced function compared to an equivalent wild-type protein, or iii) the tuberin protein or functional RNA is not produced; and b. a second mutant allele from which i) the tuberin protein is produced at a reduced level compared to production from a wild-type allele, ii) the tuberin protein is produced in a form having reduced function compared to an equivalent wild-type protein, or iii) the tuberin protein is not produced, and wherein the RIC pre-mRNA is transcribed from the first allele and/or the second allele. In these embodiments, the ASO binds to a targeted portion of the RIC pre-mRNA transcribed from the first allele or the second allele, thereby inducing constitutive splicing of the retained intron from the RIC pre-mRNA, and causing an increase in the level of mRNA encoding tuberin protein and an increase in the expression of the target protein or functional RNA in the cells of the subject. In these embodiments, the target protein or functional RNA having an increase in expression level resulting from the constitutive splicing of the retained intron from the RIC pre-mRNA is either in a form having reduced function compared to the equivalent wild-type protein (partially-functional), or having full function compared to the equivalent wild-type protein (fully-functional).

In embodiments, the level of mRNA encoding tuberin protein is increased 1.1 to 10-fold, when compared to the amount of mRNA encoding TSC2 that is produced in a control cell, e.g., one that is not treated with the antisense oligomer or one that is treated with an antisense oligomer that does not bind to the targeted portion of the TSC2 RIC pre-mRNA.

In embodiments, the condition caused by a deficient amount or activity of tuberin protein is not a condition caused by alternative or aberrant splicing of the retained intron to which the ASO is targeted. In embodiments, the condition caused by a deficient amount or activity of the tuberin protein is not a condition caused by alternative or aberrant splicing of any retained intron in a RIC pre-mRNA encoding the tuberin protein. In embodiments, alternative or aberrant splicing may occur in a pre-mRNA transcribed from the gene, however the compositions and methods of the invention do not prevent or correct this alternative or aberrant splicing.

In embodiments, a subject treated using the methods of the invention expresses a partially functional tuberin protein from one allele, wherein the partially functional tuberin protein is caused by a frameshift mutation, a nonsense mutation, a missense mutation, or a partial gene deletion. In embodiments, a subject treated using the methods of the invention expresses a nonfunctional tuberin protein from one allele, wherein the nonfunctional tuberin protein is caused by a frameshift mutation, a nonsense mutation, a missense mutation, a partial gene deletion, in one allele. In embodiments, a subject treated using the methods of the invention has a TSC2 whole gene deletion, in one allele.

In embodiments, the subject has a TSC2 missense mutation selected from R611Q/W and R905W. In embodiments, the subject has TSC2 deletion mutation of at least 6 amino acids in exon 38. In embodiments, the subject has TSC2 substitution mutation of arginine 611 for tryptophan or glutamine. In embodiments, a subject having any TSC2 mutation known in the art and described in the literature, e.g., by (Au, K., et al., J. Child Neurol., 2004, 19: 699-709), referenced above, is treated using the methods and compositions of the present invention.

Use of TANGO for Increasing Tuberin Protein Expression

As described above, in embodiments, Targeted Augmentation of Nuclear Gene Output (TANGO) is used in the methods of the invention to increase expression of a tuberin protein. In these embodiments, a retained-intron-containing pre-mRNA (RIC pre-mRNA) encoding tuberin protein is present in the nucleus of a cell. Cells having a TSC2 RIC pre-mRNA that comprises a retained intron, an exon flanking the 5' splice site, and an exon flanking the 3' splice site, encoding the tuberin protein, are contacted with antisense oligomers (ASOs) that are complementary to a targeted portion of the RIC pre-mRNA. Hybridization of the ASOs to the targeted portion of the RIC pre-mRNA results in enhanced splicing at the splice site (5' splice site or 3' splice site) of the retained intron and subsequently increases target protein production.

The terms "pre-mRNA," and "pre-mRNA transcript" may be used interchangeably and refer to any pre-mRNA species that contains at least one intron. In embodiments, pre-mRNA or pre-mRNA transcripts comprise a 5'-7-methylguanosine cap and/or a poly-A tail. In embodiments, pre-mRNA or pre-mRNA transcripts comprise both a 5'-7-methylguanosine cap and a poly-A tail. In some embodiments, the pre-mRNA transcript does not comprise a 5'-7-methylguanosine cap and/or a poly-A tail. A pre-mRNA transcript is a non-productive messenger RNA (mRNA) molecule if it is not translated into a protein (or transported into the cytoplasm from the nucleus).

As used herein, a "retained-intron-containing pre-mRNA" ("RIC pre-mRNA") is a pre-mRNA transcript that contains at least one retained intron. The RIC pre-mRNA contains a retained intron, an exon flanking the 5' splice site of the retained intron, an exon flanking the 3' splice site of the retained intron, and encodes the target protein. An "RIC pre-mRNA encoding a target protein" is understood to encode the target protein when fully spliced. A "retained intron" is any intron that is present in a pre-mRNA transcript when one or more other introns, such as an adjacent intron, encoded by the same gene have been spliced out of the same pre-mRNA transcript. In some embodiments, the retained intron is the most abundant intron in RIC pre-mRNA encoding the target protein. In embodiments, the retained intron is the most abundant intron in a population of RIC pre-mRNAs transcribed from the gene encoding the target protein in a cell, wherein the population of RIC pre-mRNAs comprises two or more retained introns. In embodiments, an antisense oligomer targeted to the most abundant intron in the population of RIC pre-mRNAs encoding the target protein induces splicing out of two or more retained introns in the population, including the retained intron to which the antisense oligomer is targeted or binds. In embodiments, a mature mRNA encoding the target protein is thereby produced. The terms "mature mRNA," and "fully-spliced mRNA," are used interchangeably herein to describe a fully processed mRNA encoding a target protein (e.g., mRNA that is exported from the nucleus into the cytoplasm and translated into target protein) or a fully processed functional RNA. The term "productive mRNA," also can be used to describe a fully processed mRNA encoding a target protein. In embodiments, the targeted region is in a retained intron that is the most abundant intron in a RIC pre-mRNA encoding the tuberin protein. In embodiments, the most abundant retained intron in a RIC pre-mRNA encoding the tuberin protein is intron 4, 25, 26, 31, 32, 25 and 26, or 31 and 32. In embodiments, the most abundant retained intron in a RIC pre-mRNA encoding the tuberin protein is intron 26. In embodiments, the most abundant retained intron in a RIC pre-mRNA encoding the tuberin protein is intron 31. In some embodiments, the most abundant retained intron in a RIC pre-mRNA encoding the tuberin protein is intron 26, and the second most abundant retained intron in a RIC pre-mRNA encoding the tuberin protein is intron 31.

In embodiments, a retained intron is an intron that is identified as a retained intron based on a determination of at least about 5%, at least about 10%, at least about 15%, at least about 20%, at least about 25%, at least about 30%, at least about 35%, at least about 40%, at least about 45%, or at least about 50%, retention. In embodiments, a retained intron is an intron that is identified as a retained intron based on a determination of about 5% to about 100%, about 5% to about 95%, about 5% to about 90%, about 5% to about 85%, about 5% to about 80%, about 5% to about 75%, about 5% to about 70%, about 5% to about 65%, about 5% to about 60%, about 5% to about 65%, about 5% to about 60%, about 5% to about 55%, about 5% to about 50%, about 5% to about 45%, about 5% to about 40%, about 5% to about 35%, about 5% to about 30%, about 5% to about 25%, about 5% to about 20%, about 5% to about 15%, about 10% to about 100%, about 10% to about 95%, about 10% to about 90%, about 10% to about 85%, about 10% to about 80%, about 10% to about 75%, about 10% to about 70%, about 10% to about 65%, about 10% to about 60%, about 10% to about 65%, about 10% to about 60%, about 10% to about 55%, about 10% to about 50%, about 10% to about 45%, about 10% to about 40%, about 10% to about 35%, about 10% to about 30%, about 10% to about 25%, about 10% to about 20%, about 15% to about 100%, about 15% to about 95%, about 15% to about 90%, about 15% to about 85%, about 15% to about 80%, about 15% to about 75%, about 15% to about 70%, about 15% to about 65%, about 15% to about 60%, about 15% to about 65%, about 15% to about 60%, about 15% to about 55%, about 15% to about 50%, about 15% to about 45%, about 15% to about 40%, about 15% to about 35%, about 15% to about 30%, about 15% to about 25%, about 20% to about 100%, about 20% to about 95%, about 20% to about 90%, about 20% to about 85%, about 20% to about 80%, about 20% to about 75%, about 20% to about 70%, about 20% to about 65%, about 20% to about 60%, about 20% to about 65%, about 20% to about 60%, about 20% to about 55%, about 20% to about 50%, about 20% to about 45%, about 20% to about 40%, about 20% to about 35%, about 20% to about 30%, about 25% to about 100%, about 25% to about 95%, about 25% to about 90%, about 25% to about 85%, about 25% to about 80%, about 25% to about 75%, about 25% to about 70%, about 25% to about 65%, about 25% to about 60%, about 25% to about 65%, about 25% to about 60%, about 25% to about 55%, about 25% to about 50%, about 25% to about 45%, about 25% to about 40%, or about 25% to about 35%, retention.

As used herein, the term "comprise" or variations thereof such as "comprises" or "comprising" are to be read to indicate the inclusion of any recited feature (e.g. in the case of an antisense oligomer, a defined nucleobase sequence) but not the exclusion of any other features. Thus, as used herein, the term "comprising" is inclusive and does not exclude additional, unrecited features (e.g. in the case of an antisense oligomer, the presence of additional, unrecited nucleobases).

In embodiments of any of the compositions and methods provided herein, "comprising" may be replaced with "consisting essentially of" or "consisting of." The phrase "consisting essentially of" is used herein to require the specified feature(s) (e.g. nucleobase sequence) as well as those which do not materially affect the character or function of the claimed invention. As used herein, the term "consisting" is used to indicate the presence of the recited feature (e.g. nucleobase sequence) alone (so that in the case of an antisense oligomer consisting of a specified nucleobase sequence, the presence of additional, unrecited nucleobases is excluded).

In embodiments, the targeted region is in a retained intron that is the second most abundant intron in a RIC pre-mRNA encoding the tuberin protein. For example, the second most abundant retained intron may be targeted rather than the most abundant retained intron due to the uniqueness of the nucleotide sequence of the second most abundant retained intron, ease of ASO design to target a particular nucleotide sequence, and/or amount of increase in protein production resulting from targeting the intron with an ASO. In embodiments, the retained intron is the second most abundant intron in a population of RIC pre-mRNAs transcribed from the gene encoding the target protein in a cell, wherein the population of RIC pre-mRNAs comprises two or more retained introns. In embodiments, an antisense oligomer targeted to the second most abundant intron in the population of RIC pre-mRNAs encoding the target protein induces splicing out of two or more retained introns in the population, including the retained intron to which the antisense oligomer is targeted or binds. In embodiments, fully-spliced (mature) RNA encoding the target protein is thereby produced. In embodiments, the second most retained intron in a RIC pre-mRNA encoding the tuberin protein is intron 4, 25, 26, 31, 32, 25 and 26, or 31 and 32. In some embodiments, the second most abundant retained intron in a RIC pre-mRNA encoding the tuberin protein is intron 31.

In embodiments, an ASO is complementary to a targeted region that is within a non-retained intron in a RIC pre-mRNA. In embodiments, the targeted portion of the RIC pre-mRNA is within: the region +6 to +100 relative to the 5' splice site of the non-retained intron; or the region −16 to −100 relative to the 3' splice site of the non-retained intron. In embodiments, the targeted portion of the RIC pre-mRNA is within the region +100 relative to the 5' splice site of the non-retained intron to −100 relative to the 3' splice site of the non-retained intron. As used to identify the location of a region or sequence, "within" is understood to include the residues at the positions recited. For example, a region +6 to +100 includes the residues at positions +6 and +100. In embodiments, fully-spliced (mature) RNA encoding the target protein is thereby produced.

In embodiments, the retained intron of the RIC pre-mRNA is an inefficiently spliced intron. As used herein, "inefficiently spliced" may refer to a relatively low frequency of splicing at a splice site adjacent to the retained intron (5' splice site or 3' splice site) as compared to the frequency of splicing at another splice site in the RIC pre-mRNA. The term "inefficiently spliced" may also refer to the relative rate or kinetics of splicing at a splice site, in which an "inefficiently spliced" intron may be spliced or removed at a slower rate as compared to another intron in a RIC pre-mRNA.

In embodiments, the 9-nucleotide sequence at −3e to −1e of the exon flanking the 5' splice site and +1 to +6 of the retained intron is identical to the corresponding wild-type sequence. In embodiments, the 16 nucleotide sequence at −15 to −1 of the retained intron and +1e of the exon flanking the 3' splice site is identical to the corresponding wild-type sequence. As used herein, the "wild-type sequence" refers to the nucleotide sequence for the TSC2 gene in the published reference genome deposited in the NCBI repository of biological and scientific information. As used herein, the "wild-type sequence" refers to the canonical sequence for the TSC2 gene found at NCBI Gene ID 7249. Also used herein, a nucleotide position denoted with an "e" indicates the nucleotide is present in the sequence of an exon (e.g., the exon flanking the 5' splice site or the exon flanking the 3' splice site).

The methods involve contacting cells with an ASO that is complementary to a portion of a pre-mRNA encoding tuberin protein, resulting in increased expression of TSC2. As used herein, "contacting" or administering to cells refers to any method of providing an ASO in immediate proximity with the cells such that the ASO and the cells interact. A cell that is contacted with an ASO will take up or transport the ASO into the cell. The method involves contacting a condition or disease-associated or condition or disease-relevant cell with any of the ASOs described herein. In some embodiments, the ASO may be further modified or attached (e.g., covalently attached) to another molecule to target the ASO to a cell type, enhance contact between the ASO and the condition or disease-associated or condition or disease-relevant cell, or enhance uptake of the ASO.

As used herein, the term "increasing protein production" or "increasing expression of a target protein" means enhancing the amount of protein that is translated from an mRNA in a cell. A "target protein" may be any protein for which increased expression/production is desired.

In embodiments, contacting a cell that expresses a TSC2 RIC pre-mRNA with an ASO that is complementary to a targeted portion of the TSC2 RIC pre-mRNA transcript results in a measurable increase in the amount of the tuberin protein (e.g., a target protein) encoded by the pre-mRNA. Methods of measuring or detecting production of a protein will be evident to one of skill in the art and include any known method, for example, Western blotting, flow cytometry, immunofluorescence microscopy, and ELISA.

In embodiments, contacting cells with an ASO that is complementary to a targeted portion of a TSC2 RIC pre-mRNA transcript results in an increase in the amount of tuberin protein produced by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of tuberin protein produced by the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the amount of target protein produced by an control compound. A control compound can be, for example, an oligonucleotide that is not complementary to the targeted portion of the RIC pre-mRNA.

In some embodiments, contacting cells with an ASO that is complementary to a targeted portion of a TSC2 RIC pre-mRNA transcript results in an increase in the amount of mRNA encoding TSC2, including the mature mRNA encoding the target protein. In some embodiments, the amount of mRNA encoding tuberin protein, or the mature mRNA encoding the tuberin protein, is increased by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of the mRNA encoding tuberin protein, or the mature mRNA encoding tuberin protein produced in the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold compared to the amount of mature RNA produced in an untreated cell, e.g., an untreated cell or a cell treated with a control compound. A control compound can be, for example, an oligonucleotide that is not complementary to the targeted portion of the TSC2 RIC pre-mRNA.

Constitutive Splicing of a Retained Intron from a RIC pre-mRNA

The methods and antisense oligonucleotide compositions provided herein are useful for increasing the expression of tuberin protein in cells, for example, in a subject having Tuberous Sclerosis Complex caused by a deficiency in the amount or activity of tuberin protein, by increasing the level of mRNA encoding tuberin protein, or the mature mRNA encoding tuberin protein. In particular, the methods and compositions as described herein induce the constitutive splicing of a retained intron from a TSC2 RIC pre-mRNA transcript encoding tuberin protein, thereby increasing the level of mRNA encoding tuberin protein, or the mature mRNA encoding tuberin protein and increasing the expression of tuberin protein.

Constitutive splicing of a retained intron from a RIC pre-mRNA correctly removes the retained intron from the RIC pre-mRNA, wherein the retained intron has wild-type splice sequences. Constitutive splicing, as used herein, does not encompass splicing of a retained intron from a RIC pre-mRNA transcribed from a gene or allele having a mutation that causes alternative splicing or aberrant splicing of a pre-mRNA transcribed from the gene or allele. For example, constitutive splicing of a retained intron, as induced using the methods and antisense oligonucleotides provided herein, does not correct aberrant splicing in or influence alternative splicing of a pre-mRNA to result in an increased expression of a target protein or functional RNA.

In embodiments, constitutive splicing correctly removes a retained intron from a TSC2 RIC pre-mRNA, wherein the TSC2 RIC pre-mRNA is transcribed from a wild-type gene or allele, or a polymorphic gene or allele, that encodes a fully-functional target protein or functional RNA, and wherein the gene or allele does not have a mutation that causes alternative splicing or aberrant splicing of the retained intron.

In some embodiments, constitutive splicing of a retained intron from a TSC2 RIC pre-mRNA encoding tuberin protein correctly removes a retained intron from a TSC2 RIC pre-mRNA encoding tuberin protein, wherein the TSC2 RIC pre-mRNA is transcribed from a gene or allele from which the target gene or functional RNA is produced at a reduced level compared to production from a wild-type allele, and wherein the gene or allele does not have a mutation that causes alternative splicing or aberrant splicing of the retained intron. In these embodiments, the correct removal of the constitutively spliced retained intron results in production of target protein or functional RNA that is functional when compared to an equivalent wild-type protein or functional RNA.

In other embodiments, constitutive splicing correctly removes a retained intron from a TSC2 RIC pre-mRNA, wherein the TSC2 RIC pre-mRNA is transcribed from a gene or allele that encodes a target protein or functional RNA produced in a form having reduced function compared to an equivalent wild-type protein or functional RNA, and wherein the gene or allele does not have a mutation that causes alternative splicing or aberrant splicing of the retained intron. In these embodiments, the correct removal of the constitutively spliced retained intron results in production of partially functional target protein, or functional RNA that is partially functional when compared to an equivalent wild-type protein or functional RNA.

"Correct removal" of the retained intron by constitutive splicing refers to removal of the entire intron, without removal of any part of an exon.

In embodiments, an antisense oligomer as described herein or used in any method described herein does not increase the amount of mRNA encoding tuberin protein or the amount of tuberin protein by modulating alternative splicing or aberrant splicing of a pre-mRNA transcribed from the TSC2 gene. Modulation of alternative splicing or aberrant splicing can be measured using any known method for analyzing the sequence and length of RNA species, e.g., by RT-PCR and using methods described elsewhere herein and in the literature. In embodiments, modulation of alternative or aberrant splicing is determined based on an increase or decrease in the amount of the spliced species of interest of at least 10% or 1.1-fold. In embodiments, modulation is determined based on an increase or decrease at a level that is at least 10% to 100% or 1.1 to 10-fold, as described herein regarding determining an increase in mRNA encoding tuberin protein in the methods of the invention.

In embodiments, the method is a method wherein the TSC2 RIC pre-mRNA was produced by partial splicing of a wild-type TSC2 pre-mRNA. In embodiments, the method is a method wherein the TSC2 RIC pre-mRNA was produced by partial splicing of a full-length wild-type TSC2 pre-mRNA. In embodiments, the TSC2 RIC pre-mRNA was produced by partial splicing of a full-length TSC2 pre-mRNA. In these embodiments, a full-length TSC2 pre-mRNA may have a polymorphism in a splice site of the retained intron that does not impair correct splicing of the retained intron as compared to splicing of the retained intron having the wild-type splice site sequence.

In embodiments, the mRNA encoding tuberin protein is a full-length mature mRNA, or a wild-type mature mRNA. In these embodiments, a full-length mature mRNA may have a polymorphism that does not affect the activity of the target protein or the functional RNA encoded by the mature mRNA, as compared to the activity of tuberin protein encoded by the wild-type mature mRNA.

Antisense Oligomers

One aspect of the present disclosure is a composition comprising antisense oligomers that enhances splicing by binding to a targeted portion of a TSC2 RIC pre-mRNA. As used herein, the terms "ASO" and "antisense oligomer" are used interchangeably and refer to an oligomer such as a polynucleotide, comprising nucleobases that hybridizes to a target nucleic acid (e.g., a TSC2 RIC pre-mRNA) sequence by Watson-Crick base pairing or wobble base pairing (G-U). The ASO may have exact sequence complementary to the target sequence or near complementarity (e.g., sufficient complementarity to bind the target sequence and enhancing splicing at a splice site). ASOs are designed so that they bind (hybridize) to a target nucleic acid (e.g., a targeted portion of a pre-mRNA transcript) and remain hybridized under physiological conditions. Typically, if they hybridize to a site other than the intended (targeted) nucleic acid sequence, they hybridize to a limited number of sequences that are not a target nucleic acid (to a few sites other than a target nucleic acid). Design of an ASO can take into consideration the occurrence of the nucleic acid sequence of the targeted portion of the pre-mRNA transcript or a sufficiently similar nucleic acid sequence in other locations in the genome or cellular pre-mRNA or transcriptome, such that the likelihood the ASO will bind other sites and cause "off-target" effects is limited. Any antisense oligomers known in the art, for example in PCT Application No. PCT/US2014/054151, published as WO 2015/035091, titled "Reducing Nonsense-Mediated mRNA Decay," can be used to practice the methods described herein.

In some embodiments, ASOs "specifically hybridize" to or are "specific" to a target nucleic acid or a targeted portion of a RIC pre-mRNA. Typically such hybridization occurs with a Tm substantially greater than 37° C., preferably at least 50° C., and typically between 60° C. to approximately 90° C. Such hybridization preferably corresponds to stringent hybridization conditions. At a given ionic strength and pH, the Tm is the temperature at which 50% of a target sequence hybridizes to a complementary oligonucleotide.

Oligomers, such as oligonucleotides, are "complementary" to one another when hybridization occurs in an antiparallel configuration between two single-stranded polynucleotides. A double-stranded polynucleotide can be "complementary" to another polynucleotide, if hybridization can occur between one of the strands of the first polynucleotide and the second. Complementarity (the degree to which one polynucleotide is complementary with another) is quantifiable in terms of the proportion (e.g., the percentage) of bases in opposing strands that are expected to form hydrogen bonds with each other, according to generally accepted base-pairing rules. The sequence of an antisense oligomer (ASO) need not be 100% complementary to that of its target nucleic acid to hybridize. In certain embodiments, ASOs can comprise at least 70%, at least 75%, at least 80%, at least 85%, at least 90%, at least 95%, at least 96%, at least 97%, at least 98%, or at least 99% sequence complementarity to a target region within the target nucleic acid sequence to which they are targeted. For example, an ASO in which 18 of 20 nucleobases of the oligomeric compound are complementary to a target region, and would therefore specifically hybridize, would represent 90 percent complementarity. In this example, the remaining non-complementary nucleobases may be clustered together or interspersed with complementary nucleobases and need not be contiguous to each other or to complementary nucleobases. Percent complementarity of an ASO with a region of a target nucleic acid can be determined routinely using BLAST programs (basic local alignment search tools) and PowerBLAST programs known in the art (Altschul et al., J. Mol. Biol., 1990, 215, 403-410; Zhang and Madden, Genome Res., 1997, 7, 649-656).

An ASO need not hybridize to all nucleobases in a target sequence and the nucleobases to which it does hybridize may be contiguous or noncontiguous. ASOs may hybridize over one or more segments of a pre-mRNA transcript, such that intervening or adjacent segments are not involved in the hybridization event (e.g., a loop structure or hairpin structure may be formed). In certain embodiments, an ASO hybridizes to noncontiguous nucleobases in a target pre-mRNA transcript. For example, an ASO can hybridize to nucleobases in a pre-mRNA transcript that are separated by one or more nucleobase(s) to which the ASO does not hybridize.

The ASOs described herein comprise nucleobases that are complementary to nucleobases present in a target portion of a RIC pre-mRNA. The term ASO embodies oligonucleotides and any other oligomeric molecule that comprises nucleobases capable of hybridizing to a complementary nucleobase on a target mRNA but does not comprise a sugar moiety, such as a peptide nucleic acid (PNA). The ASOs may comprise naturally-occurring nucleotides, nucleotide analogs, modified nucleotides, or any combination of two or three of the preceding. The term "naturally occurring nucleotides" includes deoxyribonucleotides and ribonucleotides. The term "modified nucleotides" includes nucleotides with modified or substituted sugar groups and/or having a modified backbone. In some embodiments, all of the nucleotides of the ASO are modified nucleotides. Chemical modifications of ASOs or components of ASOs that are compatible with the methods and compositions described herein will be evident to one of skill in the art and can be found, for example, in U.S. Pat. No. 8,258,109 B2, U.S. Pat. No. 5,656,612, U.S. Patent Publication No. 2012/0190728, and Dias and Stein, Mol. Cancer Ther. 2002, 1, 347-355, herein incorporated by reference in their entirety.

The nucleobase of an ASO may be any naturally occurring, unmodified nucleobase such as adenine, guanine, cytosine, thymine and uracil, or any synthetic or modified nucleobase that is sufficiently similar to an unmodified nucleobase such that it is capable of hydrogen bonding with a nucleobase present on a target pre-mRNA. Examples of modified nucleobases include, without limitation, hypoxanthine, xanthine, 7-methylguanine, 5, 6-dihydrouracil, 5-methylcytosine, and 5-hydroxymethoylcytosine.

The ASOs described herein also comprise a backbone structure that connects the components of an oligomer. The term "backbone structure" and "oligomer linkages" may be used interchangeably and refer to the connection between monomers of the ASO. In naturally occurring oligonucleotides, the backbone comprises a 3'-5' phosphodiester linkage connecting sugar moieties of the oligomer. The backbone structure or oligomer linkages of the ASOs described herein may include (but are not limited to) phosphorothioate, phosphorodithioate, phosphoroselenoate, phosphorodiselenoate, phosphoroanilothioate, phosphoraniladate, phosphoramidate, and the like. See e.g., LaPlanche et al., Nucleic Acids Res. 14:9081 (1986); Stec et al., J. Am. Chem. Soc. 106:6077 (1984), Stein et al., Nucleic Acids Res. 16:3209 (1988), Zon et al., Anti Cancer Drug Design 6:539 (1991); Zon et al., Oligonucleotides and Analogues: A Practical Approach, pp. 87-108 (F. Eckstein, Ed., Oxford University Press, Oxford England (1991)); Stec et al., U.S. Pat. No. 5,151,510; Uhlmann and Peyman, Chemical Reviews 90:543 (1990). In some embodiments, the backbone structure of the ASO does not contain phosphorous but rather contains peptide bonds, for example in a peptide nucleic acid (PNA), or linking groups including carbamate, amides, and linear and cyclic hydrocarbon groups. In some embodiments, the backbone modification is a phosphorothioate linkage. In some embodiments, the backbone modification is a phosphoramidate linkage.

In embodiments, the stereochemistry at each of the phosphorus internucleotide linkages of the ASO backbone is random. In embodiments, the stereochemistry at each of the phosphorus internucleotide linkages of the ASO backbone is controlled and is not random. For example, U.S. Pat. App. Pub. No. 2014/0194610, "Methods for the Synthesis of Functionalized Nucleic Acids," incorporated herein by reference, describes methods for independently selecting the handedness of chirality at each phosphorous atom in a nucleic acid oligomer. In embodiments, an ASO used in the methods of the invention, including, but not limited to, any of the ASOs set forth herein in Table 3, comprises an ASO having phosphorus internucleotide linkages that are not random. In embodiments, a composition used in the methods of the invention comprises a pure diastereomeric ASO. In embodiments, a composition used in the methods of the invention comprises an ASO that has diastereomeric purity of at least about 90%, at least about 91%, at least about 92%, at least about 93%, at least about 94%, at least about 95%, at least about 96%, at least about 97%, at least about 98%, at least about 99%, about 100%, about 90% to about 100%, about 91% to about 100%, about 92% to about 100%, about 93% to about 100%, about 94% to about 100%, about 95% to about 100%, about 96% to about 100%, about 97% to about 100%, about 98% to about 100%, or about 99% to about 100%.

In embodiments, the ASO has a nonrandom mixture of Rp and Sp configurations at its phosphorus internucleotide linkages. For example, it has been suggested that a mix of Rp and Sp is required in antisense oligonucleotides to achieve a balance between good activity and nuclease stability (Wan, et al., 2014, "Synthesis, biophysical properties and biological activity of second generation antisense oligonucleotides containing chiral phosphorothioate linkages," Nucleic Acids Research 42(22): 13456-13468, incorporated herein by reference). In embodiments, an ASO used in the methods of the invention, including, but not limited to, any of the ASOs set forth herein in Table 3, comprises about 5-100% Rp, at least about 5% Rp, at least about 10% Rp, at least about 15% Rp, at least about 20% Rp, at least about 25% Rp, at least about 30% Rp, at least about 35% Rp, at least about 40% Rp, at least about 45% Rp, at least about 50% Rp, at least about 55% Rp, at least about 60% Rp, at least about 65% Rp, at least about 70% Rp, at least about 75% Rp, at least about 80% Rp, at least about 85% Rp, at least about 90% Rp, or at least about 95% Rp, with the remainder Sp, or about 100% Rp. In embodiments, an ASO used in the methods of the invention, including, but not limited to, any of the ASOs set forth herein in Table 3, comprises about 10% to about 100% Rp, about 15% to about 100% Rp, about 20% to about 100% Rp, about 25% to about 100% Rp, about 30% to about 100% Rp, about 35% to about 100% Rp, about 40% to about 100% Rp, about 45% to about 100% Rp, about 50% to about 100% Rp, about 55% to about 100% Rp, about 60% to about 100% Rp, about 65% to about 100% Rp, about 70% to about 100% Rp, about 75% to about 100% Rp, about 80% to about 100% Rp, about 85% to about 100% Rp, about 90% to about 100% Rp, or about 95% to about 100% Rp, about 20% to about 80% Rp, about 25% to about 75% Rp, about 30% to about 70% Rp, about 40% to about 60% Rp, or about 45% to about 55% Rp, with the remainder Sp.

In embodiments, an ASO used in the methods of the invention, including, but not limited to, any of the ASOs set forth herein in Table 3, comprises about 5-100% Sp, at least about 5% Sp, at least about 10% Sp, at least about 15% Sp, at least about 20% Sp, at least about 25% Sp, at least about 30% Sp, at least about 35% Sp, at least about 40% Sp, at least about 45% Sp, at least about 50% Sp, at least about 55% Sp, at least about 60% Sp, at least about 65% Sp, at least about 70% Sp, at least about 75% Sp, at least about 80% Sp, at least about 85% Sp, at least about 90% Sp, or at least about 95% Sp, with the remainder Rp, or about 100% Sp. In embodiments, an ASO used in the methods of the invention, including, but not limited to, any of the ASOs set forth herein in Table 3, comprises about 10% to about 100% Sp, about 15% to about 100% Sp, about 20% to about 100% Sp, about 25% to about 100% Sp, about 30% to about 100% Sp, about 35% to about 100% Sp, about 40% to about 100% Sp, about 45% to about 100% Sp, about 50% to about 100% Sp, about 55% to about 100% Sp, about 60% to about 100% Sp, about 65% to about 100% Sp, about 70% to about 100% Sp, about 75% to about 100% Sp, about 80% to about 100% Sp, about 85% to about 100% Sp, about 90% to about 100% Sp, or about 95% to about 100% Sp, about 20% to about 80% Sp, about 25% to about 75% Sp, about 30% to about 70% Sp, about 40% to about 60% Sp, or about 45% to about 55% Sp, with the remainder Rp.

Any of the ASOs described herein may contain a sugar moiety that comprises ribose or deoxyribose, as present in naturally occurring nucleotides, or a modified sugar moiety or sugar analog, including a morpholine ring. Non-limiting examples of modified sugar moieties include 2' substitutions such as 2'-O-methyl (2'-O-Me), 2'-O-methoxyethyl (2'MOE), 2'-O-aminoethyl, 2'F; N3'→P5' phosphoramidate, 2'dimethylaminooxyethoxy, 2'dimethylaminoethoxyethoxy, 2'-guanidinidium, 2'-O-guanidinium ethyl, carbamate modified sugars, and bicyclic modified sugars. In some embodiments, the sugar moiety modification is selected from 2'-O-Me, 2'F, and 2'MOE. In some embodiments, the sugar moiety modification is an extra bridge bond, such as in a locked nucleic acid (LNA). In some embodiments the sugar analog contains a morpholine ring, such as phosphorodiamidate morpholino (PMO). In some embodiments, the sugar moiety comprises a ribofuransyl or 2'deoxyribofuransyl modification. In some embodiments, the sugar moiety comprises 2'4'-constrained 2'O-methyloxyethyl (cMOE) modifications. In some embodiments, the sugar moiety comprises cEt 2', 4' constrained 2'-O ethyl BNA modifications. In some embodiments, the sugar moiety comprises tricycloDNA (tcDNA) modifications. In some embodiments, the sugar moiety comprises ethylene nucleic acid (ENA) modifications. In some embodiments, the sugar moiety comprises MCE modifications. Modifications are known in the art and described in the literature, e.g., by Jarver, et al., 2014, "A Chemical View of Oligonucleotides for Exon Skipping and Related Drug Applications," Nucleic Acid Therapeutics 24(1): 37-47, incorporated by reference for this purpose herein.

In some examples, each monomer of the ASO is modified in the same way, for example each linkage of the backbone of the ASO comprises a phosphorothioate linkage or each ribose sugar moiety comprises a 2'O-methyl modification. Such modifications that are present on each of the monomer components of an ASO are referred to as "uniform modifications." In some examples, a combination of different modifications may be desired, for example, an ASO may comprise a combination of phosphorodiamidate linkages and sugar moieties comprising morpholine rings (morpholinos). Combinations of different modifications to an ASO are referred to as "mixed modifications" or "mixed chemistries."

In some embodiments, the ASO comprises one or more backbone modification. In some embodiments, the ASO comprises one or more sugar moiety modification. In some embodiments, the ASO comprises one or more backbone modification and one or more sugar moiety modification. In some embodiments, the ASO comprises 2'MOE modifications and a phosphorothioate backbone. In some embodiments, the ASO comprises a phosphorodiamidate morpholino (PMO). In some embodiments, the ASO comprises a peptide nucleic acid (PNA). Any of the ASOs or any component of an ASO (e.g., a nucleobase, sugar moiety, backbone) described herein may be modified in order to achieve desired properties or activities of the ASO or reduce undesired properties or activities of the ASO. For example, an ASO or one or more component of any ASO may be modified to enhance binding affinity to a target sequence on a pre-mRNA transcript; reduce binding to any non-target sequence; reduce degradation by cellular nucleases (i.e., RNase H); improve uptake of the ASO into a cell and/or into the nucleus of a cell; alter the pharmacokinetics or pharmacodynamics of the ASO; and modulate the half-life of the ASO.

In some embodiments, the ASOs are comprised of 2'-O-(2-methoxyethyl) (MOE) phosphorothioate-modified nucleotides. ASOs comprised of such nucleotides are especially well-suited to the methods disclosed herein; oligomers having such modifications have been shown to have significantly enhanced resistance to nuclease degradation and increased bioavailability, making them suitable, for example, for oral delivery in some embodiments described herein. See e.g., Geary et al., J Pharmacol Exp Ther. 2001; 296(3):890-7; Geary et al., J Pharmacol Exp Ther. 2001; 296(3):898-904.

Methods of synthesizing ASOs will be known to one of skill in the art. Alternatively or in addition, ASOs may be obtained from a commercial source.

Unless specified otherwise, the left-hand end of single-stranded nucleic acid (e.g., pre-mRNA transcript, oligonucleotide, ASO, etc.) sequences is the 5' end and the left-hand direction of single or double-stranded nucleic acid sequences is referred to as the 5' direction. Similarly, the right-hand end or direction of a nucleic acid sequence (single or double stranded) is the 3' end or direction. Generally, a region or sequence that is 5' to a reference point in a nucleic acid is referred to as "upstream," and a region or sequence that is 3' to a reference point in a nucleic acid is referred to as "downstream." Generally, the 5' direction or end of an mRNA is where the initiation or start codon is located, while the 3' end or direction is where the termination codon is located. In some aspects, nucleotides that are upstream of a reference point in a nucleic acid may be designated by a negative number, while nucleotides that are downstream of a reference point may be designated by a positive number. For example, a reference point (e.g., an exon-exon junction in mRNA) may be designated as the "zero" site, and a nucleotide that is directly adjacent and upstream of the reference point is designated "minus one," e.g., "−1," while a nucleotide that is directly adjacent and downstream of the reference point is designated "plus one," e.g., "+1."

In other embodiments, the ASOs are complementary to (and bind to) a targeted portion of a TSC2 RIC pre-mRNA that is downstream (in the 3' direction) of the 5' splice site of the retained intron in a TSC2 RIC pre-mRNA (e.g., the direction designated by positive numbers relative to the 5' splice site) (FIG. 1). In some embodiments, the ASOs are complementary to a targeted portion of the TSC2 RIC pre-mRNA that is within the region +6 to +500, +6 to +400, +6 to +300, +6 to +200, or +6 to +100 relative to the 5' splice site of the retained intron. In some embodiments, the ASO is not complementary to nucleotides +1 to +5 relative to the 5' splice site (the first five nucleotides located downstream of the 5' splice site). In some embodiments, the ASOs may be complementary to a targeted portion of a TSC2 RIC pre-mRNA that is within the region between nucleotides +6 and +50 relative to the 5' splice site of the retained intron. In some aspects, the ASOs are complementary to a targeted portion that is within the region +6 to +90, +6 to +80, +6 to +70, +6 to +60, +6 to +50, +6 to +40, +6 to +30, or +6 to +20 relative to 5' splice site of the retained intron.

In some embodiments, the ASOs are complementary to a targeted region of a TSC2 RIC pre-mRNA that is upstream (5' relative) of the 3' splice site of the retained intron in a TSC2 RIC pre-mRNA (e.g., in the direction designated by negative numbers) (FIG. 1). In some embodiments, the ASOs are complementary to a targeted portion of the TSC2 RIC pre-mRNA that is within the region −16 to −500, −16 to −400, −16 to −300, −6 to −200, −16 to −100, relative to the 3' splice site of the retained intron. In some embodiments, the ASO is not complementary to nucleotides −1 to −15 relative to the 3' splice site (the first 15 nucleotides located upstream of the 3' splice site). In some embodiments, the ASOs are complementary to a targeted portion of the TSC2 RIC pre-mRNA that is within the region −16 to −50 relative to the 3' splice site of the retained intron. In some aspects, the ASOs are complementary to a targeted portion that is within the region −16 to −90, −16 to −80, −16 to −70, −16 to −60, −16 to −50, −16 to −40, or −16 to −30 relative to 3' splice site of the retained intron.

In embodiments, the targeted portion of the TSC2 RIC pre-mRNA is within the region +100 relative to the 5' splice site of the retained intron to −100 relative to the 3' splice site of the retained intron.

In some embodiments, the ASOs are complementary to a targeted portion of a TSC2 RIC pre-mRNA that is within the exon flanking the 5' splice site (upstream) of the retained intron (FIG. 1). In some embodiments, the ASOs are complementary to a targeted portion of the TSC2 RIC pre-mRNA that is within the region +2e to −4e in the exon flanking the 5' splice site of the retained intron. In some embodiments, the ASOs are not complementary to nucleotides −1e to −3e relative to the 5' splice site of the retained intron. In some embodiments, the ASOs are complementary to a targeted portion of the TSC2 RIC pre-mRNA that is within the region −4e to −100e, −4e to −90e, −4e to −80e, −4e to −70e, −4e to −60e, −4e to −50e, −4 to −40e, −4e to −30e, or −4e to −20e relative to the 5' splice site of the retained intron.

In some embodiments, the ASOs are complementary to a targeted portion of a TSC2 RIC pre-mRNA that is within the exon flanking the 3' splice site (downstream) of the retained intron (FIG. 1). In some embodiments, the ASOs are complementary to a targeted portion to the TSC2 RIC pre-mRNA that is within the region +2e to −4e in the exon flanking the 3' splice site of the retained intron. In some embodiments, the ASOs are not complementary to nucleotide +1e relative to the 3' splice site of the retained intron. In some embodiments, the ASOs are complementary to a targeted portion of the TSC2 RIC pre-mRNA that is within the region +2e to +100e, +2e to +90e, +2e to +80e, +2e to +70e, +2e to +60e, +2e to +50e, +2e to +40e, +2e to +30e, or +2 to +20e relative to the 3' splice site of the retained intron. The ASOs may be of any length suitable for specific binding and effective enhancement of splicing. In some embodiments, the ASOs consist of 8 to 50 nucleobases. For example, the ASO may be 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, or 50 nucleobases in length. In some embodiments, the ASOs consist of more than 50 nucleobases. In some embodiments, the ASO is from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, 12 to 15 nucleobases, 13 to 50 nucleobases, 13 to 40 nucleobases, 13 to 35 nucleobases, 13 to 30 nucleobases, 13 to 25 nucleobases, 13 to 20 nucleobases, 14 to 50 nucleobases, 14 to 40 nucleobases, 14 to 35 nucleobases, 14 to 30 nucleobases, 14 to 25 nucleobases, 14 to 20 nucleobases, 15 to 50 nucleobases, 15 to 40 nucleobases, 15 to 35 nucleobases, 15 to 30 nucleobases, 15 to 25 nucleobases, 15 to 20 nucleobases, 20 to 50 nucleobases, 20 to 40 nucleobases, 20 to 35 nucleobases, 20 to 30 nucleobases, 20 to 25 nucleobases, 25 to 50 nucleobases, 25 to 40 nucleobases, 25 to 35 nucleobases, or 25 to 30 nucleobases in length. In some embodiments, the ASOs are 30 nucleotides in length. In some embodiments, the ASOs are 29 nucleotides in length. In some embodiments, the ASOs are 28 nucleotides in length. In some embodiments, the ASOs are 27 nucleotides in length. In some embodiments, the ASOs are 26 nucleotides in length. In some embodiments, the ASOs are 25 nucleotides in length. In some embodiments, the ASOs are 24 nucleotides in length. In some embodiments, the ASOs are 23 nucleotides in length. In some embodiments, the ASOs are 22 nucleotides in length. In some embodiments, the ASOs are 21 nucleotides in length. In some embodiments, the ASOs are 20 nucleotides in length. In some embodiments, the ASOs are 19 nucleotides in length. In some embodiments, the ASOs are 18 nucleotides in length. In some embodiments, the ASOs are 17 nucleotides in length. In some embodiments, the ASOs are 16 nucleotides in length. In some embodiments, the ASOs are 15 nucleotides in length. In some embodiments, the ASOs are 14 nucleotides in length. In some embodiments, the ASOs are 13 nucleotides in length. In some embodiments, the ASOs are 12 nucleotides in length. In some embodiments, the ASOs are 11 nucleotides in length. In some embodiments, the ASOs are 10 nucleotides in length.

In some embodiments, two or more ASOs with different chemistries but complementary to the same targeted portion of the RIC pre-mRNA are used. In some embodiments, two or more ASOs that are complementary to different targeted portions of the RIC pre-mRNA are used.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

In some embodiments, the nucleic acid to be targeted by an ASO is a TSC2 RIC pre-mRNA expressed in a cell, such as a eukaryotic cell. In some embodiments, the term "cell" may refer to a population of cells. In some embodiments, the cell is in a subject. In some embodiments, the cell is isolated from a subject. In some embodiments, the cell is ex vivo. In some embodiments, the cell is a condition or disease-relevant cell or a cell line. In some embodiments, the cell is in vitro (e.g., in cell culture).

Pharmaceutical Compositions

Pharmaceutical compositions or formulations comprising the antisense oligonucleotide of the described compositions and for use in any of the described methods can be prepared according to conventional techniques well known in the pharmaceutical industry and described in the published literature. In embodiments, a pharmaceutical composition or formulation for treating a subject comprises an effective amount of any antisense oligomer as described above, or a pharmaceutically acceptable salt, solvate, hydrate or ester thereof, and a pharmaceutically acceptable diluent. The antisense oligomer of a pharmaceutical formulation may further comprise a pharmaceutically acceptable excipient, diluent or carrier.

Pharmaceutically acceptable salts are suitable for use in contact with the tissues of humans and lower animals without undue toxicity, irritation, allergic response, etc., and are commensurate with a reasonable benefit/risk ratio. (See, e.g., S. M. Berge, et al., J. Pharmaceutical Sciences, 66: 1-19 (1977), incorporated herein by reference for this purpose. The salts can be prepared in situ during the final isolation and purification of the compounds, or separately by reacting the free base function with a suitable organic acid. Examples of pharmaceutically acceptable, nontoxic acid addition salts are salts of an amino group formed with inorganic acids such as hydrochloric acid, hydrobromic acid, phosphoric acid, sulfuric acid and perchloric acid or with organic acids such as acetic acid, oxalic acid, maleic acid, tartaric acid, citric acid, succinic acid or malonic acid or by using other documented methodologies such as ion exchange. Other pharmaceutically acceptable salts include adipate, alginate, ascorbate, aspartate, benzenesulfonate, benzoate, bisulfate, borate, butyrate, camphorate, camphor sulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, lower alkyl sulfonate and aryl sulfonate.

In embodiments, the compositions are formulated into any of many possible dosage forms such as, but not limited to, tablets, capsules, gel capsules, liquid syrups, soft gels, suppositories, and enemas. In embodiments, the compositions are formulated as suspensions in aqueous, non-aqueous or mixed media. Aqueous suspensions may further contain substances that increase the viscosity of the suspension including, for example, sodium carboxymethylcellulose, sorbitol and/or dextran. The suspension may also contain stabilizers. In embodiments, a pharmaceutical formulation or composition of the present invention includes, but is not limited to, a solution, emulsion, microemulsion, foam or liposome-containing formulation (e.g., cationic or noncationic liposomes).

The pharmaceutical composition or formulation of the present invention may comprise one or more penetration enhancer, carrier, excipients or other active or inactive ingredients as appropriate and well known to those of skill in the art or described in the published literature. In embodiments, liposomes also include sterically stabilized liposomes, e.g., liposomes comprising one or more specialized lipids. These specialized lipids result in liposomes with enhanced circulation lifetimes. In embodiments, a sterically stabilized liposome comprises one or more glycolipids or is derivatized with one or more hydrophilic polymers, such as a polyethylene glycol (PEG) moiety. In embodiments, a surfactant is included in the pharmaceutical formulation or compositions. The use of surfactants in drug products, formulations and emulsions is well known in the art. In embodiments, the present invention employs a penetration enhancer to effect the efficient delivery of the antisense oligonucleotide, e.g., to aid diffusion across cell membranes and/or enhance the permeability of a lipophilic drug. In embodiments, the penetration enhancers are a surfactant, fatty acid, bile salt, chelating agent, or non-chelating non-surfactant.

In embodiments, the pharmaceutical formulation comprises multiple antisense oligonucleotides. In embodiments, the antisense oligonucleotide is administered in combination with another drug or therapeutic agent. In embodiments, the antisense oligonucleotide is administered with one or more agents capable of promoting penetration of the subject antisense oligonucleotide across the blood-brain barrier by any method known in the art. For example, delivery of agents by administration of an adenovirus vector to motor neurons in muscle tissue is described in U.S. Pat. No. 6,632,427, "Adenoviral-vector-mediated gene transfer into medullary motor neurons," incorporated herein by reference. Delivery of vectors directly to the brain, e.g., the striatum, the thalamus, the hippocampus, or the substantia nigra, is described, e.g., in U.S. Pat. No. 6,756,523, "Adenovirus vectors for the transfer of foreign genes into cells of the central nervous system particularly in brain," incorporated herein by reference.

In embodiments, the antisense oligonucleotides are linked or conjugated with agents that provide desirable pharmaceutical or pharmacodynamic properties. In embodiments, the antisense oligonucleotide is coupled to a substance, known in the art to promote penetration or transport across the blood-brain barrier, e.g., an antibody to the transferrin receptor. In embodiments, the antisense oligonucleotide is linked with a viral vector, e.g., to render the antisense compound more effective or increase transport across the blood-brain barrier. In embodiments, osmotic blood brain barrier disruption is assisted by infusion of sugars, e.g., meso erythritol, xylitol, D(+) galactose, D(+) lactose, D(+) xylose, dulcitol, myo-inositol, L(−) fructose, D(−) mannitol, D(+) glucose, D(+) arabinose, D(−) arabinose, cellobiose, D(+) maltose, D(+) raffinose, L(+) rhamnose, D(+) melibiose, D(−) ribose, adonitol, D(+) arabitol, L(−) arabitol, D(+) fucose, L(−) fucose, D(−) lyxose, L(+) lyxose, and L(−) lyxose, or amino acids, e.g., glutamine, lysine, arginine, asparagine, aspartic acid, cysteine, glutamic acid, glycine, histidine, leucine, methionine, phenylalanine, proline, serine, threonine, tyrosine, valine, and taurine. Methods and materials for enhancing blood brain barrier penetration are described, e.g., in U.S. Pat. No. 4,866,042, "Method for the delivery of genetic material across the blood brain barrier," U.S. Pat. No. 6,294,520, "Material for passage through the blood-brain barrier," and U.S. Pat. No. 6,936,589, "Parenteral delivery systems," each incorporated herein by reference.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties, and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

Treatment of Subjects

Any of the compositions provided herein may be administered to an individual. "Individual" may be used interchangeably with "subject" or "patient." An individual may be a mammal, for example a human or animal such as a non-human primate, a rodent, a rabbit, a rat, a mouse, a horse, a donkey, a goat, a cat, a dog, a cow, a pig, or a sheep. In embodiments, the individual is a human. In embodiments, the individual is a fetus, an embryo, or a child. In other embodiments, the individual may be another eukaryotic organism, such as a plant. In some embodiments, the compositions provided herein are administered to a cell ex vivo.

In some embodiments, the compositions provided herein are administered to an individual as a method of treating a disease or disorder. In some embodiments, the individual has a genetic disease, such as any of the diseases described herein. In some embodiments, the individual is at risk of having the disease, such as any of the diseases described herein. In some embodiments, the individual is at increased risk of having a disease or disorder caused by insufficient amount of a protein or insufficient activity of a protein. If an individual is "at an increased risk" of having a disease or disorder caused insufficient amount of a protein or insufficient activity of a protein, the method involves preventative or prophylactic treatment. For example, an individual may be at an increased risk of having such a disease or disorder because of family history of the disease. Typically, individuals at an increased risk of having such a disease or disorder benefit from prophylactic treatment (e.g., by preventing or delaying the onset or progression of the disease or disorder).

Suitable routes for administration of ASOs of the present invention may vary depending on cell type to which delivery of the ASOs is desired. Multiple tissues and organs are affected by tuberous sclerosis complex, with the brain, kidney, skin, lung and heart being the most significantly affected tissues. The ASOs of the present invention may be administered to patients topically to the skin or by pulmonary delivery to the lung. The ASOs of the present invention may be administered to patients parenterally, for example, by intrathecal injection, intracerebroventricular injection, intraperitoneal injection, intramuscular injection, subcutaneous injection, or intravenous injection. In embodiments, delivery is to the brain, kidney, skin, lung or heart. In embodiments, a fetus is treated in utero, e.g., by administering the ASO composition to the fetus directly or indirectly (e.g., via the mother).

Methods of Identifying Additional ASOs that Enhance Splicing

Also within the scope of the present invention are methods for identifying (determining) additional ASOs that enhance splicing of a TSC2 RIC pre-mRNA, specifically at the target intron. ASOs that specifically hybridize to different nucleotides within the target region of the pre-mRNA may be screened to identify (determine) ASOs that improve the rate and/or extent of splicing of the target intron. In some embodiments, the ASO may block or interfere with the binding site(s) of a splicing repressor(s)/silencer. Any method known in the art may be used to identify (determine) an ASO that when hybridized to the target region of the intron results in the desired effect (e.g., enhanced splicing, protein or functional RNA production). These methods also can be used for identifying ASOs that enhance splicing of the retained intron by binding to a targeted region in an exon flanking the retained intron, or in a non-retained intron. An example of a method that may be used is provided below.

A round of screening, referred to as an ASO "walk" may be performed using ASOs that have been designed to hybridize to a target region of a pre-mRNA. For example, the ASOs used in the ASO walk can be tiled every 5 nucleotides from approximately 100 nucleotides upstream of the 5' splice site of the retained intron (e.g., a portion of sequence of the exon located upstream of the target/retained intron) to approximately 100 nucleotides downstream of the 5' splice site of the target/retained intron and/or from approximately 100 nucleotides upstream of the 3' splice site of the retained intron to approximately 100 nucleotides downstream of the 3' splice site of the target/retained intron (e.g., a portion of sequence of the exon located downstream of the target/retained intron). For example, a first ASO of 15 nucleotides in length may be designed to specifically hybridize to nucleotides +6 to +20 relative to the 5' splice site of the target/retained intron. A second ASO is designed to specifically hybridize to nucleotides +11 to +25 relative to the 5' splice site of the target/retained intron. ASOs are designed as such spanning the target region of the pre-mRNA. In embodiments, the ASOs can be tiled more closely, e.g., every 1, 2, 3, or 4 nucleotides. Further, the ASOs can be tiled from 100 nucleotides downstream of the 5' splice site, to 100 nucleotides upstream of the 3' splice site.

One or more ASOs, or a control ASO (an ASO with a scrambled sequence, sequence that is not expected to hybridize to the target region) are delivered, for example by transfection, into a disease-relevant cell line that expresses the target pre-mRNA (e.g., the RIC pre-mRNA described elsewhere herein). The splicing-inducing effects of each of the ASOs may be assessed by any method known in the art, for example by reverse transcriptase (RT)-PCR using primers that span the splice junction, as described herein (see "Identification of intron-retention events"). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

A second round of screening, referred to as an ASO "micro-walk" may be performed using ASOs that have been designed to hybridize to a target region of a pre-mRNA. The ASOs used in the ASO micro-walk are tiled every 1 nucleotide to further refine the nucleotide acid sequence of the pre-mRNA that when hybridized with an ASO results in enhanced splicing.

Regions defined by ASOs that promote splicing of the target intron are explored in greater detail by means of an ASO "micro-walk", involving ASOs spaced in 1-nt steps, as well as longer ASOs, typically 18-25 nt.

As described for the ASO walk above, the ASO micro-walk is performed by delivering one or more ASOs, or a control ASO (an ASO with a scrambled sequence, sequence that is not expected to hybridize to the target region), for example by transfection, into a disease-relevant cell line that expresses the target pre-mRNA. The splicing-inducing effects of each of the ASOs may be assessed by any method known in the art, for example by reverse transcriptase (RT)-PCR using primers that span the splice junction, as described herein (see "Identification of intron-retention events"). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

ASOs that when hybridized to a region of a pre-mRNA result in enhanced splicing and increased protein production may be tested in vivo using animal models, for example transgenic mouse models in which the full-length human gene has been knocked-in or in humanized mouse models of disease. Suitable routes for administration of ASOs may vary depending on the disease and/or the cell types to which delivery of the ASOs is desired. ASOs may be administered, for example, by topical application to the skin, pulmonary delivery to the lung, intrathecal injection, intracerebroventricular injection, intraperitoneal injection, intramuscular injection, subcutaneous injection, or intravenous injection. Following administration, the cells, tissues, and/or organs of the model animals may be assessed to determine the effect of the ASO treatment by for example evaluating splicing (efficiency, rate, extent) and protein production by methods known in the art and described herein. The animal models may also be any phenotypic or behavioral indication of the disease or disease severity.

Compositions and Methods for Treatment of Polycystic Kidney Disease

Individual introns in primary transcripts of protein-coding genes having more than one intron are spliced from the primary transcript with different efficiencies. In most cases only the fully spliced mRNA is exported through nuclear pores for subsequent translation in the cytoplasm. Unspliced and partially spliced transcripts are detectable in the nucleus. It is generally thought that nuclear accumulation of transcripts that are not fully spliced is a mechanism to prevent the accumulation of potentially deleterious mRNAs in the cytoplasm that may be translated to protein. For some genes, splicing of the least efficient intron is a rate-limiting post-transcriptional step in gene expression, prior to translation in the cytoplasm.

Substantial levels of partially-spliced transcripts of the PKD2 gene, which encodes the PC-2 protein that is deficient in the debilitating genetic disease, Polycystic Kidney Disease, have been discovered in the nucleus of human cells. These PKD2 pre-mRNA species comprise at least one retained intron. The present invention provides compositions and methods for upregulating splicing of one or more retained PKD2 introns that are rate-limiting for the nuclear stages of gene expression to increase steady-state production of fully-spliced, mature mRNA, and thus, translated PC-2 protein levels. These compositions and methods utilize antisense oligomers (ASOs) that promote constitutive splicing at an intron splice site of a retained-intron-containing PKD2 pre-mRNA that accumulates in the nucleus. Thus, in embodiments, PC-2 protein is increased using the methods of the invention to treat a disease caused by PC-2 deficiency.

In other embodiments, the methods of the invention are used to increase PC-2 production to treat a condition in a subject in need thereof. In embodiments, the subject has condition in which PC-2 is not necessarily deficient relative to wild-type, but where an increase in PC-2 mitigates the condition nonetheless. In embodiments, the condition is a caused by a PC-2 haploinsufficiency.

Polycystic Kidney Disease

Polycystic Kidney Disease (PKD) is an autosomal dominant multisystem disorder characterized by the evolution of renal cysts and a variety of extrarenal manifestations (Torres and Harris, 2009). The main clinical and pathological findings are renal disease due to the development and enlargement of renal cysts, which results in renal manifestations such an increase in kidney volume that correlates directly with the increase in the cyst volume. Other PKD manifestations include hypertension; endothelial vasodilation; constrictive nitric oxide synthase activity; polycystic liver disease; vascular manifestations including intracranial aneurysms, thoracic aortic dissections and coronary artery aneurysms; and progressive renal failure that leads to end-stage renal disease (ESRD) by age 70. While PKD can be diagnosed in utero or at birth through the use of fetal ultrasonography, PKD is classically diagnosed later in life through the detection of renal cysts as determined by renal ultrasound. The worldwide PKD prevalence is estimated to be between 1:400 and 1:1000, with a male/female sex ratio of ~1.2 (Torres and Harris, 2009).

Mutations in either the PKD1 or PKD2 gene have been reported to cause PKD. Mutations in PKD1 typically manifest earlier in life than mutations in PKD2 (age at ESRD 54.3 vs. 74.0 years for PKD1 and PKD2, respectively) and typically result in a more severe disease state due to the appearance of cysts at a younger age (Torres and Harris, 2009). Due to this difference in pathophysiology, the late onset form of PKD generally arises from mutations in the PKD2 gene. PKD2 encodes the PC-2 protein, a 968 amino acid protein containing a short N-terminal cytoplasmic region with a ciliary motif, 6 transmembrane domains and a short C-terminal portion. The human genomic sequence of the PKD2 gene is set forth at NCBI Gene ID 5311, and the protein at UniProtKB/Swiss-Prot: Q13563-1, described by, e.g., Mochizuki T, et al., 1996, "PKD2, a gene for polycystic kidney disease that encodes an integral membrane protein," Science 272:1339-1342, incorporated by reference herein. The PKD2 mRNA sequence is set forth at NCBI Reference Sequence: NM_000297.3.2, described by Yang Y, et al., 2015, "Oligomerization of the polycystin-2 C-terminal tail and effects on its Ca2+ binding properties," J. Bio. Chem. 290 (16), 10544-10554, both incorporated by reference herein. Mutations in PKD2 cause late onset autosomal dominant PKD (ADPKD), the most prevalent of the inherited renal cystic diseases.

The PKD2 gene consists of 15 exons and is located on chromosome 4p22.1. PKD2 mutations in PKD are spread across the entire protein, with 95 truncating mutations of PKD2 reported in the ADPKD Mutation Database (maintained by the PKD Foundation, 8330 Ward Parkway, Suite 510, Kansas City, Mo. 64114). Because a homozygous deficiency in PKD2 is predicted to be incompatible with live birth, haploinsufficiency is the most likely mechanism of ADPKD disease manifestation (Torres and Harris, 2009). Mutations such as nonsense and insertions/deletions are associated with the classic ADPKD2 phenotype display functional haploinsufficiency. A PKD missense mutation that results in expression of the PC-2-D511V protein was predicted to be indistinguishable from wild-type PC-2 in terms of stability (Reynolds, et al., 1999, J. Am. Soc. Nephrol. 10: 2342-2351). The PC-2-D511V variant, despite its stability, was shown to be dysfunctional due to a predicted disruption in its ability to act as an ion channel. Thus, even stable variants can cause the phenotype if the nascent activity is disrupted. The disease is described, e.g., by OMIM #613095 (Online Mendelian Inheritance in Man, Johns Hopkins University, 1966-2015), incorporated by reference herein.

Retained Intron Containing Pre-mRNA (RIC Pre-mRNA)

In embodiments, the methods disclosed herein exploit the presence of retained-intron-containing pre-mRNA (RIC pre-mRNA) transcribed from the PKD2 gene and encoding PC-2 protein, in the cell nucleus. Splicing of the identified PKD2 RIC pre-mRNA species to produce mature, fully-spliced, PKD2 mRNA, is induced using ASOs that stimulate splicing out of the retained introns. The resulting mature PKD2 mRNA can be exported to the cytoplasm and translated, thereby increasing the amount of PC-2 protein in the patient's cells and alleviating symptoms of Polycystic Kidney Disease. This method, described further below, is known as Targeted Augmentation of Nuclear Gene Output (TANGO).

PKD2 Nuclear Transcripts

Figure 29:
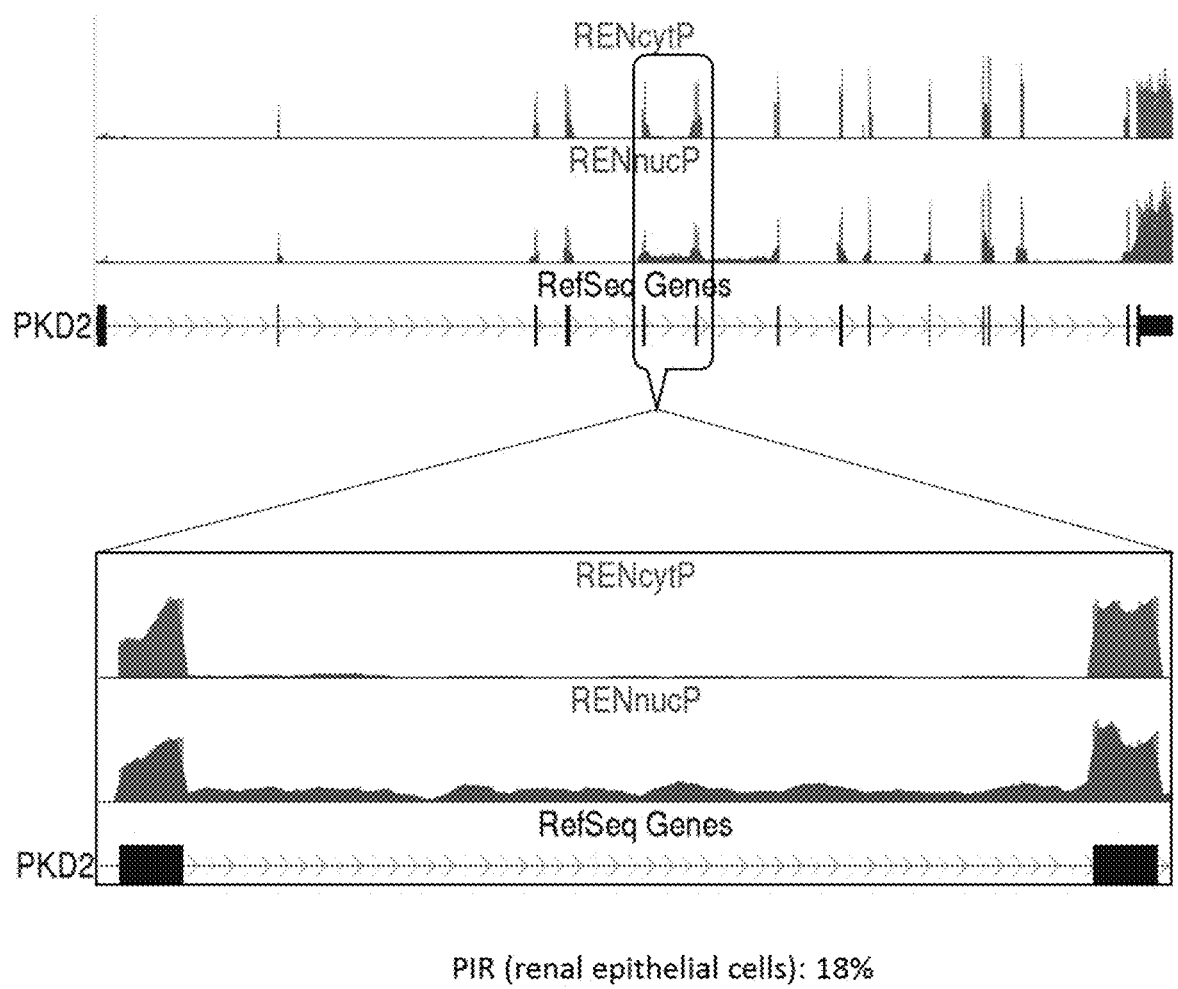
FIG. 29 depicts a schematic of the RefSeq Gene for PKD2 corresponding to NM_000297. The Percent Intron Retention (PIR) of intron 5 is detailed.
Figure 30:
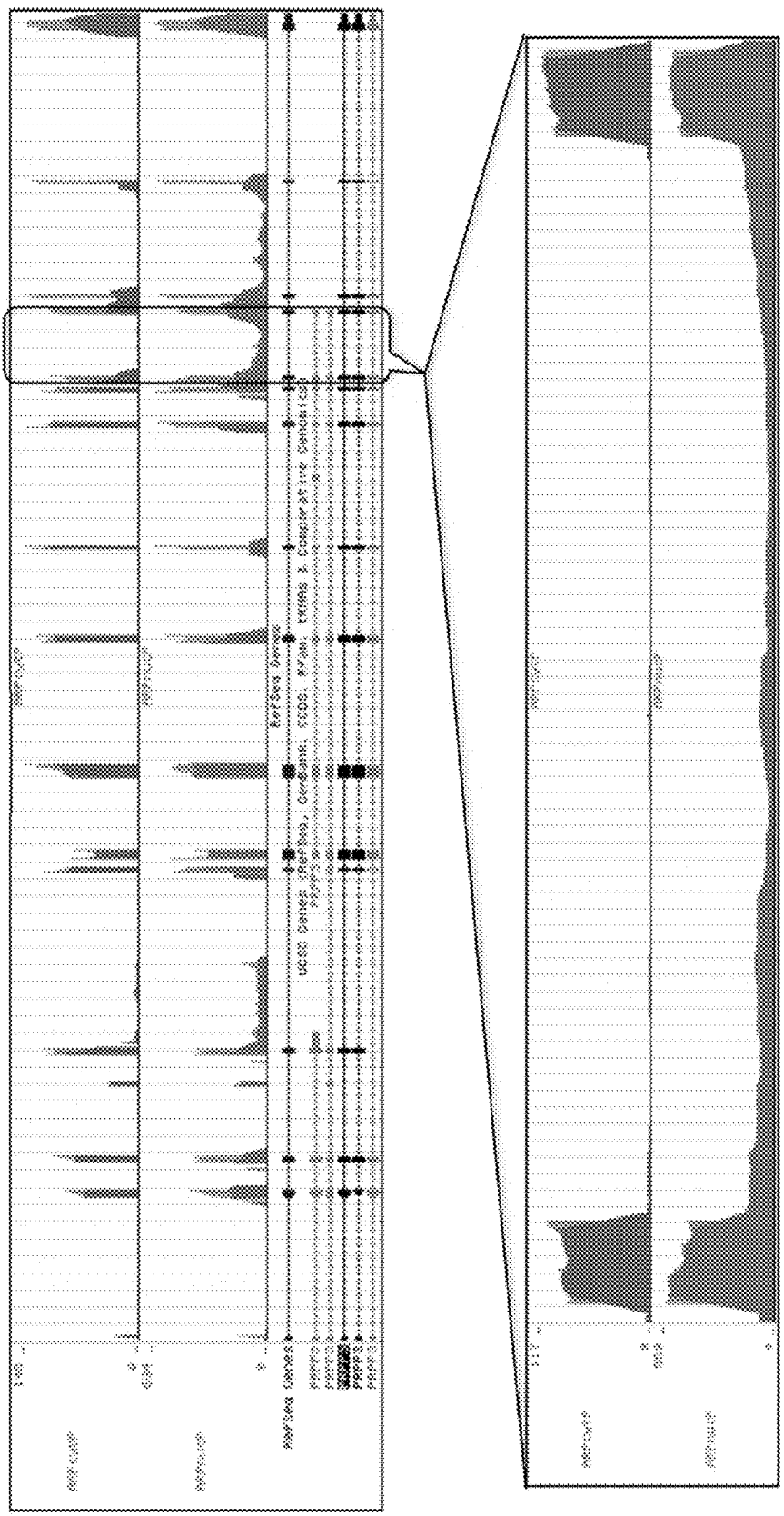
FIG. 30 depicts intron-retention in the PRPF3 gene with intron 12 detail. The identification of intron-retention events in the PRPF3 gene using RNA sequencing (RNAseq) is shown, visualized in the UCSC genome browser. The upper panel shows the read density corresponding to the PRPF3 transcript expressed in ARPE-19 (retina epithelial) cells and localized in either the cytoplasmic (top) or nuclear fraction (bottom). At the bottom of this panel, a graphic representation of the PRPF3 gene is shown to scale. The read density is shown as peaks. The highest read density corresponds to exons (black boxes), while no reads are observed for the majority of the introns (lines with arrow heads) in either cellular fraction. Higher read density is detected for intron 12 (indicated by the arrow) in the nuclear fraction compared to the cytoplasmic fraction indicating that splicing efficiency of intron 12 is low, resulting in intron retention. The retained-intron containing pre-mRNA transcripts are retained in the nucleus and are not exported out to the cytoplasm. The read density for intron 12 in renal epithelial cells is shown in detail in the lower panel.

As described herein in the Examples, the PKD2 gene was analyzed for intron-retention events and retention of intron 5 was observed. RNA sequencing (RNAseq), visualized in the UCSC genome browser, showed PKD2 transcripts expressed in renal epithelial cells and localized in either the cytoplasmic or nuclear fraction. In both fractions, reads were not observed for the majority of the introns. However, higher read density was detected for intron 5 in the nuclear fraction compared to the cytoplasmic fraction indicating that splicing efficiency of intron 5 is low, resulting in intron retention. The retained-intron containing pre-mRNA transcripts accumulate primarily in the nucleus and are not translated into the PC-2 protein. The read density for intron 5 indicated 18% intron retention (FIG. 29). The percent intron retention (PIR) value for intron 5 was obtained by averaging four values (23, 13, 22, and 14), each determined in renal epithelial cells using one of four different algorithms. Analysis of the ENCODE data (described by, e.g., Tilgner, et al., 2012, "Deep sequencing of subcellular RNA fractions shows splicing to be predominantly co-transcriptional in the human genome but inefficient for lncRNAs," Genome Research 22(9):1616-25) to identify intron retention events did not identify intron 5 as retained.

In some embodiments, the ASOs disclosed herein target a RIC pre-mRNA transcribed from a PKD2 genomic sequence. In some embodiments, the ASO targets a RIC pre-mRNA transcript from a PKD2 genomic sequence comprising retained intron 5. In some embodiments, the ASO targets a RIC pre-mRNA transcript of SEQ ID NO: 5545. In some embodiments, the ASO targets a RIC pre-mRNA transcript of SEQ ID NO: 5545 comprising a retained intron 5. In some embodiments, the ASOs disclosed herein target aPKD2 RIC pre-mRNA sequence. In some embodiments, the ASO targets aPKD2 RIC pre-mRNA sequence comprising a retained intron 5. In some embodiments, the ASO targets aPKD2 RIC pre-mRNA sequence according to SEQ ID NO: 5546. In some embodiments, the ASO targets aPKD2 RIC pre-mRNA sequence according to SEQ ID NO: 5546 comprising a retained intron 5. In some embodiments, the ASOs disclosed herein target SEQ ID NO: 5825. In some embodiments, the ASO has a sequence according to any one of SEQ ID NOs: 5547-5824.

In some embodiments, the ASO targets exon 5 of a PKD2 RIC pre-mRNA comprising a retained intron 5. In some embodiments, the ASO targets an exon 5 sequence upstream (or 5') from the 5' splice site of a PKD2 RIC pre-mRNA comprising a retained intron 5. In some embodiments, the ASO targets an exon sequence about 4 to about 204 nucleotides upstream (or 5') from the 5' splice site of a PKD2 RIC pre-mRNA comprising a retained intron 5. In some embodiments, the ASO has a sequence according to any one of SEQ ID NOs: 5547-5587.

In some embodiments, the ASO targets intron 5 in a PKD2 RIC pre-mRNA comprising a retained intron 5. In some embodiments, the ASO targets an intron 5 sequence downstream (or 3') from the 5' splice site of a PKD2 RIC pre-mRNA comprising a retained intron 5. In some embodiments, the ASO targets an intron 5 sequence about 6 to about 497 nucleotides downstream (or 3') from the 5' splice site of a PKD2 RIC pre-mRNA comprising a retained intron 5. In some embodiments, the ASO has a sequence according to any one of SEQ ID NOs: 5588-5684.

In some embodiments, the ASO targets an intron 5 sequence upstream (or 5') from the 3' splice site of a PKD2 RIC pre-mRNA comprising a retained intron 5. In some embodiments, the ASO targets an intron 5 sequence about 16 to about 496 nucleotides upstream (or 5') from the 3' splice site of a PKD2 RIC pre-mRNA a comprising retained intron 5. In some embodiments, the ASO has a sequence according to any one of SEQ ID NOs: 5685-5781.

In some embodiments, the ASO targets exon 6 in a PKD2 RIC pre-mRNA comprising a retained intron 5. In some embodiments, the ASO targets an exon 6 sequence downstream (or 3') from the 3' splice site of a PKD2 RIC pre-mRNA comprising a retained intron 5. In some embodiments, the ASO targets an exon 6 sequence about 2 to about 212 nucleotides downstream (or 3') from the 3' splice site of a PKD2 RIC pre-mRNA comprising a retained intron 5. In some embodiments, the ASO has a sequence according to any one of SEQ ID NOs: 5782-5824.

In embodiments, the targeted portion of the PKD2 RIC pre-mRNA is in intron 5. The PKD2 intron numbering used herein corresponds to the mRNA sequence at NM_000297.3. In embodiments, hybridization of an ASO to the targeted portion of the RIC pre-mRNA results in enhanced splicing at the splice site (5' splice site or 3' splice site) of retained intron 5 and subsequently increases PC-2 protein production. It is understood that the intron numbering may change in reference to a different PKD2 mRNA isoform sequence. One of skill in the art can determine the corresponding intron number in any PKD2 isoform based on an intron sequence provided herein or using the intron number provided in reference to the mRNA sequence at NM_000297.3. One of skill in the art also can determine the sequences of flanking exons in any PKD2 isoform for targeting using the methods of the invention, based on an intron sequence provided herein or using the intron number provided in reference to the mRNA sequence at NM_000297.3. In embodiments, the compositions and methods of the present invention are used to increase the expression of any known PKD2 isoform, e.g., as described in the NCBI Gene ID database at Gene ID 5311 (NCBI repository of biological and scientific information, operated by National Center for Biotechnology Information, National Library of Medicine, 8600 Rockville Pike, Bethesda, Md. USA 20894), incorporated by reference herein.

PC-2 Protein Expression

As described above, PC-2 mutations in ADPKD are spread across the entire protein, with 95 PC-2 truncating mutations having been reported in the ADPKD Mutation Database (PKD Foundation).

In embodiments, the methods described herein are used to increase the production of a functional PC-2 protein. As used herein, the term "functional" refers to the amount of activity or function of a PC-2 protein that is necessary to eliminate any one or more symptoms of a treated condition, e.g., Polycystic Kidney Disease. In embodiments, the methods are used to increase the production of a partially functional PC-2 protein. As used herein, the term "partially functional" refers to any amount of activity or function of the PC-2 protein that is less than the amount of activity or function that is necessary to eliminate or prevent any one or more symptoms of a disease or condition. In some embodiments, a partially functional protein or RNA will have at least 10%, at least 20%, at least 30%, at least 40%, at least 50%, at least 60%, at least 70%, at least 75%, at least 80%, 85%, at least 90%, or at least 95% less activity relative to the fully functional protein or RNA.

In embodiments, the method is a method of increasing the expression of the PC-2 protein by cells of a subject having a RIC pre-mRNA encoding the PC-2 protein, wherein the subject has Polycystic Kidney Disease caused by a deficient amount of activity of PC-2 protein, and wherein the deficient amount of the PC-2 protein is caused by haploinsufficiency of the PC-2 protein. In such an embodiment, the subject has a first allele encoding a functional PC-2 protein, and a second allele from which the PC-2 protein is not produced. In another such embodiment, the subject has a first allele encoding a functional PC-2 protein, and a second allele encoding a nonfunctional PC-2 protein. In another such embodiment, the subject has a first allele encoding a functional PC-2 protein, and a second allele encoding a partially functional PC-2 protein. In any of these embodiments, the antisense oligomer binds to a targeted portion of the RIC pre-mRNA transcribed from the first allele (encoding functional PC-2 protein), thereby inducing constitutive splicing of the retained intron from the RIC pre-mRNA, and causing an increase in the level of mature mRNA encoding functional PC-2 protein, and an increase in the expression of the PC-2 protein in the cells of the subject.

In embodiments, the subject has a first allele encoding a functional PC-2 protein, and a second allele encoding a partially functional PC-2 protein, and the antisense oligomer binds to a targeted portion of the RIC pre-mRNA transcribed from the first allele (encoding functional PC-2 protein) or a targeted portion of the RIC pre-mRNA transcribed from the second allele (encoding partially functional PC-2 protein), thereby inducing constitutive splicing of the retained intron from the RIC pre-mRNA, and causing an increase in the level of mature mRNA encoding the PC-2 protein, and an increase in the expression of functional or partially functional PC-2 protein in the cells of the subject.

In related embodiments, the method is a method of using an ASO to increase the expression of a protein or functional RNA. In embodiments, an ASO is used to increase the expression of PC-2 protein in cells of a subject having a RIC pre-mRNA encoding PC-2 protein, wherein the subject has a deficiency, e.g., Polycystic Kidney Disease, in the amount or function of a PC-2 protein.

In embodiments, the RIC pre-mRNA transcript that encodes the protein that is causative of the disease or condition is targeted by the ASOs described herein. In some embodiments, a RIC pre-mRNA transcript that encodes a protein that is not causative of the disease is targeted by the ASOs. For example, a disease that is the result of a mutation or deficiency of a first protein in a particular pathway may be ameliorated by targeting a RIC pre-mRNA that encodes a second protein, thereby increasing production of the second protein. In some embodiments, the function of the second protein is able to compensate for the mutation or deficiency of the first protein.

In embodiments, the subject has:
  (a) a first mutant allele from which
    i) the PC-2 protein is produced at a reduced level compared to production from a wild-type allele,
    ii) the PC-2 protein is produced in a form having reduced function compared to an equivalent wild-type protein, or
    iii) the PC-2 protein or functional RNA is not produced; and
  (b) a second mutant allele from which
    i) the PC-2 protein is produced at a reduced level compared to production from a wild-type allele,
    ii) the PC-2 protein is produced in a form having reduced function compared to an equivalent wild-type protein, or
    iii) the PC-2 protein is not produced, and
wherein the RIC pre-mRNA is transcribed from the first allele and/or the second allele. In these embodiments, the ASO binds to a targeted portion of the RIC pre-mRNA transcribed from the first allele or the second allele, thereby inducing constitutive splicing of the retained intron from the RIC pre-mRNA, and causing an increase in the level of mRNA encoding PC-2 protein and an increase in the expression of the target protein or functional RNA in the cells of the subject. In these embodiments, the target protein or functional RNA having an increase in expression level resulting from the constitutive splicing of the retained intron from the RIC pre-mRNA is either in a form having reduced function compared to the equivalent wild-type protein (partially-functional), or having full function compared to the equivalent wild-type protein (fully-functional).

In embodiments, the level of mRNA encoding PC-2 protein is increased 1.1 to 10-fold, when compared to the amount of mRNA encoding PC-2 that is produced in a control cell, e.g., one that is not treated with the antisense oligomer or one that is treated with an antisense oligomer that does not bind to the targeted portion of the PKD2 RIC pre-mRNA.

In embodiments, the condition caused by a deficient amount or activity of PC-2 protein is not a condition caused by alternative or aberrant splicing of the retained intron to which the ASO is targeted. In embodiments, the condition caused by a deficient amount or activity of the PC-2 protein is not a condition caused by alternative or aberrant splicing of any retained intron in a RIC pre-mRNA encoding the PC-2 protein. In embodiments, alternative or aberrant splicing may occur in a pre-mRNA transcribed from the gene, however the compositions and methods of the invention do not prevent or correct this alternative or aberrant splicing in the pre-mRNA.

In embodiments, a subject treated using the methods of the invention expresses a partially functional PC-2 protein from one allele, wherein the partially functional PC-2 protein is caused by a frameshift mutation, a nonsense mutation, a missense mutation, or a partial gene deletion. In embodiments, a subject treated using the methods of the invention expresses a nonfunctional PC-2 protein from one allele, wherein the nonfunctional PC-2 protein is caused by a frameshift mutation, a nonsense mutation, a missense mutation, a partial gene deletion, in one allele. In embodiments, a subject treated using the methods of the invention has a PKD2 whole gene deletion, in one allele.

In embodiments, the subject has a PC-2 missense mutation selected from M1K, P24L, R28P, A35D, R60N, S80L, Q107D, R119H, G121A, G135V, A147V, A190T, V262M, W292C, R306Q, L314V, R322W, R322Q, R325P, R325Q, C331S, S332A, Y324C, S349P, A356P, A384P, G390S, W414G, G418V, T419A, R420G, A421S, R440S, T448K, I452V, F482C, Y487H, D511V, V516L, L517R, V519M, A552P, I556V, N578D, N580K, M583I, A615T, F629S, C632R, R638C, L656W, L715I, I758V, R798C, M800L, S804N, R807Q, R848Q, D886G, R893G, V909I, D919N, T931M, R945H or S949F. In embodiments, the subject has a PC-2 deletion mutation selected from EX1 EX13del, IVS2_3'(ABCG2)del80kb*, IVS2_3'(ABCG2)del98kb, IVS4+1452 IVS5-965del5722, S378del, F605del, IVS9_3'del28kb, 2182_2183delAG, L736_N737del2 or R878del. In embodiments, the subject has PC-2 duplication mutation Ex3dup*. In embodiments, a subject having any PC-2 mutation known in the art and described in the literature, e.g., by Chang, et al., 2005, Ren Fail 27: 95-100, is treated using the methods and compositions of the present invention.

Use of TANGO for Increasing PC-2 Protein Expression

As described above, in embodiments, Targeted Augmentation of Nuclear Gene Output (TANGO) is used in the methods of the invention to increase expression of a PC-2 protein. In these embodiments, a retained-intron-containing pre-mRNA (RIC pre-mRNA) encoding PC-2 protein is present in the nucleus of a cell. Cells having a PKD2 RIC pre-mRNA that comprises a retained intron, an exon flanking the 5' splice site, and an exon flanking the 3' splice site, encoding the PC-2 protein, are contacted with antisense oligomers (ASOs) that are complementary to a targeted portion of the RIC pre-mRNA. Hybridization of the ASOs to the targeted portion of the RIC pre-mRNA results in enhanced splicing at the splice site (5' splice site or 3' splice site) of the retained intron and subsequently increases target protein production.

The terms "pre-mRNA," and "pre-mRNA transcript" may be used interchangeably and refer to any pre-mRNA species that contains at least one intron. In embodiments, pre-mRNA or pre-mRNA transcripts comprise a 5'-7-methylguanosine cap and/or a poly-A tail. In embodiments, pre-mRNA or pre-mRNA transcripts comprise both a 5'-7-methylguanosine cap and a poly-A tail. In some embodiments, the pre-mRNA transcript does not comprise a 5'-7-methylguanosine cap and/or a poly-A tail. A pre-mRNA transcript is a non-productive messenger RNA (mRNA) molecule if it is not translated into a protein (or transported into the cytoplasm from the nucleus).

As used herein, a "retained-intron-containing pre-mRNA" ("RIC pre-mRNA") is a pre-mRNA transcript that contains at least one retained intron. The RIC pre-mRNA contains a retained intron, an exon flanking the 5' splice site of the retained intron, an exon flanking the 3' splice site of the retained intron, and encodes the target protein. An "RIC pre-mRNA encoding a target protein" is understood to encode the target protein when fully spliced. A "retained intron" is any intron that is present in a pre-mRNA transcript when one or more other introns, such as an adjacent intron, encoded by the same gene have been spliced out of the same pre-mRNA transcript. In some embodiments, the retained intron is the most abundant intron in RIC pre-mRNA encoding the target protein. In embodiments, the retained intron is the most abundant intron in a population of RIC pre-mRNAs transcribed from the gene encoding the target protein in a cell, wherein the population of RIC pre-mRNAs comprises two or more retained introns. In embodiments, an antisense oligomer targeted to the most abundant intron in the population of RIC pre-mRNAs encoding the target protein induces splicing out of two or more retained introns in the population, including the retained intron to which the antisense oligomer is targeted or binds. In embodiments, a mature mRNA encoding the target protein is thereby produced. The terms "mature mRNA," and "fully-spliced mRNA," are used interchangeably herein to describe a fully processed mRNA encoding a target protein (e.g., mRNA that is exported from the nucleus into the cytoplasm and translated into target protein) or a fully processed functional RNA. The term "productive mRNA," also can be used to describe a fully processed mRNA encoding a target protein. In embodiments, the targeted region is in a retained intron that is the most abundant intron in a RIC pre-mRNA encoding the PC-2 protein. In embodiments, the most retained intron in a RIC pre-mRNA encoding the PC-2 protein is intron 5.

In embodiments, a retained intron is an intron that is identified as a retained intron based on a determination of at least about 5%, at least about 10%, at least about 15%, at least about 20%, at least about 25%, at least about 30%, at least about 35%, at least about 40%, at least about 45%, or at least about 50%, retention. In embodiments, a retained intron is an intron that is identified as a retained intron based on a determination of about 5% to about 100%, about 5% to about 95%, about 5% to about 90%, about 5% to about 85%, about 5% to about 80%, about 5% to about 75%, about 5% to about 70%, about 5% to about 65%, about 5% to about 60%, about 5% to about 55%, about 5% to about 50%, about 5% to about 45%, about 5% to about 40%, about 5% to about 35%, about 5% to about 30%, about 5% to about 25%, about 5% to about 20%, about 5% to about 15%, about 10% to about 100%, about 10% to about 95%, about 10% to about 90%, about 10% to about 85%, about 10% to about 80%, about 10% to about 75%, about 10% to about 70%, about 10% to about 65%, about 10% to about 60%, about 10% to about 55%, about 10% to about 50%, about 10% to about 45%, about 10% to about 40%, about 10% to about 35%, about 10% to about 30%, about 10% to about 25%, about 10% to about 20%, about 15% to about 100%, about 15% to about 95%, about 15% to about 90%, about 15% to about 85%, about 15% to about 80%, about 15% to about 75%, about 15% to about 70%, about 15% to about 65%, about 15% to about 60%, about 15% to about 55%, about 15% to about 50%, about 15% to about 45%, about 15% to about 40%, about 15% to about 35%, about 15% to about 30%, about 15% to about 25%, about 20% to about 100%, about 20% to about 95%, about 20% to about 90%, about 20% to about 85%, about 20% to about 80%, about 20% to about 75%, about 20% to about 70%, about 20% to about 65%, about 20% to about 60%, about 20% to about 55%, about 20% to about 50%, about 20% to about 45%, about 20% to about 40%, about 20% to about 35%, about 20% to about 30%, about 25% to about 100%, about 25% to about 95%, about 25% to about 90%, about 25% to about 85%, about 25% to about 80%, about 25% to about 75%, about 25% to about 70%, about 25% to about 65%, about 25% to about 60%, about 25% to about 55%, about 25% to about 50%, about 25% to about 45%, about 25% to about 40%, or about 25% to about 35%, retention.

As used herein, the term "comprise" or variations thereof such as "comprises" or "comprising" are to be read to indicate the inclusion of any recited feature (e.g., in the case of an antisense oligomer, a defined nucleobase sequence) but not the exclusion of any other features. Thus, as used herein, the term "comprising" is inclusive and does not exclude additional, unrecited features (e.g., in the case of an antisense oligomer, the presence of additional, unrecited nucleobases).

In embodiments of any of the compositions and methods provided herein, "comprising" may be replaced with "consisting essentially of" or "consisting of" The phrase "consisting essentially of" is used herein to require the specified feature(s) (e.g., nucleobase sequence) as well as those which do not materially affect the character or function of the claimed invention. As used herein, the term "consisting" is used to indicate the presence of the recited feature (e.g., nucleobase sequence) alone (so that in the case of an antisense oligomer consisting of a specified nucleobase sequence, the presence of additional, unrecited nucleobases is excluded).

In embodiments, an ASO is complementary to a targeted region that is within a non-retained intron in a RIC pre-mRNA. In embodiments, the targeted portion of the RIC pre-mRNA is within: the region +6 to +100 relative to the 5' splice site of the non-retained intron; or the region −16 to −100 relative to the 3' splice site of the non-retained intron. In embodiments, the targeted portion of the RIC pre-mRNA is within the region +100 relative to the 5' splice site of the non-retained intron to −100 relative to the 3' splice site of the non-retained intron. As used to identify the location of a region or sequence, "within" is understood to include the residues at the positions recited. For example, a region +6 to +100 includes the residues at positions +6 and +100. In embodiments, fully-spliced (mature) RNA encoding the target protein is thereby produced.

In embodiments, the retained intron of the RIC pre-mRNA is an inefficiently spliced intron. As used herein, "inefficiently spliced" may refer to a relatively low frequency of splicing at a splice site adjacent to the retained intron (5' splice site or 3' splice site) as compared to the frequency of splicing at another splice site in the RIC pre-mRNA. The term "inefficiently spliced" may also refer to the relative rate or kinetics of splicing at a splice site, in which an "inefficiently spliced" intron may be spliced or removed at a slower rate as compared to another intron in a RIC pre-mRNA.

In embodiments, the 9-nucleotide sequence at −3e to −1e of the exon flanking the 5' splice site and +1 to +6 of the retained intron is identical to the corresponding wild-type sequence. In embodiments, the 16 nucleotide sequence at −15 to −1 of the retained intron and +1e of the exon flanking the 3' splice site is identical to the corresponding wild-type sequence. As used herein, the "wild-type sequence" refers to the nucleotide sequence for the PKD2 gene in the published reference genome deposited in the NCBI repository of biological and scientific information. As used herein, the "wild-type sequence" refers to the canonical sequence for the PKD2 gene found at NCBI Gene ID 5311. Also used herein, a nucleotide position denoted with an "e" indicates the nucleotide is present in the sequence of an exon (e.g., the exon flanking the 5' splice site or the exon flanking the 3' splice site).

The methods involve contacting cells with an ASO that is complementary to a portion of a pre-mRNA encoding PC-2 protein, resulting in increased expression of PC-2. As used herein, "contacting" or administering to cells refers to any method of providing an ASO in immediate proximity with the cells such that the ASO and the cells interact. A cell that is contacted with an ASO will take up or transport the ASO into the cell. The method involves contacting a condition or disease-associated or condition or disease-relevant cell with any of the ASOs described herein. In some embodiments, the ASO may be further modified or attached (e.g., covalently attached) to another molecule to target the ASO to a cell type, enhance contact between the ASO and the condition or disease-associated or condition or disease-relevant cell, or enhance uptake of the ASO.

As used herein, the term "increasing protein production" or "increasing expression of a target protein" means enhancing the amount of protein that is translated from an mRNA in a cell. A "target protein" may be any protein for which increased expression/production is desired.

In embodiments, contacting a cell that expresses a PKD2 RIC pre-mRNA with an ASO that is complementary to a targeted portion of the PKD2 RIC pre-mRNA transcript results in a measurable increase in the amount of the PC-2 protein (e.g., a target protein) encoded by the pre-mRNA. Methods of measuring or detecting production of a protein will be evident to one of skill in the art and include any known method, for example, Western blotting, flow cytometry, immunofluorescence microscopy, and ELISA.

In embodiments, contacting cells with an ASO that is complementary to a targeted portion of a PKD2 RIC pre-mRNA transcript results in an increase in the amount of PC-2 protein produced by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of PC-2 protein produced by the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the amount of target protein produced by a control compound. A control compound can be, for example, an oligonucleotide that is not complementary to the targeted portion of the RIC pre-mRNA.

In some embodiments, contacting cells with an ASO that is complementary to a targeted portion of a PKD2 RIC pre-mRNA transcript results in an increase in the amount of mRNA encoding PC-2, including the mature mRNA encoding the target protein. In some embodiments, the amount of mRNA encoding PC-2 protein, or the mature mRNA encoding the PC-2 protein, is increased by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of the mRNA encoding PC-2 protein, or the mature mRNA encoding PC-2 protein produced in the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold compared to the amount of mature RNA produced in an untreated cell, e.g., an untreated cell or a cell treated with a control compound. A control compound can be, for example, an oligonucleotide that is not complementary to the targeted portion of the PKD2 RIC pre-mRNA.

Constitutive Splicing of a Retained Intron from a RIC pre-mRNA

The methods and antisense oligonucleotide compositions provided herein are useful for increasing the expression of PC-2 protein in cells, for example, in a subject having Polycystic Kidney Disease caused by a deficiency in the amount or activity of PC-2 protein, by increasing the level of mRNA encoding PC-2 protein, or the mature mRNA encoding PC-2 protein. In particular, the methods and compositions as described herein induce the constitutive splicing of a retained intron from a PKD2 RIC pre-mRNA transcript encoding PC-2 protein, thereby increasing the level of mRNA encoding PC-2 protein, or the mature mRNA encoding PC-2 protein and increasing the expression of PC-2 protein.

Constitutive splicing of a retained intron from a RIC pre-mRNA correctly removes the retained intron from the RIC pre-mRNA, wherein the retained intron has wild-type splice sequences. Constitutive splicing, as used herein, does not encompass splicing of a retained intron from a RIC pre-mRNA transcribed from a gene or allele having a mutation that causes alternative splicing or aberrant splicing of a pre-mRNA transcribed from the gene or allele. For example, constitutive splicing of a retained intron, as induced using the methods and antisense oligonucleotides provided herein, does not correct aberrant splicing in or influence alternative splicing of a pre-mRNA to result in an increased expression of a target protein or functional RNA.

In embodiments, constitutive splicing correctly removes a retained intron from a PKD2 RIC pre-mRNA, wherein the PKD2 RIC pre-mRNA is transcribed from a wild-type gene or allele, or a polymorphic gene or allele, that encodes a fully-functional target protein or functional RNA, and wherein the gene or allele does not have a mutation that causes alternative splicing or aberrant splicing of the retained intron.

In some embodiments, constitutive splicing of a retained intron from a PKD2 RIC pre-mRNA encoding PC-2 protein correctly removes a retained intron from a PKD2 RIC pre-mRNA encoding PC-2 protein, wherein the PKD2 RIC pre-mRNA is transcribed from a gene or allele from which the target gene or functional RNA is produced at a reduced level compared to production from a wild-type allele, and wherein the gene or allele does not have a mutation that causes alternative splicing or aberrant splicing of the retained intron. In these embodiments, the correct removal of the constitutively spliced retained intron results in production of target protein or functional RNA that is functional when compared to an equivalent wild-type protein or functional RNA.

In other embodiments, constitutive splicing correctly removes a retained intron from a PKD2 RIC pre-mRNA, wherein the PKD2 RIC pre-mRNA is transcribed from a gene or allele that encodes a target protein or functional RNA produced in a form having reduced function compared to an equivalent wild-type protein or functional RNA, and wherein the gene or allele does not have a mutation that causes alternative splicing or aberrant splicing of the retained intron. In these embodiments, the correct removal of the constitutively spliced retained intron results in production of partially functional target protein, or functional RNA that is partially functional when compared to an equivalent wild-type protein or functional RNA.

"Correct removal" of the retained intron by constitutive splicing refers to removal of the entire intron, without removal of any part of an exon.

In embodiments, an antisense oligomer as described herein or used in any method described herein does not increase the amount of mRNA encoding PC-2 protein or the amount of PC-2 protein by modulating alternative splicing or aberrant splicing of a pre-mRNA transcribed from the PKD2 gene. Modulation of alternative splicing or aberrant splicing can be measured using any known method for analyzing the sequence and length of RNA species, e.g., by RT-PCR and using methods described elsewhere herein and in the literature. In embodiments, modulation of alternative or aberrant splicing is determined based on an increase or decrease in the amount of the spliced species of interest of at least 10% or 1.1-fold. In embodiments, modulation is determined based on an increase or decrease at a level that is at least 10% to 100% or 1.1 to 10-fold, as described herein regarding determining an increase in mRNA encoding PC-2 protein in the methods of the invention.

In embodiments, the methods described herein is a method wherein the PKD2 RIC pre-mRNA was produced by partial splicing of a wild-type PKD2 pre-mRNA. In embodiments, the method is a method wherein the PKD2 RIC pre-mRNA was produced by partial splicing of a full-length wild-type PKD2 pre-mRNA. In embodiments, the PKD2 RIC pre-mRNA was produced by partial splicing of a full-length PKD2 pre-mRNA. In these embodiments, a full-length PKD2 pre-mRNA may have a polymorphism in a splice site of the retained intron that does not impair correct splicing of the retained intron as compared to splicing of the retained intron having the wild-type splice site sequence.

In embodiments, the mRNA encoding PC-2 protein is a full-length mature mRNA, or a wild-type mature mRNA. In these embodiments, a full-length mature mRNA may have a polymorphism that does not affect the activity of the target protein or the functional RNA encoded by the mature mRNA, as compared to the activity of PC-2 protein encoded by the wild-type mature mRNA.

Antisense Oligomers

One aspect of the present disclosure is a composition comprising antisense oligomers that enhances splicing by binding to a targeted portion of a PKD2 RIC pre-mRNA. As used herein, the terms "ASO" and "antisense oligomer" are used interchangeably and refer to an oligomer such as a polynucleotide, comprising nucleobases that hybridize to a target nucleic acid (e.g., a PKD2 RIC pre-mRNA) sequence by Watson-Crick base pairing or wobble base pairing (G-U). The ASO may have exact sequence complementary to the target sequence or near complementarity (e.g., sufficient complementarity to bind the target sequence and enhancing splicing at a splice site). ASOs are designed so that they bind (hybridize) to a target nucleic acid (e.g., a targeted portion of a pre-mRNA transcript) and remain hybridized under physiological conditions. Typically, if they hybridize to a site other than the intended (targeted) nucleic acid sequence, they hybridize to a limited number of sequences that are not a target nucleic acid (to a few sites other than a target nucleic acid). Design of an ASO can take into consideration the occurrence of the nucleic acid sequence of the targeted portion of the pre-mRNA transcript or a sufficiently similar nucleic acid sequence in other locations in the genome or cellular pre-mRNA or transcriptome, such that the likelihood the ASO will bind other sites and cause "off-target" effects is limited. Any antisense oligomers known in the art, for example in PCT Application No. PCT/US2014/054151, published as WO 2015/035091, titled "Reducing Nonsense-Mediated mRNA Decay," can be used to practice the methods described herein.

In some embodiments, ASOs "specifically hybridize" to or are "specific" to a target nucleic acid or a targeted portion of a RIC pre-mRNA. Typically such hybridization occurs with a Tm substantially greater than 37° C., preferably at least 50° C., and typically between 60° C. to approximately 90° C. Such hybridization preferably corresponds to stringent hybridization conditions. At a given ionic strength and pH, the Tm is the temperature at which 50% of a target sequence hybridizes to a complementary oligonucleotide.

Oligomers, such as oligonucleotides, are "complementary" to one another when hybridization occurs in an antiparallel configuration between two single-stranded polynucleotides. A double-stranded polynucleotide can be "complementary" to another polynucleotide, if hybridization can occur between one of the strands of the first polynucleotide and the second. Complementarity (the degree to which one polynucleotide is complementary with another) is quantifiable in terms of the proportion (e.g., the percentage) of bases in opposing strands that are expected to form hydrogen bonds with each other, according to generally accepted base-pairing rules. The sequence of an antisense oligomer (ASO) need not be 100% complementary to that of its target nucleic acid to hybridize. In certain embodiments, ASOs can comprise at least 70%, at least 75%, at least 80%, at least 85%, at least 90%, at least 95%, at least 96%, at least 97%, at least 98%, or at least 99% sequence complementarity to a target region within the target nucleic acid sequence to which they are targeted. For example, an ASO in which 18 of 20 nucleobases of the oligomeric compound are complementary to a target region, and would therefore specifically hybridize, would represent 90 percent complementarity. In this example, the remaining non-complementary nucleobases may be clustered together or interspersed with complementary nucleobases and need not be contiguous to each other or to complementary nucleobases. Percent complementarity of an ASO with a region of a target nucleic acid can be determined routinely using BLAST programs (basic local alignment search tools) and PowerBLAST programs known in the art (Altschul, et al., J. Mol. Biol., 1990, 215, 403-410; Zhang and Madden, Genome Res., 1997, 7, 649-656).

An ASO need not hybridize to all nucleobases in a target sequence and the nucleobases to which it does hybridize may be contiguous or noncontiguous. ASOs may hybridize over one or more segments of a pre-mRNA transcript, such that intervening or adjacent segments are not involved in the hybridization event (e.g., a loop structure or hairpin structure may be formed). In certain embodiments, an ASO hybridizes to noncontiguous nucleobases in a target pre-mRNA transcript. For example, an ASO can hybridize to nucleobases in a pre-mRNA transcript that are separated by one or more nucleobase(s) to which the ASO does not hybridize.

The ASOs described herein comprise nucleobases that are complementary to nucleobases present in a target portion of a RIC pre-mRNA. The term ASO embodies oligonucleotides and any other oligomeric molecule that comprises nucleobases capable of hybridizing to a complementary nucleobase on a target mRNA but does not comprise a sugar moiety, such as a peptide nucleic acid (PNA). The ASOs may comprise naturally-occurring nucleotides, nucleotide analogs, modified nucleotides, or any combination of two or three of the preceding. The term "naturally occurring nucleotides" includes deoxyribonucleotides and ribonucleotides. The term "modified nucleotides" includes nucleotides with modified or substituted sugar groups and/or having a modified backbone. In some embodiments, all of the nucleotides of the ASO are modified nucleotides. Chemical modifications of ASOs or components of ASOs that are compatible with the methods and compositions described herein will be evident to one of skill in the art and can be found, for example, in U.S. Pat. No. 8,258,109 B2, U.S. Pat. No. 5,656,612, U.S. Patent Publication No. 2012/0190728, and Dias and Stein, Mol. Cancer Ther. 2002, 347-355, herein incorporated by reference in their entirety.

The nucleobase of an ASO may be any naturally occurring, unmodified nucleobase such as adenine, guanine, cytosine, thymine and uracil, or any synthetic or modified nucleobase that is sufficiently similar to an unmodified nucleobase such that it is capable of hydrogen bonding with a nucleobase present on a target pre-mRNA. Examples of modified nucleobases include, without limitation, hypoxanthine, xanthine, 7-methylguanine, 5,6-dihydrouracil, 5-methylcytosine, and 5-hydroxymethoylcytosine.

The ASOs described herein also comprise a backbone structure that connects the components of an oligomer. The term "backbone structure" and "oligomer linkages" may be used interchangeably and refer to the connection between monomers of the ASO. In naturally occurring oligonucleotides, the backbone comprises a 3'-5' phosphodiester linkage connecting sugar moieties of the oligomer. The backbone structure or oligomer linkages of the ASOs described herein may include (but are not limited to) phosphorothioate, phosphorodithioate, phosphoroselenoate, phosphorodiselenoate, phosphoroanilothioate, phosphoranilladate, phosphoramidate, and the like. See e.g., LaPlanche, et al., Nucleic Acids Res. 14:9081 (1986); Stec, et al., J. Am. Chem. Soc. 106:6077 (1984), Stein, et al., Nucleic Acids Res. 16:3209 (1988), Zon, et al., Anti Cancer Drug Design 6:539 (1991); Zon, et al., Oligonucleotides and Analogues: A Practical Approach, pp. 87-108 (F. Eckstein, Ed., Oxford University Press, Oxford England (1991)); Stec, et al., U.S. Pat. No. 5,151,510; Uhlmann and Peyman, Chemical Reviews 90:543 (1990). In some embodiments, the backbone structure of the ASO does not contain phosphorous but rather contains peptide bonds, for example in a peptide nucleic acid (PNA), or linking groups including carbamate, amides, and linear and cyclic hydrocarbon groups. In some embodiments, the backbone modification is a phosphorothioate linkage. In some embodiments, the backbone modification is a phosphoramidate linkage.

In embodiments, the stereochemistry at each of the phosphorus internucleotide linkages of the ASO backbone is random. In embodiments, the stereochemistry at each of the phosphorus internucleotide linkages of the ASO backbone is controlled and is not random. For example, U.S. Pat. App. Pub. No. 2014/0194610, "Methods for the Synthesis of Functionalized Nucleic Acids," incorporated herein by reference, describes methods for independently selecting the handedness of chirality at each phosphorous atom in a nucleic acid oligomer. In embodiments, an ASO used in the methods of the disclosure, including, but not limited to, any of the ASOs set forth herein in Table 5, comprises an ASO having phosphorus internucleotide linkages that are not random. In embodiments, a composition used in the methods of the invention comprises a pure diastereomeric ASO. In embodiments, a composition used in the methods of the invention comprises an ASO that has diastereomeric purity of at least about 90%, at least about 91%, at least about 92%, at least about 93%, at least about 94%, at least about 95%, at least about 96%, at least about 97%, at least about 98%, at least about 99%, about 100%, about 90% to about 100%, about 91% to about 100%, about 92% to about 100%, about 93% to about 100%, about 94% to about 100%, about 95% to about 100%, about 96% to about 100%, about 97% to about 100%, about 98% to about 100%, or about 99% to about 100%.

In embodiments, the ASO has a nonrandom mixture of Rp and Sp configurations at its phosphorus internucleotide linkages. For example, it has been suggested that a mix of Rp and Sp is required in antisense oligonucleotides to achieve a balance between good activity and nuclease stability (Wan, et al., 2014, "Synthesis, biophysical properties and biological activity of second generation antisense oligonucleotides containing chiral phosphorothioate linkages," Nucleic Acids Research 42(22): 13456-13468, incorporated herein by reference). In embodiments, an ASO used in the methods of the invention, including, but not limited to, any of the ASOs set forth herein in Table 5, comprises about 5-100% Rp, at least about 5% Rp, at least about 10% Rp, at least about 15% Rp, at least about 20% Rp, at least about 25% Rp, at least about 30% Rp, at least about 35% Rp, at least about 40% Rp, at least about 45% Rp, at least about 50% Rp, at least about 55% Rp, at least about 60% Rp, at least about 65% Rp, at least about 70% Rp, at least about 75% Rp, at least about 80% Rp, at least about 85% Rp, at least about 90% Rp, or at least about 95% Rp, with the remainder Sp, or about 100% Rp. In embodiments, an ASO used in the methods of the invention, including, but not limited to, any of the ASOs set forth herein in Table 5, comprises about 10% to about 100% Rp, about 15% to about 100% Rp, about 20% to about 100% Rp, about 25% to about 100% Rp, about 30% to about 100% Rp, about 35% to about 100% Rp, about 40% to about 100% Rp, about 45% to about 100% Rp, about 50% to about 100% Rp, about 55% to about 100% Rp, about 60% to about 100% Rp, about 65% to about 100% Rp, about 70% to about 100% Rp, about 75% to about 100% Rp, about 80% to about 100% Rp, about 85% to about 100% Rp, about 90% to about 100% Rp, or about 95% to about 100% Rp, about 20% to about 80% Rp, about 25% to about 75% Rp, about 30% to about 70% Rp, about 40% to about 60% Rp, or about 45% to about 55% Rp, with the remainder Sp.

In embodiments, an ASO used in the methods of the invention, including, but not limited to, any of the ASOs set forth herein in Table 5, comprises about 5-100% Sp, at least about 5% Sp, at least about 10% Sp, at least about 15% Sp, at least about 20% Sp, at least about 25% Sp, at least about 30% Sp, at least about 35% Sp, at least about 40% Sp, at least about 45% Sp, at least about 50% Sp, at least about 55% Sp, at least about 60% Sp, at least about 65% Sp, at least about 70% Sp, at least about 75% Sp, at least about 80% Sp, at least about 85% Sp, at least about 90% Sp, or at least about 95% Sp, with the remainder Rp, or about 100% Sp. In embodiments, an ASO used in the methods of the invention, including, but not limited to, any of the ASOs set forth herein in Table 5, comprises about 10% to about 100% Sp, about 15% to about 100% Sp, about 20% to about 100% Sp, about 25% to about 100% Sp, about 30% to about 100% Sp, about 35% to about 100% Sp, about 40% to about 100% Sp, about 45% to about 100% Sp, about 50% to about 100% Sp, about 55% to about 100% Sp, about 60% to about 100% Sp, about 65% to about 100% Sp, about 70% to about 100% Sp, about 75% to about 100% Sp, about 80% to about 100% Sp, about 85% to about 100% Sp, about 90% to about 100% Sp, or about 95% to about 100% Sp, about 20% to about 80% Sp, about 25% to about 75% Sp, about 30% to about 70% Sp, about 40% to about 60% Sp, or about 45% to about 55% Sp, with the remainder Rp.

Any of the ASOs described herein may contain a sugar moiety that comprises ribose or deoxyribose, as present in naturally occurring nucleotides, or a modified sugar moiety or sugar analog, including a morpholine ring. Non-limiting examples of modified sugar moieties include 2' substitutions such as 2'-O-methyl (2'-O-Me), 2'-O-methoxyethyl (2'MOE), 2'-O-aminoethyl, 2'F; N3'→P5' phosphoramidate, 2'dimethylaminooxyethoxy, 2'dimethylaminoethoxyethoxy, 2'-guanidinidium, 2'-O-guanidinium ethyl, carbamate modified sugars, and bicyclic modified sugars. In some embodiments, the sugar moiety modification is selected from 2'-O-Me, 2'F, and 2'MOE. In some embodiments, the sugar moiety modification is an extra bridge bond, such as in a locked nucleic acid (LNA). In some embodiments the sugar analog contains a morpholine ring, such as phosphorodiamidate morpholino (PMO). In some embodiments, the sugar moiety comprises a ribofuransyl or 2'deoxyribofuransyl modification. In some embodiments, the sugar moiety comprises 2'4'-constrained 2'O-methyloxyethyl (cMOE) modifications. In some embodiments, the sugar moiety comprises cEt 2', 4' constrained 2'-O ethyl BNA modifications. In some embodiments, the sugar moiety comprises tricycloDNA (tcDNA) modifications. In some embodiments, the sugar moiety comprises ethylene nucleic acid (ENA) modifications. In some embodiments, the sugar moiety comprises MCE modifications. Modifications are known in the art and described in the literature, e.g., by Jarver, et al., 2014, "A Chemical View of Oligonucleotides for Exon Skipping and Related Drug Applications," Nucleic Acid Therapeutics 24(1): 37-47, incorporated by reference for this purpose herein.

In some examples, each monomer of the ASO is modified in the same way, for example each linkage of the backbone of the ASO comprises a phosphorothioate linkage or each ribose sugar moiety comprises a 2'O-methyl modification. Such modifications that are present on each of the monomer components of an ASO are referred to as "uniform modifications." In some examples, a combination of different modifications may be desired, for example, an ASO may comprise a combination of phosphorodiamidate linkages and sugar moieties comprising morpholine rings (morpholinos). Combinations of different modifications in an ASO are referred to as "mixed modifications" or "mixed chemistries."

In some embodiments, the ASO comprises one or more backbone modification. In some embodiments, the ASO comprises one or more sugar moiety modification. In some embodiments, the ASO comprises one or more backbone modification and one or more sugar moiety modification. In some embodiments, the ASO comprises 2'MOE modifications and a phosphorothioate backbone. In some embodiments, the ASO comprises a phosphorodiamidate morpholino (PMO). In some embodiments, the ASO comprises a peptide nucleic acid (PNA). Any of the ASOs or any component of an ASO (e.g., a nucleobase, sugar moiety, backbone) described herein may be modified in order to achieve desired properties or activities of the ASO or reduce undesired properties or activities of the ASO. For example, an ASO or one or more component of any ASO may be modified to enhance binding affinity to a target sequence on a pre-mRNA transcript; reduce binding to any non-target sequence; reduce degradation by cellular nucleases (i.e., RNase H); improve uptake of the ASO into a cell and/or into the nucleus of a cell; alter the pharmacokinetics or pharmacodynamics of the ASO; and modulate the half-life of the ASO.

In some embodiments, the ASOs are comprised of 2'-O-(2-methoxyethyl) (MOE) phosphorothioate-modified nucleotides. ASOs comprised of such nucleotides are especially well-suited to the methods disclosed herein; oligomers having such modifications have been shown to have significantly enhanced resistance to nuclease degradation and increased bioavailability, making them suitable, for example, for oral delivery in some embodiments described herein. See e.g., Geary, et al., J Pharmacol Exp Ther. 2001; 296(3):890-7; Geary, et al., J Pharmacol Exp Ther. 2001; 296(3):898-904.

Methods of synthesizing ASOs will be known to one of skill in the art. Alternatively or in addition, ASOs may be obtained from a commercial source.

Unless specified otherwise, the left-hand end of single-stranded nucleic acid (e.g., pre-mRNA transcript, oligonucleotide, ASO, etc.) sequences is the 5' end and the left-hand direction of single or double-stranded nucleic acid sequences is referred to as the 5' direction. Similarly, the right-hand end or direction of a nucleic acid sequence (single or double stranded) is the 3' end or direction. Generally, a region or sequence that is 5' to a reference point in a nucleic acid is referred to as "upstream," and a region or sequence that is 3' to a reference point in a nucleic acid is referred to as "downstream." Generally, the 5' direction or end of an mRNA is where the initiation or start codon is located, while the 3' end or direction is where the termination codon is located. In some aspects, nucleotides that are upstream of a reference point in a nucleic acid may be designated by a negative number, while nucleotides that are downstream of a reference point may be designated by a positive number. For example, a reference point (e.g., an exon-exon junction in mRNA) may be designated as the "zero" site, and a nucleotide that is directly adjacent and upstream of the reference point is designated "minus one," e.g., "−1," while a nucleotide that is directly adjacent and downstream of the reference point is designated "plus one," e.g., "+1."

In some embodiments, the ASOs are complementary to (and bind to) a targeted portion of a PKD2 RIC pre-mRNA that is downstream (in the 3' direction) of the 5' splice site of the retained intron in a PKD2 RIC pre-mRNA (e.g., the direction designated by positive numbers relative to the 5' splice site) (FIG. 1). In some embodiments, the ASOs are complementary to a targeted portion of the PKD2 RIC pre-mRNA that is within the region of about +6 to about +500 relative to the 5' splice site of the retained intron. In some embodiments, the ASO is not complementary to nucleotides +1 to +5 relative to the 5' splice site (the first five nucleotides located downstream of the 5' splice site). In some embodiments, the ASOs may be complementary to a targeted portion of a PKD2 RIC pre-mRNA that is within the region between nucleotides +6 and +497 relative to the 5' splice site of the retained intron. In some aspects, the ASOs are complementary to a targeted portion that is within the region about +6 to about +500, about +6 to about +490, about +6 to about +480, about +6 to about +470, about +6 to about +460, about +6 to about +450, about +6 to about +440, about +6 to about +430, about +6 to about +420, about +6 to about +410, about +6 to about +400, about +6 to about +390, about +6 to about +380, about +6 to about +370, about +6 to about +360, about +6 to about +350, about +6 to about +340, about +6 to about +330, about +6 to about +320, about +6 to about +310, about +6 to about +300, about +6 to about +290, about +6 to about +280, about +6 to about +270, about +6 to about +260, about +6 to about +250, about +6 to about +240, about +6 to about +230, about +6 to about +220, about +6 to about +210, about +6 to about +200, about +6 to about +190, about +6 to about +180, about +6 to about +170, about +6 to about +160, about +6 to about +150, about +6 to about +140, about +6 to about +130, about +6 to about +120, about +6 to about +110, about +6 to about +100, about +6 to about +90, about +6 to about +80, about +6 to about +70, about +6 to about +60, about +6 to about +50, about +6 to about +40, about +6 to about +30, or about +6 to about +20 relative to 5' splice site of the retained intron.

In some embodiments, the ASOs are complementary to (and bind to) a targeted portion of a PKD2 RIC pre-mRNA that is upstream (in the 5' direction) of the 5' splice site of the retained intron in a PKD2 RIC pre-mRNA (e.g., the direction designated by negative numbers relative to the 5' splice site) (FIG. 1). In some embodiments, the ASOs are complementary to a targeted portion of the PKD2 RIC pre-mRNA that is within the region of about −4e to about −210e relative to the 5' splice site of the retained intron. In some embodiments, the ASO is not complementary to nucleotides −1e to −3e relative to the 5' splice site (the first three nucleotides located upstream of the 5' splice site). In some embodiments, the ASOs may be complementary to a targeted portion of a PKD2 RIC pre-mRNA that is within the region between nucleotides −4e and about −204e relative to the 5' splice site of the retained intron. In some aspects, the ASOs are complementary to a targeted portion that is within the region about −4e to about −210e, about −4e to about −200e, about −4e to about −190e, about −4e to about −180e, about −4e to about −170e, about −4e to about −160e, about −4e to about −150e, about −4e to about −140e, about −4e to about −130e, about −4e to about −120e, about −4e to about −110e, about −4e to about −100e, about −4e to about −90e, about −4e to about −80e, about −4e to about −70e, about −4e to about −60e, about −4e to about −50e, about −4e to about −40e, about −4e to about −30e, or about −4e to about −20e relative to 5' splice site of the retained intron.

In some embodiments, the ASOs are complementary to a targeted region of a PKD2 RIC pre-mRNA that is upstream (in the 5' direction) of the 3' splice site of the retained intron in a PKD2 RIC pre-mRNA (e.g., in the direction designated by negative numbers) (FIG. 1). In some embodiments, the ASOs are complementary to a targeted portion of the PKD2 RIC pre-mRNA that is within the region of about −16 to about −500 relative to the 3' splice site of the retained intron. In some embodiments, the ASO is not complementary to nucleotides −1 to −15 relative to the 3' splice site (the first 15 nucleotides located upstream of the 3' splice site). In some embodiments, the ASOs are complementary to a targeted portion of the PKD2 RIC pre-mRNA that is within the region −16 to −496 relative to the 3' splice site of the retained intron. In some aspects, the ASOs are complementary to a targeted portion that is within the region about −16 to about −500, about −16 to about −490, about −16 to about −480, about −16 to about −470, about −16 to about −460, about −16 to about −450, about −16 to about −440, about −16 to about −430, about −16 to about −420, about −16 to about −410, about −16 to about −400, about −16 to about −390, about −16 to about −380, about −16 to about −370, about −16 to about −360, about −16 to about −350, about −16 to about −340, about −16 to about −330, about −16 to about −320, about −16 to about −310, about −16 to about −300, about −16 to about −290, about −16 to about −280, about −16 to about −270, about −16 to about −260, about −16 to about −250, about −16 to about −240, about −16 to about −230, about −16 to about −220, about −16 to about −210, about −16 to about −200, about −16 to about −190, about −16 to about −180, about −16 to about −170, about −16 to about −160, about −16 to about −150, about −16 to about −140, about −16 to about −130, about −16 to about −120, about −16 to about −110, about −16 to about −100, about −16 to about −90, about −16 to about −80, about −16 to about −70, about −16 to about −60, about −16 to about −50, about −16 to about −40, or about −16 to about −30 relative to 3' splice site of the retained intron.

In some embodiments, the ASOs are complementary to a targeted region of a PKD2 RIC pre-mRNA that is downstream (in the 3' direction) of the 3' splice site of the retained intron in a PKD2 RIC pre-mRNA (e.g., in the direction designated by positive numbers) (FIG. 1). In some embodiments, the ASOs are complementary to a targeted portion of the PKD2 RIC pre-mRNA that is within the region of about +2e to about +220e relative to the 3' splice site of the retained intron. In some embodiments, the ASO is not complementary to nucleotides +1e relative to the 3' splice site (the first nucleotide located downstream of the 3' splice site). In some embodiments, the ASOs may be complementary to a targeted portion of a PKD2 RIC pre-mRNA that is within the region between nucleotides +2e and +212e relative to the 3' splice site of the retained intron. In some aspects, the ASOs are complementary to a targeted portion that is within the region about +2e to about +220e, about +2e to about +210e, about +2e to about +200e, about +2e to about +190e, about +2e to about +180e, about +2e to about +170e, about +2e to about +160e, about +2e to about +150e, about +2e to about +140e, about +2e to about +130e, about +2e to about +120e, about +2e to about +110e, about +2e to about +100e, about +2e to about +90e, about +2e to about +80e, about +2e to about +70e, about +2e to about +60e, about +2e to about +50e, about +2e to about +40e, about +2e to about +30e, about +2e to about +20e, or about +2e to about +10e relative to 3' splice site of the retained intron.

In embodiments, the targeted portion of the PKD2 RIC pre-mRNA is within the region +100 relative to the 5' splice site of the retained intron to −100 relative to the 3' splice site of the retained intron.

The ASOs may be of any length suitable for specific binding and effective enhancement of splicing. In some embodiments, the ASOs consist of 8 to 50 nucleobases. For example, the ASO may be 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, or 50 nucleobases in length. In some embodiments, the ASOs consist of more than 50 nucleobases. In some embodiments, the ASO is from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, 12 to 15 nucleobases, 13 to 50 nucleobases, 13 to 40 nucleobases, 13 to 35 nucleobases, 13 to 30 nucleobases, 13 to 25 nucleobases, 13 to 20 nucleobases, 14 to 50 nucleobases, 14 to 40 nucleobases, 14 to 35 nucleobases, 14 to 30 nucleobases, 14 to 25 nucleobases, 14 to 20 nucleobases, 15 to 50 nucleobases, 15 to 40 nucleobases, 15 to 35 nucleobases, 15 to 30 nucleobases, 15 to 25 nucleobases, 15 to 20 nucleobases, 20 to 50 nucleobases, 20 to 40 nucleobases, 20 to 35 nucleobases, 20 to 30 nucleobases, 20 to 25 nucleobases, 25 to 50 nucleobases, 25 to 40 nucleobases, 25 to 35 nucleobases, or 25 to 30 nucleobases in length. In some embodiments, the ASOs are 18 nucleotides in length. In some embodiments, the ASOs are 15 nucleotides in length. In some embodiments, the ASOs are 25 nucleotides in length.

In some embodiments, two or more ASOs with different chemistries but complementary to the same targeted portion of the RIC pre-mRNA are used. In some embodiments, two or more ASOs that are complementary to different targeted portions of the RIC pre-mRNA are used.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

In some embodiments, the nucleic acid to be targeted by an ASO is a PKD2 RIC pre-mRNA expressed in a cell, such as a eukaryotic cell. In some embodiments, the term "cell" may refer to a population of cells. In some embodiments, the cell is in a subject. In some embodiments, the cell is isolated from a subject. In some embodiments, the cell is ex vivo. In some embodiments, the cell is a condition or disease-relevant cell or a cell line. In some embodiments, the cell is in vitro (e.g., in cell culture).

Pharmaceutical Compositions

Pharmaceutical compositions or formulations comprising the antisense oligonucleotide of the described compositions and for use in any of the described methods can be prepared according to conventional techniques well known in the pharmaceutical industry and described in the published literature. In embodiments, a pharmaceutical composition or formulation for treating a subject comprises an effective amount of any antisense oligomer as described above, or a pharmaceutically acceptable salt, solvate, hydrate or ester thereof, and a pharmaceutically acceptable diluent. The antisense oligomer of a pharmaceutical formulation may further comprise a pharmaceutically acceptable excipient, diluent, or carrier.

Pharmaceutically acceptable salts are suitable for use in contact with the tissues of humans and lower animals without undue toxicity, irritation, allergic response, etc., and are commensurate with a reasonable benefit/risk ratio. (See, e.g., S. M. Berge, et al., J. Pharmaceutical Sciences, 66: 1-19 (1977), incorporated herein by reference for this purpose). The salts can be prepared in situ during the final isolation and purification of the compounds, or separately by reacting the free base function with a suitable organic acid. Examples of pharmaceutically acceptable, nontoxic acid addition salts are salts of an amino group formed with inorganic acids such as hydrochloric acid, hydrobromic acid, phosphoric acid, sulfuric acid and perchloric acid or with organic acids such as acetic acid, oxalic acid, maleic acid, tartaric acid, citric acid, succinic acid or malonic acid or by using other documented methodologies such as ion exchange. Other pharmaceutically acceptable salts include adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, lower alkyl sulfonate and aryl sulfonate.

In embodiments, the compositions are formulated into any of many possible dosage forms such as, but not limited to, tablets, capsules, gel capsules, liquid syrups, soft gels, suppositories, and enemas. In embodiments, the compositions are formulated as suspensions in aqueous, non-aqueous or mixed media. Aqueous suspensions may further contain substances that increase the viscosity of the suspension including, for example, sodium carboxymethylcellulose, sorbitol and/or dextran. The suspension may also contain stabilizers. In embodiments, a pharmaceutical formulation or composition of the present invention includes, but is not limited to, a solution, emulsion, microemulsion, foam or liposome-containing formulation (e.g., cationic or noncationic liposomes).

The pharmaceutical composition or formulation of the present invention may comprise one or more penetration enhancer, carrier, excipients or other active or inactive ingredients as appropriate and well known to those of skill in the art or described in the published literature. In embodiments, liposomes also include sterically stabilized liposomes, e.g., liposomes comprising one or more specialized lipids. These specialized lipids result in liposomes with enhanced circulation lifetimes. In embodiments, a sterically stabilized liposome comprises one or more glycolipids or is derivatized with one or more hydrophilic polymers, such as a polyethylene glycol (PEG) moiety. In embodiments, a surfactant is included in the pharmaceutical formulation or compositions. The use of surfactants in drug products, formulations and emulsions is well known in the art. In embodiments, the present invention employs a penetration enhancer to effect the efficient delivery of the antisense oligonucleotide, e.g., to aid diffusion across cell membranes and/or enhance the permeability of a lipophilic drug. In embodiments, the penetration enhancer is a surfactant, fatty acid, bile salt, chelating agent, or non-chelating nonsurfactant.

In embodiments, the pharmaceutical formulation comprises multiple antisense oligonucleotides. In embodiments, the antisense oligonucleotide is administered in combination with another drug or therapeutic agent. In embodiments, the antisense oligonucleotide is administered with one or more agents capable of promoting penetration of the subject antisense oligonucleotide across the blood-brain barrier by any method known in the art. For example, delivery of agents by administration of an adenovirus vector to motor neurons in muscle tissue is described in U.S. Pat. No. 6,632,427, "Adenoviral-vector-mediated gene transfer into medullary motor neurons," incorporated herein by reference. Delivery of vectors directly to the brain, e.g., the striatum, the thalamus, the hippocampus, or the substantia nigra, is described, e.g., in U.S. Pat. No. 6,756,523, "Adenovirus vectors for the transfer of foreign genes into cells of the central nervous system particularly in brain," incorporated herein by reference.

In embodiments, the antisense oligonucleotides are linked or conjugated with agents that provide desirable pharmaceutical or pharmacodynamic properties. In embodiments, the antisense oligonucleotide is coupled to a substance, known in the art to promote penetration or transport across the blood-brain barrier, e.g., an antibody to the transferrin receptor. In embodiments, the antisense oligonucleotide is linked with a viral vector, e.g., to render the antisense compound more effective or increase transport across the blood-brain barrier. In embodiments, osmotic blood brain barrier disruption is assisted by infusion of sugars, e.g., meso erythritol, xylitol, D(+) galactose, D(+) lactose, D(+) xylose, dulcitol, myo-inositol, L(−) fructose, D(−) mannitol, D(+) glucose, D(+) arabinose, D(−) arabinose, cellobiose, D(+) maltose, D(+) raffinose, L(+) rhamnose, D(+) melibiose, D(−) ribose, adonitol, D(+) arabitol, L(−) arabitol, D(+) fucose, L(−) fucose, D(−) lyxose, L(+) lyxose, and L(−) lyxose, or amino acids, e.g., glutamine, lysine, arginine, asparagine, aspartic acid, cysteine, glutamic acid, glycine, histidine, leucine, methionine, phenylalanine, proline, serine, threonine, tyrosine, valine, and taurine. Methods and materials for enhancing blood brain barrier penetration are described, e.g., in U.S. Pat. No. 4,866,042, "Method for the delivery of genetic material across the blood brain barrier," U.S. Pat. No. 6,294,520, "Material for passage through the blood-brain barrier," and U.S. Pat. No. 6,936,589, "Parenteral delivery systems," each incorporated herein by reference.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties, and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

Treatment of Subjects

Any of the compositions provided herein may be administered to an individual. "Individual" may be used interchangeably with "subject" or "patient." An individual may be a mammal, for example a human or animal such as a non-human primate, a rodent, a rabbit, a rat, a mouse, a horse, a donkey, a goat, a cat, a dog, a cow, a pig, or a sheep. In embodiments, the individual is a human. In embodiments, the individual is a fetus, an embryo, or a child. In other embodiments, the individual may be another eukaryotic organism, such as a plant. In some embodiments, the compositions provided herein are administered to a cell ex vivo.

In some embodiments, the compositions provided herein are administered to an individual as a method of treating a disease or disorder. In some embodiments, the individual has a genetic disease, such as any of the diseases described herein. In some embodiments, the individual is at risk of having the disease, such as any of the diseases described herein. In some embodiments, the individual is at increased risk of having a disease or disorder caused by insufficient amount of a protein or insufficient activity of a protein. If an individual is "at an increased risk" of having a disease or disorder caused insufficient amount of a protein or insufficient activity of a protein, the method involves preventative or prophylactic treatment. For example, an individual may be at an increased risk of having such a disease or disorder because of family history of the disease. Typically, individuals at an increased risk of having such a disease or disorder benefit from prophylactic treatment (e.g., by preventing or delaying the onset or progression of the disease or disorder).

Suitable routes for administration of ASOs of the present invention may vary depending on cell type to which delivery of the ASOs is desired. Multiple tissues and organs are affected by Polycystic Kidney Disease, with the kidney being the most significantly affected tissue. The ASOs of the present invention may be administered to patients parenterally, for example, by intraperitoneal injection, intramuscular injection, subcutaneous injection, or intravenous injection.

Subjects are evaluated for response to treatment using any appropriate markers. In embodiments, subjects with kidney disease are evaluated for response to treatment by measuring specific markers for kidney disease, including creatinine, creatinine clearance, blood pressure, 24-hour urine volume, 24-hour urine protein, vWAg and platelet aggregation by arachidonic acid.

Methods of Identifying Additional ASOs that Enhance Splicing

Also within the scope of the present invention are methods for identifying (determining) additional ASOs that enhance splicing of a PKD2 RIC pre-mRNA, specifically at the target intron. ASOs that specifically hybridize to different nucleotides within the target region of the pre-mRNA may be screened to identify (determine) ASOs that improve the rate and/or extent of splicing of the target intron. In some embodiments, the ASO may block or interfere with the binding site(s) of a splicing repressor/silencer. Any method known in the art may be used to identify (determine) an ASO that when hybridized to the target region of the intron results in the desired effect (e.g., enhanced splicing, protein or functional RNA production). These methods also can be used for identifying ASOs that enhance splicing of the retained intron by binding to a targeted region in an exon flanking the retained intron, or in a non-retained intron. An example of a method that may be used is provided below.

A round of screening, referred to as an ASO "walk" may be performed using ASOs that have been designed to hybridize to a target region of a pre-mRNA. For example, the ASOs used in the ASO walk can be tiled every 5 nucleotides from approximately 100 nucleotides upstream of the 5' splice site of the retained intron (e.g., a portion of sequence of the exon located upstream of the target/retained intron) to approximately 100 nucleotides downstream of the 5' splice site of the target/retained intron and/or from approximately 100 nucleotides upstream of the 3' splice site of the retained intron to approximately 100 nucleotides downstream of the 3' splice site of the target/retained intron (e.g., a portion of sequence of the exon located downstream of the target/retained intron). For example, a first ASO of 15 nucleotides in length may be designed to specifically hybridize to nucleotides +6 to +20 relative to the 5' splice site of the target/retained intron. A second ASO is designed to specifically hybridize to nucleotides +11 to +25 relative to the 5' splice site of the target/retained intron. ASOs are designed as such spanning the target region of the pre-mRNA. In embodiments, the ASOs can be tiled more closely, e.g., every 1, 2, 3, or 4 nucleotides. Further, the ASOs can be tiled from 100 nucleotides downstream of the 5' splice site, to 100 nucleotides upstream of the 3' splice site. In some embodiments, the ASOs can be tiled from about 210 nucleotides upstream of the 5' splice site, to about 500 nucleotides downstream of the 5' splice site. In some embodiments, the ASOs can be tiled from about 500 nucleotides upstream of the 3' splice site, to about 220 nucleotides downstream of the 3' splice site.

One or more ASOs, or a control ASO (an ASO with a scrambled sequence, sequence that is not expected to hybridize to the target region) are delivered, for example by transfection, into a disease-relevant cell line that expresses the target pre-mRNA (e.g., the RIC pre-mRNA described elsewhere herein). The splicing-inducing effects of each of the ASOs may be assessed by any method known in the art, for example by reverse transcriptase (RT)-PCR using primers that span the splice junction, as described herein (see "Identification of intron-retention events"). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

A second round of screening, referred to as an ASO "micro-walk" may be performed using ASOs that have been designed to hybridize to a target region of a pre-mRNA. The ASOs used in the ASO micro-walk are tiled every 1 nucleotide to further refine the nucleotide acid sequence of the pre-mRNA that when hybridized with an ASO results in enhanced splicing.

Regions defined by ASOs that promote splicing of the target intron are explored in greater detail by means of an ASO "micro-walk", involving ASOs spaced in 1-nt steps, as well as longer ASOs, typically 18-25 nt.

As described for the ASO walk above, the ASO micro-walk is performed by delivering one or more ASOs, or a control ASO (an ASO with a scrambled sequence, sequence that is not expected to hybridize to the target region), for example by transfection, into a disease-relevant cell line that expresses the target pre-mRNA. The splicing-inducing effects of each of the ASOs may be assessed by any method known in the art, for example by reverse transcriptase (RT)-PCR using primers that span the splice junction, as described herein (see "Identification of intron-retention events"). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

ASOs that when hybridized to a region of a pre-mRNA result in enhanced splicing and increased protein production may be tested in vivo using animal models, for example transgenic mouse models in which the full-length human gene has been knocked-in or in humanized mouse models of disease. Suitable routes for administration of ASOs may vary depending on the disease and/or the cell types to which delivery of the ASOs is desired. ASOs may be administered, for example, by intraperitoneal injection, intramuscular injection, subcutaneous injection, or intravenous injection. Following administration, the cells, tissues, and/or organs of the model animals may be assessed to determine the effect of the ASO treatment by for example evaluating splicing (efficiency, rate, extent) and protein production by methods known in the art and described herein. The animal models may also be any phenotypic or behavioral indication of the disease or disease severity.

Compositions and Methods for Treatment of Retinitis Pigmentosa 18 and Retinitis Pigmentosa 13

Individual introns in primary transcripts of protein-coding genes having more than one intron are spliced from the primary transcript with different efficiencies. In most cases only the fully spliced mRNA is exported through nuclear pores for subsequent translation in the cytoplasm. Unspliced and partially spliced transcripts are detectable in the nucleus. It is generally thought that nuclear accumulation of transcripts that are not fully spliced is a mechanism to prevent the accumulation of potentially deleterious mRNAs in the cytoplasm that may be translated to protein. For some genes, splicing of the least efficient intron is a rate-limiting post-transcriptional step in gene expression, prior to translation in the cytoplasm.

Substantial levels of partially-spliced transcripts of the PRPF3 and PRPF8 genes, which encode the PRPF3 protein, deficient in RP18, and the PRPF8 protein, deficient in RP13, respectively, have been discovered in the nucleus of human cells. These PRPF3 and PRPF8 pre-mRNA species comprise at least one retained intron. The present invention provides compositions and methods for upregulating splicing of one or more retained PRPF3 or PRPF8 introns that are rate-limiting for the nuclear stages of gene expression to increase steady-state production of fully-spliced, mature mRNA, and thus, translated PRPF3 or PRPF8 protein levels, respectively. These compositions and methods utilize antisense oligomers (ASOs) that promote constitutive splicing at an intron splice site of a retained-intron-containing PRPF3 or PRPF8 pre-mRNA that accumulates in the nucleus. Thus, in embodiments, PRPF3 or PRPF8 protein is increased using the methods of the invention to treat a condition caused by PRPF3 or PRPF8 protein deficiency. In other embodiments, the methods of the invention are used to increase PRPF3 or PRPF8 production to treat a condition in a subject in need thereof. In embodiments, the subject has condition in which PRPF3 or PRPF8 is not necessarily deficient relative to wild-type, but where an increase in PRPF3 or PRPF8 mitigates the condition nonetheless. In embodiments, the condition is a caused by a PRPF3 or PRPF8 haploinsufficiency.

Retinitis Pigmentosa

Retinitis pigmentosa (RP) describes a debilitating group of eye disorders, including RP18, caused by a deficiency in the PRPF3 protein, and RP13, caused by a deficiency in the PRPF8 protein. Subjects having RP experience loss of night vision in the early phase of the disorder. Over time, loss of vision begins to occur, which eventually leads to tunnel vision. This loss in vision can be attributed to a dysfunction in the rod photoreceptor system. As the disorder progresses, the afflicted patient may lose a significant portion of their cone photoreceptors before experiencing loss of visual acuity (Berger et al., 2010).

The overall prevalence of RP diseases is estimated to be about 1:3500. The mutation of over 40 genes has been correlated to incidence of RP disease through three patterns of inheritance: autosomal dominant, autosomal recessive, and X-linked. The genes that have been implicated in the progression of RP diseases can be grouped into five main categories: i) phototransduction, ii) retinal metabolism, iii) tissue development and maintenance, iv) cellular structure, and v) splicing. The genes that comprise the splicing category (PRPF3, PRPF8, PRP31 and PAP1) are responsible for the assembly of the spliceosome protein complex that is responsible for removing intronic sequences from pre-mRNA. Studies have suggested that the progression of at least some cases of RP is due to haploinsufficiency, meaning that the presence of a single dysfunctional allele results in diminished expression of the corresponding protein (Berger et al., 2010).

PRPF3

The PRPF3 gene, which spans 16 exons and is located at 1q21.1, encodes the pre-mRNA processing factor 3 (PRPF3) protein. The PRPF3 canonical mRNA sequence is set forth at NCBI Reference Sequence: NM_004698. PRPF3 is a 77 kD, 682 amino acid protein that is involved in spliceosome assembly. Dysfunction of PRPF3 has been implicated in the progression of RP 18. It has been speculated that a retina-specific splicing element may interact with PRPF3 and generate the rod photoreceptor-specific phenotype.

Missense mutations P493S and T494M in PRPF3 have both been shown to display the RP18 phenotype, linking dysfunction of PRPF3 with the RP 18 phenotype (Berger et al., 2010). RP18 and the PRPF3 gene are described by, e.g., OMIM #601414 (Online Mendelian Inheritance in Man, Johns Hopkins University, 1966-2015), incorporated by reference herein.

PRPF8

The PRPF8 gene, which spans 42 exons and is located at 17p13.3, codes for the pre-mRNA processing factor 8 (PRPF8) protein. The PRPF8 canonical mRNA sequence is set forth at NCBI Reference Sequence: NM_006445. PRPF8 is a 220 kD, 2,334 amino acid protein that is involved in spliceosome assembly. Dysfunction of PRPF8 has been implicated in the progression of RP13. PRPF8 mutants H2309P, H2309R, R2310K, P2301T, F2304L, R2310G and F2314L were found to result in the clinical phenotype of RP13, linking dysfunction of PRPF8 with RP13 (Berger et al., 2010). RP13 and the RP8 gene are described by, e.g., OMIM #600059 (Online Mendelian Inheritance in Man, Johns Hopkins University, 1966-2015), incorporated by reference herein.

Retained Intron Containing Pre-mRNA (RIC Pre-mRNA)

In embodiments, the methods of the present invention exploit the presence of retained-intron-containing pre-mRNA (RIC pre-mRNA) transcribed from the PRPF3 or the PRPF8 gene in the cell nucleus. Splicing of the identified RIC pre-mRNA species to produce mature, fully-spliced, mRNA, is induced using ASOs that stimulate splicing out of the retained introns. The resulting mature mRNA can be exported to the cytoplasm and translated, thereby increasing the amount of PRPF3 protein or PRPF8 protein in the patient's cells and alleviating symptoms of RP18 or RP13, respectively. This method, described further below, is known as Targeted Augmentation of Nuclear Gene Output (TANGO).

PRPF3 Nuclear Transcripts

As described herein in the Examples, the PRPF3 gene was analyzed for intron-retention events and retention of introns, e.g., introns 12 and 13, was observed. RNA sequencing (RNAseq), visualized in the UCSC genome browser, showed PRPF3 transcripts expressed in ARPE-19 cells and localized in either the cytoplasmic or nuclear fraction. In both fractions, reads were not observed for the majority of the introns. However, higher read density was detected for introns 12 and 13 in the nuclear fraction compared to the cytoplasmic fraction indicating that splicing efficiency of introns 12 and 13 is low, resulting in intron retention. The retained-intron containing pre-mRNA transcripts accumulate primarily in the nucleus and are not translated into the PRPF3 protein. The read density for introns 12 and 13, indicated 26%, and 33% intron retention, respectively. The percent intron retention (PIR) value for intron 12 was obtained by averaging four values (37, 35, 16, and 15). The PIR value for intron 13 was obtained similarly, by averaging the four values 34, 33, 34, and 31. Each value was determined in ARPE-19 (retinal pigmented epithelial) cells using one of four different algorithms.

In some embodiments, the PRPF3 intron number corresponds to the mRNA sequence at NM_004698. In some embodiments, the targeted portion of the PRPF3 RIC pre-mRNA is in intron 12 and/or 13. In embodiments, hybridization of an ASO to the targeted portion of a PRPF3 RIC pre-mRNA results in enhanced splicing at the splice site (5' splice site or 3' splice site) of at least one of retained PRPF3 introns 12 or 13 and subsequently increases PRPF3 protein production. It is understood that the intron numbering may change in reference to a different PRPF3 isoform sequence. One of skill in the art can determine the corresponding intron number in any PRPF3 isoform based on an intron sequence provided herein or using the intron number provided in reference to the mRNA sequence at NM_004698. One of skill in the art also can determine the sequences of flanking exons in any PRPF3 isoform for targeting using the methods of the invention, based on an intron sequence provided herein or using the intron number provided in reference to the mRNA sequence at NM_004698. In embodiments, the compositions and methods of the present invention are used to increase the expression of any known PRPF3 isoform, e.g., as described in the NCBI Gene ID database at Gene ID 9129 (NCBI repository of biological and scientific information, operated by National Center for Biotechnology Information, National Library of Medicine, 8600 Rockville Pike, Bethesda, Md. USA 20894), incorporated by reference herein.

In some embodiments, the PRPF8 intron numbering corresponds to the mRNA sequence at NM_006445. In embodiments, the targeted portion of the PRPF8 RIC pre-mRNA is in intron 31. In embodiments, hybridization of an ASO to the targeted portion of the RIC pre-mRNA results in enhanced splicing at the splice site (5' splice site or 3' splice site) of at least one of retained PRPF8 intron 31 and subsequently increases PRPF8 protein production. It is understood that the intron numbering may change in reference to a different PRPF8 isoform sequence. One of skill in the art can determine the corresponding intron number in any PRPF8 isoform based on an intron sequence provided herein or using the intron number provided in reference to the mRNA sequence at NM_006445. One of skill in the art also can determine the sequences of flanking exons in any PRPF8 isoform for targeting using the methods of the invention, based on an intron sequence provided herein or using the intron number provided in reference to the mRNA sequence at NM_006445. In embodiments, the compositions and methods of the present invention are used to increase the expression of any known PRPF8 isoform, e.g., as described in the NCBI Gene ID database at Gene ID 10594 (NCBI repository of biological and scientific information), incorporated by reference herein.

PRPF3

In some embodiments, the ASOs disclosed herein target a RIC pre-mRNA transcribed from a PRPF3 genomic sequence (a PRPF3 RIC pre-mRNA). In some embodiments, the PRPF3 genomic sequence is SEQ ID NO: 5826. In some embodiments, the PRPF3 RIC pre-mRNA is SEQ ID NO: 5828.

PRPF3: Retained Intron 12

In some embodiments, the PRPF3 RIC pre-mRNA transcript comprises retained intron 12. In some embodiments, when the PRPF3 RIC pre-mRNA transcript comprises retained intron 12, the ASOs disclosed herein target SEQ ID NO: 6272. In some embodiments, when the PRPF3 RIC pre-mRNA transcript comprises retained intron 12, the ASO has a sequence according to any one of SEQ ID NOs: 5830-6064. In some embodiments, the ASOs target a PRPF3 RIC pre-mRNA sequence.

In some embodiments, the ASO targets exon 12 of PRPF3 RIC pre-mRNA comprising a retained intron 12. In some embodiments, the ASO targets an exon 12 sequence upstream (or 5') from the 5' splice site of a PRPF3 RIC pre-mRNA comprising a retained intron 12. In some embodiments, the ASO targets an exon sequence about 4 to about 94 nucleotides upstream (or 5') from the 5' splice site of a PRPF3 RIC pre-mRNA comprising a retained intron 12. In some embodiments, the ASO has a sequence according to any one of SEQ ID NOs: 5830-5848.

In some embodiments, the ASO targets intron 12 in a PRPF3 RIC pre-mRNA comprising a retained intron 12. In some embodiments, the ASO targets an intron 12 sequence downstream (or 3') from the 5' splice site of a PRPF3 RIC pre-mRNA comprising a retained intron 12. In some embodiments, the ASO targets an intron 12 sequence about 6 to about 498 nucleotides downstream (or 3') from the 5' splice site of a PRPF3 RIC pre-mRNA comprising a retained intron 12. In some embodiments, the ASO has a sequence according to any one of SEQ ID NOs: 5849-5946.

In some embodiments, the ASO targets an intron 12 sequence upstream (or 5') from the 3' splice site of a PRPF3 RIC pre-mRNA comprising a retained intron 12. In some embodiments, the ASO targets an intron 12 sequence about 16 to about 496 nucleotides upstream (or 5') from the 3' splice site of a PRPF3 RIC pre-mRNA a comprising retained intron 12. In some embodiments, the ASO has a sequence according to any one of SEQ ID NOs: 5947-6043.

In some embodiments, the ASO targets exon 13 in a PRPF3 RIC pre-mRNA comprising a retained intron 12. In some embodiments, the ASO targets an exon 13 sequence downstream (or 3') from the 3' splice site of a PRPF3 RIC pre-mRNA comprising a retained intron 12. In some embodiments, the ASO targets an exon 13 sequence about 2 to about 102 nucleotides downstream (or 3') from the 3' splice site of a PRPF3 RIC pre-mRNA comprising a retained intron 12. In some embodiments, the ASO has a sequence according to any one of SEQ ID NOs: 6044-6064.

PRPF3: Retained Intron 13

In some embodiments, the PRPF3 RIC pre-mRNA transcript comprises retained intron 13. In some embodiments, when the PRPF3 RIC pre-mRNA transcript comprises retained intron 13, the ASOs disclosed herein target SEQ ID NO: 6271. In some embodiments, when the PRPF3 RIC pre-mRNA transcript comprises retained intron 13, the ASO has a sequence according to any one of SEQ ID NOs: 6065-6148. In some embodiments, the ASOs target a PRPF3 RIC pre-mRNA sequence.

In some embodiments, the ASO targets exon 13 of PRPF3 RIC pre-mRNA comprising a retained intron 13. In some embodiments, the ASO targets an exon 13 sequence upstream (or 5') from the 5' splice site of a PRPF3 RIC pre-mRNA comprising a retained intron 13. In some embodiments, the ASO targets an exon sequence about 4 to about 99 nucleotides upstream (or 5') from the 5' splice site of a PRPF3 RIC pre-mRNA comprising a retained intron 13. In some embodiments, the ASO has a sequence according to any one of SEQ ID NOs: 6065-6084.

In some embodiments, the ASO targets intron 13 in a PRPF3 RIC pre-mRNA comprising a retained intron 13. In some embodiments, the ASO targets an intron 13 sequence downstream (or 3') from the 5' splice site of a PRPF3 RIC pre-mRNA comprising a retained intron 13. In some embodiments, the ASO targets an intron 13 sequence about 6 to about 146 nucleotides downstream (or 3') from the 5' splice site of a PRPF3 RIC pre-mRNA comprising a retained intron 13. In some embodiments, the ASO has a sequence according to any one of SEQ ID NOs: 6085-6111.

In some embodiments, the ASO targets an intron 13 sequence upstream (or 5') from the 3' splice site of a PRPF3 RIC pre-mRNA comprising a retained intron 13. In some embodiments, the ASO targets an intron 13 sequence about 16 to about 146 nucleotides upstream (or 5') from the 3' splice site of a PRPF3 RIC pre-mRNA a comprising retained intron 13. In some embodiments, the ASO has a sequence according to any one of SEQ ID NOs: 6112-6135.

In some embodiments, the ASO targets exon 14 in a PRPF3 RIC pre-mRNA comprising a retained intron 13. In some embodiments, the ASO targets an exon 14 sequence downstream (or 3') from the 3' splice site of a PRPF3 RIC pre-mRNA comprising a retained intron 13. In some embodiments, the ASO targets an exon 14 sequence about 2 to about 67 nucleotides downstream (or 3') from the 3' splice site of a PRPF3 RIC pre-mRNA comprising a retained intron 13. In some embodiments, the ASO has a sequence according to any one of SEQ ID NOs: 6136-6148.

PRPF8

In some embodiments, the ASOs disclosed herein target a RIC pre-mRNA transcribed from a PRPF8 genomic sequence (a PRPF8 RIC pre-mRNA). In some embodiments, the PRPF8 genomic sequence is SEQ ID NO. 5827. In some embodiments, the PRPF8 RIC pre-mRNA is SEQ ID NO. 5829.

PRPF8: Retained Intron 31

In some embodiments, the PRPF8 RIC pre-mRNA transcript comprises retained intron 31. In some embodiments, when the PRPF8 RIC pre-mRNA transcript comprises retained intron 31, the ASOs disclosed herein target SEQ ID NO: 6273. In some embodiments, when the PRPF8 RIC pre-mRNA transcript comprises retained intron 31, the ASO has a sequence according to any one of SEQ ID NOs: 6149-6270. In some embodiments, the ASOs target a PRPF8 RIC pre-mRNA sequence.

In some embodiments, the ASO targets exon 31 of PRPF8 RIC pre-mRNA comprising a retained intron 31. In some embodiments, the ASO targets an exon 31 sequence upstream (or 5') from the 5' splice site of a PRPF8 RIC pre-mRNA comprising a retained intron 31. In some embodiments, the ASO targets an exon sequence about 4 to about 144 nucleotides upstream (or 5') from the 5' splice site of a PRPF8 RIC pre-mRNA comprising a retained intron 31. In some embodiments, the ASO has a sequence according to any one of SEQ ID NOs: 6149-6175.

In some embodiments, the ASO targets intron 31 in a PRPF8 RIC pre-mRNA comprising a retained intron 31. In some embodiments, the ASO targets an intron 31 sequence downstream (or 3') from the 5' splice site of a PRPF8 RIC pre-mRNA comprising a retained intron 31. In some embodiments, the ASO targets an intron 31 sequence about 6 to about 156 nucleotides downstream (or 3') from the 5' splice site of a PRPF8 RIC pre-mRNA comprising a retained intron 31. In some embodiments, the ASO has a sequence according to any one of SEQ ID NOs: 6176-6206.

In some embodiments, the ASO targets an intron 31 sequence upstream (or 5') from the 3' splice site of a PRPF8 RIC pre-mRNA comprising a retained intron 31. In some embodiments, the ASO targets an intron 31 sequence about 16 to about 156 nucleotides upstream (or 5') from the 3' splice site of a PRPF8 RIC pre-mRNA a comprising retained intron 31. In some embodiments, the ASO has a sequence according to any one of SEQ ID NOs: 6207-6235.

In some embodiments, the ASO targets exon 32 in a PRPF8 RIC pre-mRNA comprising a retained intron 31. In some embodiments, the ASO targets an exon 32 sequence downstream (or 3') from the 3' splice site of a PRPF8 RIC pre-mRNA comprising a retained intron 31. In some embodiments, the ASO targets an exon 32 sequence about 2 to about 172 nucleotides downstream (or 3') from the 3' splice site of a PRPF8 RIC pre-mRNA comprising a retained intron 31. In some embodiments, the ASO has a sequence according to any one of SEQ ID NOs: 6236-6270.

Protein Expression

As described above, PRPF3 and PRPF8 mutations in RP diseases are spread across the entire protein. In some embodiments, the methods described herein are used to increase the production of a functional PRPF3 protein. In other embodiments, the methods described herein are used to increase the production of a functional PRPF8 protein. In other embodiments, the methods described herein are used to increase the production of a functional PRPF3 protein or PRPF8 protein. As used herein, the term "functional" refers to the amount of activity or function of a PRPF3 or PRPF8 protein that is necessary to eliminate any one or more symptoms of an RP disease. In some embodiments, the methods are used to increase the production of a partially functional PRPF3 protein. In other embodiments, the methods are used to increase the production of a partially functional PRPF8 protein. In other embodiments, the methods are used to increase the production of a partially functional PRPF3 or PRPF8 protein. As used herein, the term "partially functional" refers to any amount of activity or function of the PRPF3 or PRPF8 protein that is less than the amount of activity or function that is necessary to eliminate or prevent any one or more symptoms of a disease. In some embodiments, a partially functional protein or RNA will have at least 10%, at least 20%, at least 30%, at least 40%, at least 50%, at least 60%, at least 70%, at least 75%, at least 80%, 85%, at least 90%, or at least 95% less activity relative to the fully functional protein or RNA.

In embodiments, the method is a method of increasing the expression of the PRPF3 protein by cells of a subject having a RIC pre-mRNA encoding the PRPF3 protein, wherein the subject has an RP disease caused by a deficient amount of activity of PRPF3 protein, and wherein the deficient amount of the PRPF3 protein is caused by haploinsufficiency of the PRPF3 protein. In such an embodiment, the subject has a first allele encoding a functional PRPF3 protein, and a second allele from which the PRPF3 protein is not produced. In another such embodiment, the subject has a first allele encoding a functional PRPF3 protein, and a second allele encoding a nonfunctional PRPF3 protein. In another such embodiment, the subject has a first allele encoding a functional PRPF3 protein, and a second allele encoding a partially functional PRPF3 protein. In any of these embodiments, the antisense oligomer binds to a targeted portion of the RIC pre-mRNA transcribed from the first allele (encoding functional PRPF3 protein), thereby inducing constitutive splicing of the retained intron from the RIC pre-mRNA, and causing an increase in the level of mature mRNA encoding functional PRPF3 protein, and an increase in the expression of the PRPF3 protein in the cells of the subject.

In embodiments, the method is a method of increasing the expression of the PRPF8 protein by cells of a subject having a RIC pre-mRNA encoding the PRPF8 protein, wherein the subject has an RP disease caused by a deficient amount of activity of PRPF8 protein, and wherein the deficient amount of the PRPF8 protein is caused by haploinsufficiency of the PRPF8 protein. In such an embodiment, the subject has a first allele encoding a functional PRPF8 protein, and a second allele from which the PRPF8 protein is not produced. In another such embodiment, the subject has a first allele encoding a functional PRPF8 protein, and a second allele encoding a nonfunctional PRPF8 protein. In another such embodiment, the subject has a first allele encoding a functional PRPF8 protein, and a second allele encoding a partially functional PRPF8 protein. In any of these embodiments, the antisense oligomer binds to a targeted portion of the RIC pre-mRNA transcribed from the first allele (encoding functional PRPF8 protein), thereby inducing constitutive splicing of the retained intron from the RIC pre-mRNA, and causing an increase in the level of mature mRNA encoding functional PRPF8 protein, and an increase in the expression of the PRPF8 protein in the cells of the subject.

In some embodiments, the subject has a first allele encoding a functional PRPF3 protein, and a second allele encoding a partially functional PRPF3 protein, and the antisense oligomer binds to a targeted portion of the RIC pre-mRNA transcribed from the first allele (encoding functional PRPF3 protein) or a targeted portion of the RIC pre-mRNA transcribed from the second allele (encoding partially functional PRPF3 protein), thereby inducing constitutive splicing of the retained intron from the RIC pre-mRNA, and causing an increase in the level of mature mRNA encoding the PRPF3 protein, and an increase in the expression of functional or partially functional PRPF3 protein in the cells of the subject.

In other embodiments, the subject has a first allele encoding a functional PRPF8 protein, and a second allele encoding a partially functional PRPF8 protein, and the antisense oligomer binds to a targeted portion of the RIC pre-mRNA transcribed from the first allele (encoding functional PRPF8 protein) or a targeted portion of the RIC pre-mRNA transcribed from the second allele (encoding partially functional PRPF8 protein), thereby inducing constitutive splicing of the retained intron from the RIC pre-mRNA, and causing an increase in the level of mature mRNA encoding the PRPF8 protein, and an increase in the expression of functional or partially functional PRPF8 protein in the cells of the subject.

In related embodiments, the method is a method of using an ASO to increase the expression of a protein or functional RNA. In embodiments, an ASO is used to increase the expression of PRPF3 protein in cells of a subject having a RIC pre-mRNA encoding PRPF3 protein, wherein the subject has a deficiency, e.g., RP18, in the amount or function of a PRPF3 protein.

In other related embodiments, the method is a method of using an ASO to increase the expression of a protein or functional RNA. In embodiments, an ASO is used to increase the expression of PRPF8 protein in cells of a subject having a RIC pre-mRNA encoding PRPF8 protein, wherein the subject has a deficiency, e.g., RP13, in the amount or function of a PRPF8 protein.

In embodiments, the RIC pre-mRNA transcript that encodes the protein that is causative of the disease is targeted by the ASOs described herein. In some embodiments, a RIC pre-mRNA transcript that encodes a protein that is not causative of the disease is targeted by the ASOs. For example, a disease that is the result of a mutation or deficiency of a first protein in a particular pathway may be ameliorated by targeting a RIC pre-mRNA that encodes a second protein, thereby increasing production of the second protein. In some embodiments, the function of the second protein is able to compensate for the mutation or deficiency of the first protein (which is causative of the disease or condition).

In embodiments, the subject has:
a. a first mutant allele from which
 i) the PRPF3 protein is produced at a reduced level compared to production from a wild-type allele,
 ii) the PRPF3 protein is produced in a form having reduced function compared to an equivalent wild-type protein, or
 iii) the PRPF3 protein or functional RNA is not produced; and
b. a second mutant allele from which
 i) the PRPF3 protein is produced at a reduced level compared to production from a wild-type allele,
 ii) the PRPF3 protein is produced in a form having reduced function compared to an equivalent wild-type protein, or
 iii) the PRPF3 protein is not produced, and
wherein the RIC pre-mRNA is transcribed from the first allele and/or the second allele. In these embodiments, the ASO binds to a targeted portion of the RIC pre-mRNA transcribed from the first allele or the second allele, thereby inducing constitutive splicing of the retained intron from the RIC pre-mRNA, and causing an increase in the level of mRNA encoding PRPF3 protein and an increase in the expression of the target protein or functional RNA in the cells of the subject. In these embodiments, the target protein or functional RNA having an increase in expression level resulting from the constitutive splicing of the retained intron from the RIC pre-mRNA is either in a form having reduced function compared to the equivalent wild-type protein (partially-functional), or having full function compared to the equivalent wild-type protein (fully-functional).

In embodiments, the subject has:
a. a first mutant allele from which
 i. the PRPF8 protein is produced at a reduced level compared to production from a wild-type allele,
 ii. the PRPF8 protein is produced in a form having reduced function compared to an equivalent wild-type protein, or iii. the PRPF8 protein or functional RNA is not produced; and
b. a second mutant allele from which
i. the PRPF8 protein is produced at a reduced level compared to production from a wild-type allele,
ii. the PRPF8 protein is produced in a form having reduced function compared to an equivalent wild-type protein, or
iii. the PRPF8 protein is not produced, and wherein the RIC pre-mRNA is transcribed from the first allele and/or the second allele. In these embodiments, the ASO binds to a targeted portion of the RIC pre-mRNA transcribed from the first allele or the second allele, thereby inducing constitutive splicing of the retained intron from the RIC pre-mRNA, and causing an increase in the level of mRNA encoding PRPF8 protein and an increase in the expression of the target protein or functional RNA in the cells of the subject. In these embodiments, the target protein or functional RNA having an increase in expression level resulting from the constitutive splicing of the retained intron from the RIC pre-mRNA is either in a form having reduced function compared to the equivalent wild-type protein (partially-functional), or having full function compared to the equivalent wild-type protein (fully-functional).

In embodiments, the level of mRNA encoding PRPF3 or PRPF8 protein is increased 1.1 to 10-fold, when compared to the amount of mRNA encoding PRPF3 or PRPF8 that is produced in a control cell, e.g., one that is not treated with the antisense oligomer or one that is treated with an antisense oligomer that does not bind to the targeted portion of the PRPF3 or PRPF8 RIC pre-mRNA.

In embodiments, the condition caused by a deficient amount or activity of PRPF3 or PRPF8 protein is not a condition caused by alternative or aberrant splicing of the retained intron to which the ASO is targeted. In embodiments, the condition caused by a deficient amount or activity of the PRPF3 or PRPF8 protein is not a condition caused by alternative or aberrant splicing of any retained intron in a RIC pre-mRNA encoding the PRPF3 or PRPF8 protein.

In embodiments, a subject treated using the methods of the invention expresses a partially functional PRPF3 or PRPF8 protein from one allele, wherein the partially functional PRPF3 or PRPF8 protein is caused by a frameshift mutation, a nonsense mutation, a missense mutation, or a partial gene deletion. In embodiments, a subject treated using the methods of the invention expresses a nonfunctional PRPF3 or PRPF8 protein from one allele, wherein the nonfunctional PRPF3 or PRPF8 protein is caused by a frameshift mutation, a nonsense mutation, a missense mutation, a partial gene deletion, in one allele. In embodiments, a subject treated using the methods of the invention has a PRPF3 or PRPF8 whole gene deletion, in one allele.

In some embodiments, the subject has a PRPF3 missense mutation selected from P493S and T494M. In other embodiments, the subject has a PRPF8 missense mutation selected from H2309P, H2309R, R2310K, P2301T, F2304L, R2310G and F2314L. In embodiments, a subject having any mutation known in the art and described in the literature, e.g., by McKie et al 2001 referenced above, is treated using the methods and compositions of the present invention.

Use of TANGO for Increasing Protein Expression

As described above, in embodiments, Targeted Augmentation of Nuclear Gene Output (TANGO) is used in the methods of the invention to increase expression of a PRPF3 or PRPF8 protein. In these embodiments, a retained-intron-containing pre-mRNA (RIC pre-mRNA) encoding PRPF3 or PRPF8 protein is present in the nucleus of a cell. Cells having a PRPF3 or PRPF8 RIC pre-mRNA that comprises a retained intron, an exon flanking the 5' splice site, and an exon flanking the 3' splice site, encoding the PRPF3 or PRPF8 protein, are contacted with antisense oligomers (ASOs) that are complementary to a targeted portion of the RIC pre-mRNA. Hybridization of the ASOs to the targeted portion of the RIC pre-mRNA results in enhanced splicing at the splice site (5' splice site or 3' splice site) of the retained intron and subsequently increases target protein production.

The terms "pre-mRNA," and "pre-mRNA transcript" may be used interchangeably and refer to any pre-mRNA species that contains at least one intron. In embodiments, pre-mRNA or pre-mRNA transcripts comprise a 5'-7-methylguanosine cap and/or a poly-A tail. In embodiments, pre-mRNA or pre-mRNA transcripts comprise both a 5'-7-methylguanosine cap and a poly-A tail. In some embodiments, the pre-mRNA transcript does not comprise a 5'-7-methylguanosine cap and/or a poly-A tail. A pre-mRNA transcript is a non-productive messenger RNA (mRNA) molecule if it is not translated into a protein (or transported into the cytoplasm from the nucleus).

As used herein, a "retained-intron-containing pre-mRNA" ("RIC pre-mRNA") is a pre-mRNA transcript that contains at least one retained intron. The RIC pre-mRNA contains a retained intron, an exon flanking the 5' splice site of the retained intron, an exon flanking the 3' splice site of the retained intron, and encodes the target protein. An "RIC pre-mRNA encoding a target protein" is understood to encode the target protein when fully spliced. A "retained intron" is any intron that is present in a pre-mRNA transcript when one or more other introns, such as an adjacent intron, encoded by the same gene have been spliced out of the same pre-mRNA transcript. In some embodiments, the retained intron is the most abundant intron in RIC pre-mRNA encoding the target protein. In embodiments, the retained intron is the most abundant intron in a population of RIC pre-mRNAs transcribed from the gene encoding the target protein in a cell, wherein the population of RIC pre-mRNAs comprises two or more retained introns. In embodiments, an antisense oligomer targeted to the most abundant intron in the population of RIC pre-mRNAs encoding the target protein induces splicing out of two or more retained introns in the population, including the retained intron to which the antisense oligomer is targeted or binds. In embodiments, a mature mRNA encoding the target protein is thereby produced. The terms "mature mRNA," and "fully-spliced mRNA," are used interchangeably herein to describe a fully processed mRNA encoding a target protein (e.g., mRNA that is exported from the nucleus into the cytoplasm and translated into target protein) or a fully processed functional RNA. The term "productive mRNA," also can be used to describe a fully processed mRNA encoding a target protein. In embodiments, the targeted region is in a retained intron that is the most abundant intron in a RIC pre-mRNA encoding the PRPF3 and/or PRPF8 protein. In embodiments, the most retained intron in a RIC pre-mRNA encoding the PRPF3 protein is intron 12. In embodiments, the most retained intron in a RIC pre-mRNA encoding the PRPF3 protein is intron 13. In some embodiments, the most retained intron in a RIC pre-mRNA encoding the PRPF8 protein is intron 31.

In embodiments, a retained intron is an intron that is identified as a retained intron based on a determination of at least about 5%, at least about 10%, at least about 15%, at least about 20%, at least about 25%, at least about 30%, at least about 35%, at least about 40%, at least about 45%, or at least about 50%, retention. In embodiments, a retained intron is an intron that is identified as a retained intron based on a determination of about 5% to about 100%, about 5% to about 95%, about 5% to about 90%, about 5% to about 85%, about 5% to about 80%, about 5% to about 75%, about 5% to about 70%, about 5% to about 65%, about 5% to about 60%, about 5% to about 65%, about 5% to about 60%, about 5% to about 55%, about 5% to about 50%, about 5% to about 45%, about 5% to about 40%, about 5% to about 35%, about 5% to about 30%, about 5% to about 25%, about 5% to about 20%, about 5% to about 15%, about 10% to about 100%, about 10% to about 95%, about 10% to about 90%, about 10% to about 85%, about 10% to about 80%, about 10% to about 75%, about 10% to about 70%, about 10% to about 65%, about 10% to about 60%, about 10% to about 65%, about 10% to about 60%, about 10% to about 55%, about 10% to about 50%, about 10% to about 45%, about 10% to about 40%, about 10% to about 35%, about 10% to about 30%, about 10% to about 25%, about 10% to about 20%, about 15% to about 100%, about 15% to about 95%, about 15% to about 90%, about 15% to about 85%, about 15% to about 80%, about 15% to about 75%, about 15% to about 70%, about 15% to about 65%, about 15% to about 60%, about 15% to about 65%, about 15% to about 60%, about 15% to about 55%, about 15% to about 50%, about 15% to about 45%, about 15% to about 40%, about 15% to about 35%, about 15% to about 30%, about 15% to about 25%, about 20% to about 100%, about 20% to about 95%, about 20% to about 90%, about 20% to about 85%, about 20% to about 80%, about 20% to about 75%, about 20% to about 70%, about 20% to about 65%, about 20% to about 60%, about 20% to about 65%, about 20% to about 60%, about 20% to about 55%, about 20% to about 50%, about 20% to about 45%, about 20% to about 40%, about 20% to about 35%, about 20% to about 30%, about 25% to about 100%, about 25% to about 95%, about 25% to about 90%, about 25% to about 85%, about 25% to about 80%, about 25% to about 75%, about 25% to about 70%, about 25% to about 65%, about 25% to about 60%, about 25% to about 65%, about 25% to about 60%, about 25% to about 55%, about 25% to about 50%, about 25% to about 45%, about 25% to about 40%, or about 25% to about 35%, retention. ENCODE data (described by, e.g., Tilgner, et al., 2012, "Deep sequencing of subcellular RNA fractions shows splicing to be predominantly co-transcriptional in the human genome but inefficient for lncRNAs," Genome Research 22(9):1616-25) can be used to aid in identifying retained introns.

As used herein, the term "comprise" or variations thereof such as "comprises" or "comprising" are to be read to indicate the inclusion of any recited feature (e.g. in the case of an antisense oligomer, a defined nucleobase sequence) but not the exclusion of any other features. Thus, as used herein, the term "comprising" is inclusive and does not exclude additional, unrecited features (e.g. in the case of an antisense oligomer, the presence of additional, unrecited nucleobases).

In embodiments of any of the compositions and methods provided herein, "comprising" may be replaced with "consisting essentially of" or "consisting of" The phrase "consisting essentially of" is used herein to require the specified feature(s) (e.g. nucleobase sequence) as well as those which do not materially affect the character or function of the claimed invention. As used herein, the term "consisting" is used to indicate the presence of the recited feature (e.g. nucleobase sequence) alone (so that in the case of an antisense oligomer consisting of a specified nucleobase sequence, the presence of additional, unrecited nucleobases is excluded).

In embodiments, the targeted region is in a retained intron that is the second most abundant intron in a population of RIC pre-mRNA encoding the PRPF3 or PRPF8 protein. For example, the second most abundant retained intron may be targeted rather than the most abundant retained intron due to the uniqueness of the nucleotide sequence of the second most abundant retained intron, ease of ASO design to target a particular nucleotide sequence, and/or amount of increase in protein production resulting from targeting the intron with an ASO. In embodiments, the retained intron is the second most abundant intron in a population of RIC pre-mRNAs transcribed from the gene encoding the target protein in a cell, wherein the population of RIC pre-mRNAs comprises two or more retained introns. In embodiments, an antisense oligomer targeted to the second most abundant intron in the population of RIC pre-mRNAs encoding the target protein induces splicing out of two or more retained introns in the population, including the retained intron to which the antisense oligomer is targeted or binds. In embodiments, fully-spliced (mature) RNA encoding the target protein is thereby produced. In embodiments, the second-most abundant retained intron in a population of RIC pre-mRNA encoding the PRPF3 protein is intron 12. In embodiments, the second-most abundant retained intron in a population of RIC pre-mRNA encoding the PRPF3 protein is intron 13.

In embodiments, an ASO is complementary to a targeted region that is within a non-retained intron in a RIC pre-mRNA. In embodiments, the targeted portion of the RIC pre-mRNA is within: the region +6 to +100 relative to the 5' splice site of the non-retained intron; or the region −16 to −100 relative to the 3' splice site of the non-retained intron. In embodiments, the targeted portion of the RIC pre-mRNA is within the region +100 relative to the 5' splice site of the non-retained intron to −100 relative to the 3' splice site of the non-retained intron. As used to identify the location of a region or sequence, "within" is understood to include the residues at the positions recited. For example, a region +6 to +100 includes the residues at positions +6 and +100. In embodiments, fully-spliced (mature) RNA encoding the target protein is thereby produced.

In embodiments, the retained intron of the RIC pre-mRNA is an inefficiently spliced intron. As used herein, "inefficiently spliced" may refer to a relatively low frequency of splicing at a splice site adjacent to the retained intron (5' splice site or 3' splice site) as compared to the frequency of splicing at another splice site in the RIC pre-mRNA. The term "inefficiently spliced" may also refer to the relative rate or kinetics of splicing at a splice site, in which an "inefficiently spliced" intron may be spliced or removed at a slower rate as compared to another intron in a RIC pre-mRNA.

In embodiments, the 9-nucleotide sequence at −3e to −1e of the exon flanking the 5' splice site and +1 to +6 of the retained intron is identical to the corresponding wild-type sequence. In embodiments, the 16 nucleotide sequence at −15 to −1 of the retained intron and +1e of the exon flanking the 3' splice site is identical to the corresponding wild-type sequence. As used herein, the "wild-type sequence" refers to the nucleotide sequence for the PRPF3 or PRPF8 gene in the published reference genome deposited in the NCBI repository of biological and scientific information. As used herein, the "wild-type PRPF3 sequence" refers to the canonical sequence available at NCBI Gene ID 9129. As used herein, the "wild-type PRPF8 sequence" refers to the canonical sequence available at NCBI Gene ID 10594. Also used herein, a nucleotide position denoted with an "e" indicates the nucleotide is present in the sequence of an exon (e.g., the exon flanking the 5' splice site or the exon flanking the 3' splice site).

The methods involve contacting cells with an ASO that is complementary to a portion of a pre-mRNA encoding PRPF3 or PRPF8 protein, resulting in increased expression of the PRPF3 or PRPF8 protein, respectively. As used herein, "contacting" or administering to cells refers to any method of providing an ASO in immediate proximity with the cells such that the ASO and the cells interact. A cell that is contacted with an ASO will take up or transport the ASO into the cell. The method involves contacting a condition or disease-associated or condition or disease-relevant cell with any of the ASOs described herein. In some embodiments, the ASO may be further modified or attached (e.g., covalently attached) to another molecule to target the ASO to a cell type, enhance contact between the ASO and the condition or disease-associated or condition or disease-relevant cell, or enhance uptake of the ASO.

As used herein, the term "increasing protein production" or "increasing expression of a target protein" means enhancing the amount of protein that is translated from an mRNA in a cell. A "target protein" may be any protein for which increased expression/production is desired.

In embodiments, contacting a cell that expresses a PRPF3 or PRPF8 RIC pre-mRNA with an ASO that is complementary to a targeted portion of the PRPF3 or PRPF8 RIC pre-mRNA transcript results in a measurable increase in the amount of the PRPF3 or PRPF8 protein (e.g., a target protein) encoded by the pre-mRNA. Methods of measuring or detecting production of a protein will be evident to one of skill in the art and include any known method, for example, Western blotting, flow cytometry, immunofluorescence microscopy, and ELISA.

In embodiments, contacting cells with an ASO that is complementary to a targeted portion of a PRPF3 and/or PRPF8 RIC pre-mRNA transcript results in an increase in the amount of PRPF3 and/or PRPF8 protein produced by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of PRPF3 or PRPF8 protein produced by the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the amount of target protein produced by an control compound. A control compound can be, for example, an oligonucleotide that is not complementary to the targeted portion of the RIC pre-mRNA.

In some embodiments, contacting cells with an ASO that is complementary to a targeted portion of a PRPF3 or PRPF8 RIC pre-mRNA transcript results in an increase in the amount of mRNA encoding PRPF3 or PRPF8, including the mature mRNA encoding the target protein. In some embodiments, the amount of mRNA encoding PRPF3 or PRPF8 protein, or the mature mRNA encoding the PRPF3 or PRPF8 protein, is increased by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of the mRNA encoding PRPF3 or PRPF8 protein, or the mature mRNA encoding PRPF3 or PRPF8 protein produced in the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold compared to the amount of mature RNA produced in an untreated cell, e.g., an untreated cell or a cell treated with a control compound. A control compound can be, for example, an oligonucleotide that is not complementary to the targeted portion of the PRPF3 or PRPF8 RIC pre-mRNA.

Constitutive Splicing of a Retained Intron from a RIC pre-mRNA

The methods and antisense oligonucleotide compositions provided herein are useful for increasing the expression of PRPF3 or PRPF8 protein in cells, for example, in a subject having RP caused by a deficiency in the amount or activity of PRPF3 or PRPF8 protein, by increasing the level of mRNA encoding PRPF3 or PRPF8 protein, or the mature mRNA encoding PRPF3 or PRPF8 protein. In particular, the methods and compositions as described herein induce the constitutive splicing of a retained intron from a PRPF3 or PRPF8 RIC pre-mRNA transcript encoding PRPF3 or PRPF8 protein, thereby increasing the level of mRNA encoding PRPF3 or PRPF8 protein, or the mature mRNA encoding PRPF3 or PRPF8 protein and increasing the expression of PRPF3 or PRPF8 protein.

Constitutive splicing of a retained intron from a RIC pre-mRNA correctly removes the retained intron from the RIC pre-mRNA, wherein the retained intron has wild-type splice sequences. Constitutive splicing, as used herein, does not encompass splicing of a retained intron from a RIC pre-mRNA transcribed from a gene or allele having a mutation that causes alternative splicing or aberrant splicing of a pre-mRNA transcribed from the gene or allele. For example, constitutive splicing of a retained intron, as induced using the methods and antisense oligonucleotides provided herein, does not correct aberrant splicing in or influence alternative splicing of a pre-mRNA to result in an increased expression of a target protein or functional RNA.

In embodiments, constitutive splicing correctly removes a retained intron from a PRPF3 or PRPF8 RIC pre-mRNA, wherein the PRPF3 or PRPF8 RIC pre-mRNA is transcribed from a wild-type gene or allele, or a polymorphic gene or allele, that encodes a fully-functional target protein or functional RNA, and wherein the gene or allele does not have a mutation that causes alternative splicing or aberrant splicing of the retained intron.

In some embodiments, constitutive splicing of a retained intron from a PRPF3 or PRPF8 RIC pre-mRNA encoding PRPF3 or PRPF8 protein correctly removes a retained intron from a PRPF3 or PRPF8 RIC pre-mRNA encoding PRPF3 or PRPF8 protein, wherein the PRPF3 or PRPF8 RIC pre-mRNA is transcribed from a gene or allele from which the target gene or functional RNA is produced at a reduced level compared to production from a wild-type allele, and wherein the gene or allele does not have a mutation that causes alternative splicing or aberrant splicing of the retained intron. In these embodiments, the correct removal of the constitutively spliced retained intron results in production of target protein or functional RNA that is functional when compared to an equivalent wild-type protein or functional RNA.

In other embodiments, constitutive splicing correctly removes a retained intron from a PRPF3 or PRPF8 RIC pre-mRNA, wherein the PRPF3 or PRPF8 RIC pre-mRNA is transcribed from a gene or allele that encodes a target protein or functional RNA produced in a form having reduced function compared to an equivalent wild-type protein or functional RNA, and wherein the gene or allele does not have a mutation that causes alternative splicing or aberrant splicing of the retained intron. In these embodiments, the correct removal of the constitutively spliced retained intron results in production of partially functional target protein, or functional RNA that is partially functional when compared to an equivalent wild-type protein or functional RNA.

"Correct removal" of the retained intron by constitutive splicing refers to removal of the entire intron, without removal of any part of an exon.

In embodiments, an antisense oligomer as described herein or used in any method described herein does not increase the amount of mRNA encoding PRPF3 or PRPF8 protein or the amount of PRPF3 or PRPF8 protein by modulating alternative splicing or aberrant splicing of a pre-mRNA transcribed from the PRPF3 or PRPF8 gene. Modulation of alternative splicing or aberrant splicing can be measured using any known method for analyzing the sequence and length of RNA species, e.g., by RT-PCR and using methods described elsewhere herein and in the literature. In embodiments, modulation of alternative or aberrant splicing is determined based on an increase or decrease in the amount of the spliced species of interest of at least 10% or 1.1-fold. In embodiments, modulation is determined based on an increase or decrease at a level that is at least 10% to 100% or 1.1 to 10-fold, as described herein regarding determining an increase in mRNA encoding PRPF3 or PRPF8 protein in the methods of the invention.

In embodiments, the method is a method wherein the PRPF3 or PRPF8 RIC pre-mRNA was produced by partial splicing of a wild-type PRPF3 or PRPF8 pre-mRNA. In embodiments, the method is a method wherein the PRPF3 or PRPF8 RIC pre-mRNA was produced by partial splicing of a full-length wild-type PRPF3 or PRPF8 pre-mRNA. In embodiments, the PRPF3 or PRPF8 RIC pre-mRNA was produced by partial splicing of a full-length PRPF3 or PRPF8 pre-mRNA. In these embodiments, a full-length PRPF3 or PRPF8 pre-mRNA may have a polymorphism in a splice site of the retained intron that does not impair correct splicing of the retained intron as compared to splicing of the retained intron having the wild-type splice site sequence.

In embodiments, the mRNA encoding PRPF3 or PRPF8 protein is a full-length mature mRNA, or a wild-type mature mRNA. In these embodiments, a full-length mature mRNA may have a polymorphism that does not affect the activity of the target protein or the functional RNA encoded by the mature mRNA, as compared to the activity of PRPF3 or PRPF8 protein encoded by the wild-type mature mRNA.

Antisense Oligomers

One aspect of the present disclosure is a composition comprising antisense oligomers that enhances splicing by binding to a targeted portion of a PRPF3 or PRPF8 RIC pre-mRNA. As used herein, the terms "ASO" and "antisense oligomer" are used interchangeably and refer to an oligomer such as a polynucleotide, comprising nucleobases that hybridizes to a target nucleic acid (e.g., a PRPF3 or PRPF8 RIC pre-mRNA) sequence by Watson-Crick base pairing or wobble base pairing (G-U). The ASO may have exact sequence complementary to the target sequence or near complementarity (e.g., sufficient complementarity to bind the target sequence and enhancing splicing at a splice site). ASOs are designed so that they bind (hybridize) to a target nucleic acid (e.g., a targeted portion of a pre-mRNA transcript) and remain hybridized under physiological conditions. Typically, if they hybridize to a site other than the intended (targeted) nucleic acid sequence, they hybridize to a limited number of sequences that are not a target nucleic acid (to a few sites other than a target nucleic acid). Design of an ASO can take into consideration the occurrence of the nucleic acid sequence of the targeted portion of the pre-mRNA transcript or a sufficiently similar nucleic acid sequence in other locations in the genome or cellular pre-mRNA or transcriptome, such that the likelihood the ASO will bind other sites and cause "off-target" effects is limited. Any antisense oligomers known in the art, for example in PCT Application No. PCT/US2014/054151, published as WO 2015/035091, titled "Reducing Nonsense-Mediated mRNA Decay," can be used to practice the methods described herein.

In some embodiments, ASOs "specifically hybridize" to or are "specific" to a target nucleic acid or a targeted portion of a RIC pre-mRNA. Typically such hybridization occurs with a Tm substantially greater than 37° C., preferably at least 50° C., and typically between 60° C. to approximately 90° C. Such hybridization preferably corresponds to stringent hybridization conditions. At a given ionic strength and pH, the Tm is the temperature at which 50% of a target sequence hybridizes to a complementary oligonucleotide.

Oligomers, such as oligonucleotides, are "complementary" to one another when hybridization occurs in an antiparallel configuration between two single-stranded polynucleotides. A double-stranded polynucleotide can be "complementary" to another polynucleotide, if hybridization can occur between one of the strands of the first polynucleotide and the second. Complementarity (the degree to which one polynucleotide is complementary with another) is quantifiable in terms of the proportion (e.g., the percentage) of bases in opposing strands that are expected to form hydrogen bonds with each other, according to generally accepted base-pairing rules. The sequence of an antisense oligomer (ASO) need not be 100% complementary to that of its target nucleic acid to hybridize. In certain embodiments, ASOs can comprise at least 70%, at least 75%, at least 80%, at least 85%, at least 90%, at least 95%, at least 96%, at least 97%, at least 98%, or at least 99% sequence complementarity to a target region within the target nucleic acid sequence to which they are targeted. For example, an ASO in which 18 of 20 nucleobases of the oligomeric compound are complementary to a target region, and would therefore specifically hybridize, would represent 90 percent complementarity. In this example, the remaining non-complementary nucleobases may be clustered together or interspersed with complementary nucleobases and need not be contiguous to each other or to complementary nucleobases. Percent complementarity of an ASO with a region of a target nucleic acid can be determined routinely using BLAST programs (basic local alignment search tools) and PowerBLAST programs known in the art (Altschul et al., J. Mol. Biol., 1990, 215, 403-410; Zhang and Madden, Genome Res., 1997, 7, 649-656).

An ASO need not hybridize to all nucleobases in a target sequence and the nucleobases to which it does hybridize may be contiguous or noncontiguous. ASOs may hybridize over one or more segments of a pre-mRNA transcript, such that intervening or adjacent segments are not involved in the hybridization event (e.g., a loop structure or hairpin structure may be formed). In certain embodiments, an ASO hybridizes to noncontiguous nucleobases in a target pre-mRNA transcript. For example, an ASO can hybridize to nucleobases in a pre-mRNA transcript that are separated by one or more nucleobase(s) to which the ASO does not hybridize.

The ASOs described herein comprise nucleobases that are complementary to nucleobases present in a target portion of a RIC pre-mRNA. The term ASO embodies oligonucleotides and any other oligomeric molecule that comprises nucleobases capable of hybridizing to a complementary nucleobase on a target mRNA but does not comprise a sugar moiety, such as a peptide nucleic acid (PNA). The ASOs may comprise naturally-occurring nucleotides, nucleotide analogs, modified nucleotides, or any combination of two or three of the preceding. The term "naturally occurring nucleotides" includes deoxyribonucleotides and ribonucleotides. The term "modified nucleotides" includes nucleotides with modified or substituted sugar groups and/or having a modified backbone. In some embodiments, all of the nucleotides of the ASO are modified nucleotides. Chemical modifications of ASOs or components of ASOs that are compatible with the methods and compositions described herein will be evident to one of skill in the art and can be found, for example, in U.S. Pat. No. 8,258,109 B2, U.S. Pat. No. 5,656,612, U.S. Patent Publication No. 2012/0190728, and Dias and Stein, Mol. Cancer Ther. 2002, 1, 347-355, herein incorporated by reference in their entirety.

The nucleobase of an ASO may be any naturally occurring, unmodified nucleobase such as adenine, guanine, cytosine, thymine and uracil, or any synthetic or modified nucleobase that is sufficiently similar to an unmodified nucleobase such that it is capable of hydrogen bonding with a nucleobase present on a target pre-mRNA. Examples of modified nucleobases include, without limitation, hypoxanthine, xanthine, 7-methylguanine, 5,6-dihydrouracil, 5-methylcytosine, and 5-hydroxymethoylcytosine.

The ASOs described herein also comprise a backbone structure that connects the components of an oligomer. The term "backbone structure" and "oligomer linkages" may be used interchangeably and refer to the connection between monomers of the ASO. In naturally occurring oligonucleotides, the backbone comprises a 3'-5' phosphodiester linkage connecting sugar moieties of the oligomer. The backbone structure or oligomer linkages of the ASOs described herein may include (but are not limited to) phosphorothioate, phosphorodithioate, phosphoroselenoate, phosphorodiselenoate, phosphoroanilothioate, phosphoraniladate, phosphoramidate, and the like. See e.g., LaPlanche et al., Nucleic Acids Res. 14:9081 (1986); Stec et al., J. Am. Chem. Soc. 106:6077 (1984), Stein et al., Nucleic Acids Res. 16:3209 (1988), Zon et al., Anti Cancer Drug Design 6:539 (1991); Zon et al., Oligonucleotides and Analogues: A Practical Approach, pp. 87-108 (F. Eckstein, Ed., Oxford University Press, Oxford England (1991)); Stec et al., U.S. Pat. No. 5,151,510; Uhlmann and Peyman, Chemical Reviews 90:543 (1990). In some embodiments, the backbone structure of the ASO does not contain phosphorous but rather contains peptide bonds, for example in a peptide nucleic acid (PNA), or linking groups including carbamate, amides, and linear and cyclic hydrocarbon groups. In some embodiments, the backbone modification is a phosphothioate linkage. In some embodiments, the backbone modification is a phosphoramidate linkage.

In embodiments, the stereochemistry at each of the phosphorus internucleotide linkages of the ASO backbone is random. In embodiments, the stereochemistry at each of the phosphorus internucleotide linkages of the ASO backbone is controlled and is not random. For example, U.S. Pat. App. Pub. No. 2014/0194610, "Methods for the Synthesis of Functionalized Nucleic Acids," incorporated herein by reference, describes methods for independently selecting the handedness of chirality at each phosphorous atom in a nucleic acid oligomer. In embodiments, an ASO used in the methods of the invention, including, but not limited to, any of the ASOs set forth herein in Table 6, comprises an ASO having phosphorus internucleotide linkages that are not random. In embodiments, a composition used in the methods of the invention comprises a pure diastereomeric ASO. In embodiments, a composition used in the methods of the invention comprises an ASO that has diastereomeric purity of at least about 90%, at least about 91%, at least about 92%, at least about 93%, at least about 94%, at least about 95%, at least about 96%, at least about 97%, at least about 98%, at least about 99%, about 100%, about 90% to about 100%, about 91% to about 100%, about 92% to about 100%, about 93% to about 100%, about 94% to about 100%, about 95% to about 100%, about 96% to about 100%, about 97% to about 100%, about 98% to about 100%, or about 99% to about 100%.

In embodiments, the ASO has a nonrandom mixture of Rp and Sp configurations at its phosphorus internucleotide linkages. For example, it has been suggested that a mix of Rp and Sp is required in antisense oligonucleotides to achieve a balance between good activity and nuclease stability (Wan, et al., 2014, "Synthesis, biophysical properties and biological activity of second generation antisense oligonucleotides containing chiral phosphorothioate linkages," Nucleic Acids Research 42(22): 13456-13468, incorporated herein by reference). In embodiments, an ASO used in the methods of the invention, including, but not limited to, any of the ASOs set forth herein in Table 1, comprises about 5-100% Rp, at least about 5% Rp, at least about 10% Rp, at least about 15% Rp, at least about 20% Rp, at least about 25% Rp, at least about 30% Rp, at least about 35% Rp, at least about 40% Rp, at least about 45% Rp, at least about 50% Rp, at least about 55% Rp, at least about 60% Rp, at least about 65% Rp, at least about 70% Rp, at least about 75% Rp, at least about 80% Rp, at least about 85% Rp, at least about 90% Rp, or at least about 95% Rp, with the remainder Sp, or about 100% Rp. In embodiments, an ASO used in the methods of the invention, including, but not limited to, any of the ASOs set forth herein in Table 6, comprises about 10% to about 100% Rp, about 15% to about 100% Rp, about 20% to about 100% Rp, about 25% to about 100% Rp, about 30% to about 100% Rp, about 35% to about 100% Rp, about 40% to about 100% Rp, about 45% to about 100% Rp, about 50% to about 100% Rp, about 55% to about 100% Rp, about 60% to about 100% Rp, about 65% to about 100% Rp, about 70% to about 100% Rp, about 75% to about 100% Rp, about 80% to about 100% Rp, about 85% to about 100% Rp, about 90% to about 100% Rp, or about 95% to about 100% Rp, about 20% to about 80% Rp, about 25% to about 75% Rp, about 30% to about 70% Rp, about 40% to about 60% Rp, or about 45% to about 55% Rp, with the remainder Sp.

In embodiments, an ASO used in the methods of the invention, including, but not limited to, any of the ASOs set forth herein in Table 6, comprises about 5-100% Sp, at least about 5% Sp, at least about 10% Sp, at least about 15% Sp, at least about 20% Sp, at least about 25% Sp, at least about 30% Sp, at least about 35% Sp, at least about 40% Sp, at least about 45% Sp, at least about 50% Sp, at least about 55% Sp, at least about 60% Sp, at least about 65% Sp, at least about 70% Sp, at least about 75% Sp, at least about 80% Sp, at least about 85% Sp, at least about 90% Sp, or at least about 95% Sp, with the remainder Rp, or about 100% Sp. In embodiments, an ASO used in the methods of the invention, including, but not limited to, any of the ASOs set forth herein in Table 6, comprises about 10% to about 100% Sp, about 15% to about 100% Sp, about 20% to about 100% Sp, about 25% to about 100% Sp, about 30% to about 100% Sp, about 35% to about 100% Sp, about 40% to about 100% Sp, about 45% to about 100% Sp, about 50% to about 100% Sp, about 55% to about 100% Sp, about 60% to about 100% Sp, about 65% to about 100% Sp, about 70% to about 100% Sp, about 75% to about 100% Sp, about 80% to about 100% Sp, about 85% to about 100% Sp, about 90% to about 100% Sp, or about 95% to about 100% Sp, about 20% to about 80% Sp, about 25% to about 75% Sp, about 30% to about 70% Sp, about 40% to about 60% Sp, or about 45% to about 55% Sp, with the remainder Rp.

Any of the ASOs described herein may contain a sugar moiety that comprises ribose or deoxyribose, as present in naturally occurring nucleotides, or a modified sugar moiety or sugar analog, including a morpholine ring. Non-limiting examples of modified sugar moieties include 2' substitutions such as 2'-O-methyl (2'-O-Me), 2'-O-methoxyethyl (2'MOE), 2'-O-aminoethyl, 2'F; N3'→P5' phosphoramidate, 2'dimethylaminooxyethoxy, 2'dimethylaminoethoxyethoxy, 2'-guanidinidium, 2'-O-guanidinium ethyl, carbamate modified sugars, and bicyclic modified sugars. In some embodiments, the sugar moiety modification is selected from 2'-O-Me, 2'F, and 2'MOE. In some embodiments, the sugar moiety modification is an extra bridge bond, such as in a locked nucleic acid (LNA). In some embodiments the sugar analog contains a morpholine ring, such as phosphorodiamidate morpholino (PMO). In some embodiments, the sugar moiety comprises a ribofuransyl or 2'deoxyribofuransyl modification. In some embodiments, the sugar moiety comprises 2'4'-constrained 2'O-methyloxyethyl (cMOE) modifications. In some embodiments, the sugar moiety comprises cEt 2', 4' constrained 2'-O ethyl BNA modifications. In some embodiments, the sugar moiety comprises tricycloDNA (tcDNA) modifications. In some embodiments, the sugar moiety comprises ethylene nucleic acid (ENA) modifications. In some embodiments, the sugar moiety comprises MCE modifications. Modifications are known in the art and described in the literature, e.g., by Jarver, et al., 2014, "A Chemical View of Oligonucleotides for Exon Skipping and Related Drug Applications," Nucleic Acid Therapeutics 24(1): 37-47, incorporated by reference for this purpose herein.

In some examples, each monomer of the ASO is modified in the same way, for example each linkage of the backbone of the ASO comprises a phosphorothioate linkage or each ribose sugar moiety comprises a 2'O-methyl modification. Such modifications that are present on each of the monomer components of an ASO are referred to as "uniform modifications." In some examples, a combination of different modifications may be desired, for example, an ASO may comprise a combination of phosphorodiamidate linkages and sugar moieties comprising morpholine rings (morpholinos). Combinations of different modifications to an ASO are referred to as "mixed modifications" or "mixed chemistries."

In some embodiments, the ASO comprises one or more backbone modification. In some embodiments, the ASO comprises one or more sugar moiety modification. In some embodiments, the ASO comprises one or more backbone modification and one or more sugar moiety modification. In some embodiments, the ASO comprises 2'MOE modifications and a phosphorothioate backbone. In some embodiments, the ASO comprises a phosphorodiamidate morpholino (PMO). In some embodiments, the ASO comprises a peptide nucleic acid (PNA). Any of the ASOs or any component of an ASO (e.g., a nucleobase, sugar moiety, backbone) described herein may be modified in order to achieve desired properties or activities of the ASO or reduce undesired properties or activities of the ASO. For example, an ASO or one or more component of any ASO may be modified to enhance binding affinity to a target sequence on a pre-mRNA transcript; reduce binding to any non-target sequence; reduce degradation by cellular nucleases (i.e., RNase H); improve uptake of the ASO into a cell and/or into the nucleus of a cell; alter the pharmacokinetics or pharmacodynamics of the ASO; and modulate the half-life of the ASO.

In some embodiments, the ASOs are comprised of 2'-O-(2-methoxyethyl) (MOE) phosphorothioate-modified nucleotides. ASOs comprised of such nucleotides are especially well-suited to the methods disclosed herein; oligomers having such modifications have been shown to have significantly enhanced resistance to nuclease degradation and increased bioavailability, making them suitable, for example, for oral delivery in some embodiments described herein. See e.g., Geary et al., J Pharmacol Exp Ther. 2001; 296(3):890-7; Geary et al., J Pharmacol Exp Ther. 2001; 296(3):898-904.

Methods of synthesizing ASOs will be known to one of skill in the art. Alternatively or in addition, ASOs may be obtained from a commercial source.

Unless specified otherwise, the left-hand end of single-stranded nucleic acid (e.g., pre-mRNA transcript, oligonucleotide, ASO, etc.) sequences is the 5' end and the left-hand direction of single or double-stranded nucleic acid sequences is referred to as the 5' direction. Similarly, the right-hand end or direction of a nucleic acid sequence (single or double stranded) is the 3' end or direction. Generally, a region or sequence that is 5' to a reference point in a nucleic acid is referred to as "upstream," and a region or sequence that is 3' to a reference point in a nucleic acid is referred to as "downstream." Generally, the 5' direction or end of an mRNA is where the initiation or start codon is located, while the 3' end or direction is where the termination codon is located. In some aspects, nucleotides that are upstream of a reference point in a nucleic acid may be designated by a negative number, while nucleotides that are downstream of a reference point may be designated by a positive number. For example, a reference point (e.g., an exon-exon junction in mRNA) may be designated as the "zero" site, and a nucleotide that is directly adjacent and upstream of the reference point is designated "minus one,"

e.g., "−1," while a nucleotide that is directly adjacent and downstream of the reference point is designated "plus one," e.g., "+1."

In other embodiments, the ASOs are complementary to (and bind to) a targeted portion of a PRPF3 or PRPF8 RIC pre-mRNA that is downstream (in the 3' direction) of the 5' splice site of the retained intron in a PRPF3 or PRPF8 RIC pre-mRNA (e.g., the direction designated by positive numbers relative to the 5' splice site) (FIG. 1). In some embodiments, the ASOs are complementary to a targeted portion of the PRPF3 or PRPF8 RIC pre-mRNA that is within the region +6 to +100 relative to the 5' splice site of the retained intron. In some embodiments, the ASO is not complementary to nucleotides +1 to +5 relative to the 5' splice site (the first five nucleotides located downstream of the 5' splice site). In some embodiments, the ASOs may be complementary to a targeted portion of a PRPF3 or PRPF8 RIC pre-mRNA that is within the region between nucleotides +6 and +50 relative to the 5' splice site of the retained intron. In some aspects, the ASOs are complementary to a targeted portion that is within the region +6 to +90, +6 to +80, +6 to +70, +6 to +60, +6 to +50, +6 to +40, +6 to +30, or +6 to +20 relative to 5' splice site of the retained intron.

In some embodiments, the ASOs are complementary to a targeted region of a PRPF3 or PRPF8 RIC pre-mRNA that is upstream (5' relative) of the 3' splice site of the retained intron in a PRPF3 or PRPF8 RIC pre-mRNA (e.g., in the direction designated by negative numbers) (FIG. 1). In some embodiments, the ASOs are complementary to a targeted portion of the PRPF3 or PRPF8 RIC pre-mRNA that is within the region −16 to −100 relative to the 3' splice site of the retained intron. In some embodiments, the ASO is not complementary to nucleotides −1 to −15 relative to the 3' splice site (the first 15 nucleotides located upstream of the 3' splice site). In some embodiments, the ASOs are complementary to a targeted portion of the PRPF3 or PRPF8 RIC pre-mRNA that is within the region −16 to −50 relative to the 3' splice site of the retained intron. In some aspects, the ASOs are complementary to a targeted portion that is within the region −16 to −90, −16 to −80, −16 to −70, −16 to −60, −16 to −50, −16 to −40, or −16 to −30 relative to 3' splice site of the retained intron.

In embodiments, the targeted portion of the PRPF3 or PRPF8 RIC pre-mRNA is within the region +100 relative to the 5' splice site of the retained intron to −100 relative to the 3' splice site of the retained intron.

In some embodiments, the ASOs are complementary to a targeted portion of a PRPF3 or PRPF8 RIC pre-mRNA that is within the exon flanking the 5' splice site (upstream) of the retained intron (FIG. 1). In some embodiments, the ASOs are complementary to a targeted portion of the PRPF3 or PRPF8 RIC pre-mRNA that is within the region +2e to −4e in the exon flanking the 5' splice site of the retained intron. In some embodiments, the ASOs are not complementary to nucleotides −1e to −3e relative to the 5' splice site of the retained intron. In some embodiments, the ASOs are complementary to a targeted portion of the PRPF3 or PRPF8 RIC pre-mRNA that is within the region −4e to −100e, −4e to −90e, −4e to −80e, −4e to −70e, −4e to −60e, −4e to −50e, −4 to −40e, −4e to −30e, or −4e to −20e relative to the 5' splice site of the retained intron.

In some embodiments, the ASOs are complementary to a targeted portion of a PRPF3 or PRPF8 RIC pre-mRNA that is within the exon flanking the 3' splice site (downstream) of the retained intron (FIG. 1). In some embodiments, the ASOs are complementary to a targeted portion to the PRPF3 or PRPF8 RIC pre-mRNA that is within the region +2e to −4e in the exon flanking the 3' splice site of the retained intron. In some embodiments, the ASOs are not complementary to nucleotide +1e relative to the 3' splice site of the retained intron. In some embodiments, the ASOs are complementary to a targeted portion of the PRPF3 or PRPF8 RIC pre-mRNA that is within the region +2e to +100e, +2e to +90e, +2e to +80e, +2e to +70e, +2e to +60e, +2e to +50e, +2e to +40e, +2e to +30e, or +2 to +20e relative to the 3' splice site of the retained intron. The ASOs may be of any length suitable for specific binding and effective enhancement of splicing. In some embodiments, the ASOs consist of 8 to 50 nucleobases. For example, the ASO may be 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, or 50 nucleobases in length. In some embodiments, the ASOs consist of more than 50 nucleobases. In some embodiments, the ASO is from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, 12 to 15 nucleobases, 13 to 50 nucleobases, 13 to 40 nucleobases, 13 to 35 nucleobases, 13 to 30 nucleobases, 13 to 25 nucleobases, 13 to 20 nucleobases, 14 to 50 nucleobases, 14 to 40 nucleobases, 14 to 35 nucleobases, 14 to 30 nucleobases, 14 to 25 nucleobases, 14 to 20 nucleobases, 15 to 50 nucleobases, 15 to 40 nucleobases, 15 to 35 nucleobases, 15 to 30 nucleobases, 15 to 25 nucleobases, 15 to 20 nucleobases, 20 to 50 nucleobases, 20 to 40 nucleobases, 20 to 35 nucleobases, 20 to 30 nucleobases, 20 to 25 nucleobases, 25 to 50 nucleobases, 25 to 40 nucleobases, 25 to 35 nucleobases, or 25 to 30 nucleobases in length. In some embodiments, the ASOs are 18 nucleotides in length. In some embodiments, the ASOs are 15 nucleotides in length. In some embodiments, the ASOs are 25 nucleotides in length.

In some embodiments, two or more ASOs with different chemistries but complementary to the same targeted portion of the RIC pre-mRNA are used. In some embodiments, two or more ASOs that are complementary to different targeted portions of the RIC pre-mRNA are used.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties, and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

In some embodiments, the nucleic acid to be targeted by an ASO is a PRPF3 or PRPF8 RIC pre-mRNA expressed in a cell, such as a eukaryotic cell. In some embodiments, the term "cell" may refer to a population of cells. In some embodiments, the cell is in a subject. In some embodiments, the cell is isolated from a subject. In some embodiments, the cell is ex vivo. In some embodiments, the cell is a condition or disease-relevant cell or a cell line. In some embodiments, the cell is in vitro (e.g., in cell culture).

Pharmaceutical Compositions

Pharmaceutical compositions or formulations comprising the antisense oligonucleotide of the described compositions and for use in any of the described methods can be prepared according to conventional techniques well known in the pharmaceutical industry and described in the published literature. In embodiments, a pharmaceutical composition or formulation for treating a subject comprises an effective amount of any antisense oligomer as described above, or a pharmaceutically acceptable salt, solvate, hydrate or ester thereof, and a pharmaceutically acceptable diluent. The antisense oligomer of a pharmaceutical formulation may further comprise a pharmaceutically acceptable excipient, diluent or carrier.

Pharmaceutically acceptable salts are suitable for use in contact with the tissues of humans and lower animals without undue toxicity, irritation, allergic response, etc., and are commensurate with a reasonable benefit/risk ratio. (See, e.g., S. M. Berge, et al., J. Pharmaceutical Sciences, 66: 1-19 (1977), incorporated herein by reference for this purpose. The salts can be prepared in situ during the final isolation and purification of the compounds, or separately by reacting the free base function with a suitable organic acid. Examples of pharmaceutically acceptable, nontoxic acid addition salts are salts of an amino group formed with inorganic acids such as hydrochloric acid, hydrobromic acid, phosphoric acid, sulfuric acid and perchloric acid or with organic acids such as acetic acid, oxalic acid, maleic acid, tartaric acid, citric acid, succinic acid or malonic acid or by using other documented methodologies such as ion exchange. Other pharmaceutically acceptable salts include adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, lower alkyl sulfonate and aryl sulfonate.

In embodiments, the compositions are formulated into any of many possible dosage forms such as, but not limited to, tablets, capsules, gel capsules, liquid syrups, soft gels, suppositories, and enemas. In embodiments, the compositions are formulated as suspensions in aqueous, non-aqueous or mixed media. Aqueous suspensions may further contain substances that increase the viscosity of the suspension including, for example, sodium carboxymethylcellulose, sorbitol and/or dextran. The suspension may also contain stabilizers. In embodiments, a pharmaceutical formulation or composition of the present invention includes, but is not limited to, a solution, emulsion, microemulsion, foam or liposome-containing formulation (e.g., cationic or noncationic liposomes).

The pharmaceutical composition or formulation of the present invention may comprise one or more penetration enhancer, carrier, excipients or other active or inactive ingredients as appropriate and well known to those of skill in the art or described in the published literature. In embodiments, liposomes also include sterically stabilized liposomes, e.g., liposomes comprising one or more specialized lipids. These specialized lipids result in liposomes with enhanced circulation lifetimes. In embodiments, a sterically stabilized liposome comprises one or more glycolipids or is derivatized with one or more hydrophilic polymers, such as a polyethylene glycol (PEG) moiety. In embodiments, a surfactant is included in the pharmaceutical formulation or compositions. The use of surfactants in drug products, formulations and emulsions is well known in the art. In embodiments, the present invention employs a penetration enhancer to effect the efficient delivery of the antisense oligonucleotide, e.g., to aid diffusion across cell membranes and/or enhance the permeability of a lipophilic drug. In embodiments, the penetration enhancer is a surfactant, fatty acid, bile salt, chelating agent, or non-chelating nonsurfactant.

In embodiments, the pharmaceutical formulation comprises multiple antisense oligonucleotides. In embodiments, the antisense oligonucleotide is administered in combination with another drug or therapeutic agent. In embodiments, the antisense oligonucleotide is administered with one or more agents capable of promoting penetration of the subject antisense oligonucleotide across the blood-brain barrier by any method known in the art. For example, delivery of agents by administration of an adenovirus vector to motor neurons in muscle tissue is described in U.S. Pat. No. 6,632,427, "Adenoviral-vector-mediated gene transfer into medullary motor neurons," incorporated herein by reference. Delivery of vectors directly to the brain, e.g., the striatum, the thalamus, the hippocampus, or the substantia nigra, is described, e.g., in U.S. Pat. No. 6,756,523, "Adenovirus vectors for the transfer of foreign genes into cells of the central nervous system particularly in brain," incorporated herein by reference.

In embodiments, the antisense oligonucleotides are linked or conjugated with agents that provide desirable pharmaceutical or pharmacodynamic properties. In embodiments, the antisense oligonucleotide is coupled to a substance, known in the art to promote penetration or transport across the blood-brain barrier, e.g., an antibody to the transferrin receptor. In embodiments, the antisense oligonucleotide is linked with a viral vector, e.g., to render the antisense compound more effective or increase transport across the blood-brain barrier. In embodiments, osmotic blood brain barrier disruption is assisted by infusion of sugars, e.g., meso erythritol, xylitol, D(+) galactose, D(+) lactose, D(+) xylose, dulcitol, myo-inositol, L(−) fructose, D(−) mannitol, D(+) glucose, D(+) arabinose, D(−) arabinose, cellobiose, D(+) maltose, D(+) raffinose, L(+) rhamnose, D(+) melibiose, D(−) ribose, adonitol, D(+) arabitol, L(−) arabitol, D(+) fucose, L(−) fucose, D(−) lyxose, L(+) lyxose, and L(−) lyxose, or amino acids, e.g., glutamine, lysine, arginine, asparagine, aspartic acid, cysteine, glutamic acid, glycine, histidine, leucine, methionine, phenylalanine, proline, serine, threonine, tyrosine, valine, and taurine. Methods and materials for enhancing blood brain barrier penetration are described, e.g., in U.S. Pat. No. 4,866,042, "Method for the delivery of genetic material across the blood brain barrier," U.S. Pat. No. 6,294,520, "Material for passage through the blood-brain barrier," and U.S. Pat. No. 6,936,589, "Parenteral delivery systems," each incorporated herein by reference.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties, and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

Treatment of Subjects

Any of the compositions provided herein may be administered to an individual. "Individual" may be used interchangeably with "subject" or "patient." An individual may be a mammal, for example a human or animal such as a non-human primate, a rodent, a rabbit, a rat, a mouse, a horse, a donkey, a goat, a cat, a dog, a cow, a pig, or a sheep. In embodiments, the individual is a human. In embodiments, the individual is a fetus, an embryo, or a child. In other embodiments, the individual may be another eukaryotic organism, such as a plant. In some embodiments, the compositions provided herein are administered to a cell ex vivo.

In some embodiments, the compositions provided herein are administered to an individual as a method of treating a disease or disorder. In some embodiments, the individual has a genetic disease, such as any of the diseases described herein. In some embodiments, the individual is at risk of having the disease, such as any of the diseases described herein. In some embodiments, the individual is at increased risk of having a disease or disorder caused by insufficient amount of a protein or insufficient activity of a protein. If an individual is "at an increased risk" of having a disease or disorder caused insufficient amount of a protein or insufficient activity of a protein, the method involves preventative or prophylactic treatment. For example, an individual may be at an increased risk of having such a disease or disorder because of family history of the disease. Typically, individuals at an increased risk of having such a disease or disorder benefit from prophylactic treatment (e.g., by preventing or delaying the onset or progression of the disease or disorder).

Suitable routes for administration of ASOs of the present invention may vary depending on cell type to which delivery of the ASOs is desired. The eye is the most significantly affected tissue in RP13 and RP18. An ASO of the present invention may therefore be administered to a subject by intravitreal injection, by subretinal injection, or by topical application to the eye. In embodiments, an ASO of the present invention administered to a subject via an implant, e.g., an encapsulated drug implanted in the eye. In embodiments, RPE cells treated ex vivo with an ASO of the present invention are implanted in the eye, e.g., in encapsulated form. In embodiments, therapy is administered in conjunction with existing treatments for RP, e.g., oral acetazolamide, calcium channel blockers, lutein or zeaxanthin, oral valproic acid, or an immunosuppressive agent. In embodiments, ASOs are administered parenterally. In embodiments, ASOs of the present invention are administered to a subject orally, by intraperitoneal injection, intramuscular injection, subcutaneous injection, or intravenous injection. In embodiments, a fetus is treated in utero, e.g., by administering the ASO composition to the fetus directly or indirectly (e.g., via the mother).

In embodiments, subjects treated using the methods and compositions are evaluated for improvement in condition using any methods known and described in the art.

Methods of Identifying Additional ASOs that Enhance Splicing

Also within the scope of the present invention are methods for identifying (determining) additional ASOs that enhance splicing of a PRPF3 or PRPF8 RIC pre-mRNA, specifically at the target intron. ASOs that specifically hybridize to different nucleotides within the target region of the pre-mRNA may be screened to identify (determine) ASOs that improve the rate and/or extent of splicing of the target intron. In some embodiments, the ASO may block or interfere with the binding site(s) of a splicing repressor(s)/silencer. Any method known in the art may be used to identify (determine) an ASO that when hybridized to the target region of the intron results in the desired effect (e.g., enhanced splicing, protein or functional RNA production). These methods also can be used for identifying ASOs that enhance splicing of the retained intron by binding to a targeted region in an exon flanking the retained intron, or in a non-retained intron. An example of a method that may be used is provided below.

A round of screening, referred to as an ASO "walk" may be performed using ASOs that have been designed to hybridize to a target region of a pre-mRNA. For example, the ASOs used in the ASO walk can be tiled every 5 nucleotides from approximately 100 nucleotides upstream of the 5' splice site of the retained intron (e.g., a portion of sequence of the exon located upstream of the target/retained intron) to approximately 100 nucleotides downstream of the 5' splice site of the target/retained intron and/or from approximately 100 nucleotides upstream of the 3' splice site of the retained intron to approximately 100 nucleotides downstream of the 3' splice site of the target/retained intron (e.g., a portion of sequence of the exon located downstream of the target/retained intron). For example, a first ASO of 15 nucleotides in length may be designed to specifically hybridize to nucleotides +6 to +20 relative to the 5' splice site of the target/retained intron. A second ASO is designed to specifically hybridize to nucleotides +11 to +25 relative to the 5' splice site of the target/retained intron. ASOs are designed as such spanning the target region of the pre-mRNA. In embodiments, the ASOs can be tiled more closely, e.g., every 1, 2, 3, or 4 nucleotides. Further, the ASOs can be tiled from 100 nucleotides downstream of the 5' splice site, to 100 nucleotides upstream of the 3' splice site.

One or more ASOs, or a control ASO (an ASO with a scrambled sequence, sequence that is not expected to hybridize to the target region) are delivered, for example by transfection, into a disease-relevant cell line that expresses the target pre-mRNA (e.g., the RIC pre-mRNA described elsewhere herein). The splicing-inducing effects of each of the ASOs may be assessed by any method known in the art, for example by reverse transcriptase (RT)-PCR using primers that span the splice junction, as described herein (see "Identification of intron-retention events"). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

A second round of screening, referred to as an ASO "micro-walk" may be performed using ASOs that have been designed to hybridize to a target region of a pre-mRNA. The ASOs used in the ASO micro-walk are tiled every 1 nucleotide to further refine the nucleotide acid sequence of the pre-mRNA that when hybridized with an ASO results in enhanced splicing.

Regions defined by ASOs that promote splicing of the target intron are explored in greater detail by means of an ASO "micro-walk", involving ASOs spaced in 1-nt steps, as well as longer ASOs, typically 18-25 nt.

As described for the ASO walk above, the ASO micro-walk is performed by delivering one or more ASOs, or a control ASO (an ASO with a scrambled sequence, sequence that is not expected to hybridize to the target region), for example by transfection, into a disease-relevant cell line that expresses the target pre-mRNA. The splicing-inducing effects of each of the ASOs may be assessed by any method known in the art, for example by reverse transcriptase (RT)-PCR using primers that span the splice junction, as described herein (see "Identification of intron-retention events"). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

ASOs that when hybridized to a region of a pre-mRNA result in enhanced splicing and increased protein production may be tested in vivo using animal models, for example transgenic mouse models in which the full-length human gene has been knocked-in or in humanized mouse models of disease. Suitable routes for administration of ASOs may vary depending on the disease and/or the cell types to which delivery of the ASOs is desired. ASOs may be administered, for example, by intravitreal injection, by subretinal injection, by topical application to the eye, or by an encapsulated drug implanted in the eye. Following administration, the cells, tissues, and/or organs of the model animals may be assessed to determine the effect of the ASO treatment by for example evaluating splicing (efficiency, rate, extent) and protein production by methods known in the art and described herein. The animal models may also be any phenotypic or behavioral indication of the disease or disease severity.

Compositions and Methods for Treatment of Central Nervous System Diseases

Individual introns in primary transcripts of protein-coding genes having more than one intron are spliced from the primary transcript with different efficiencies. In most cases only the fully spliced mRNA is exported through nuclear pores for subsequent translation in the cytoplasm. Unspliced and partially spliced transcripts are detectable in the nucleus. It is generally thought that nuclear accumulation of transcripts that are not fully spliced is a mechanism to prevent the accumulation of potentially deleterious mRNAs in the cytoplasm that may be translated to protein. For some genes, splicing of the least efficient intron is a rate-limiting post-transcriptional step in gene expression, prior to translation in the cytoplasm.

Substantial levels of partially-spliced transcripts encoding the: ATP1A2 protein, deficient in Familial hemiplegic migraine-2, Familial Basilar migraine, and Alternating hemiplegia of childhood; CACNA1A protein, deficient in Episodic ataxia type 2 (EA2), Familial hemiplegic migraine, and Spinocerebellar ataxia type 6; SETD5 protein, deficient in Mental retardation-23 (MRD23), and 3p25 microdeletion syndrome; SHANK3 protein, deficient in Phelan-McDermid syndrome (PHMDS), and Schizophrenia-15 (SCZD15); NF2 protein, deficient in Neurofibromatosis, type 2, Meningioma, NF2-related, and Schwannomatosis 1; DNMT1 protein, deficient in Hereditary sensory neuropathy type IE (HSN1E), Autosomal dominant cerebellar ataxia, deafness, and narcolepsy (ADCADN); TCF4 protein, deficient in Pitt-hopkins syndrome; RAI1 protein, deficient in Smith-magenis syndrome; PEX1 protein, deficient in PEROXISOME BIOGENESIS DISORDER 1A (Zellweger syndrome)(PBD1A), and Heimler syndrome-1 (HMLR1); ARSA protein, deficient in Metachromatic Leukodystrophy; EIF2B5 protein/EIF2B1 protein/EIF2B2, deficient in Leukoencephalopathy with vanishing white matter (VWM); NPC1 protein, deficient in Niemann-Pick disease type C1 and Niemann-Pick disease type D; ADAR protein, deficient in Aicardi-Goutieres syndrome-6 (AGS6); MFSD8 protein, deficient in Neuronal ceroid lipofuscinosis-7; STXBP1 protein, deficient in early infantile epileptic encephalopathy-4; PRICKLE2 protein, deficient in progressive myoclonic epilepsy 5; PRRT2 protein, deficient in familial infantile convulsion with paroxysmal choreoathetosis, episodic kinesigenic dyskinesia 1, or benign familial infantile seizuers-2; IDUA protein, deficient in attenuated MPS-1 (Hurler-scheie syndrome); and STX1B protein, deficient in generalized Epilepsy with febrile seizure plus type 9 have been discovered in the nucleus of human cells. These ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, and STX1B pre-mRNA species comprise at least one retained intron. The present invention provides compositions and methods for upregulating splicing of one or more retained ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B introns that are rate-limiting for the nuclear stages of gene expression to increase steady-state production of fully-spliced, mature mRNA, and thus, translated ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein levels. These compositions and methods can utilize antisense oligomers (ASOs) that promote constitutive splicing at intron splice sites of a retained-intron-containing ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B pre-mRNA (RIC pre-mRNA) that accumulates in the nucleus. Thus, in embodiments, ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein can be increased using the methods of the invention to treat a condition caused by ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B deficiency.

In some embodiments, disclosed herein are compositions and methods for upregulating splicing of one or more retained ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B introns that are rate-limiting for the nuclear stages of gene expression to increase steady-state production of fully-spliced, mature mRNA, and thus, translated ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein levels. These compositions and methods can utilize antisense oligomers (ASOs) that promote constitutive splicing at intron splice sites of a retained-intron-containing ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B pre-mRNA (RIC pre-mRNA) that accumulates in the nucleus. Thus, in embodiments, ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein can be increased using the methods of the invention to treat a condition caused by ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B deficiency.

In some embodiments, disclosed herein are compositions and methods for upregulating splicing of one or more retained ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B introns that are rate-limiting for the nuclear stages of gene expression to increase steady-state production of fully-spliced, mature mRNA, and thus, translated ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B protein levels. These compositions and methods can utilize antisense oligomers (ASOs) that promote constitutive splicing at intron splice sites of a retained-intron-containing ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B pre-mRNA (RIC pre-mRNA) that accumulates in the nucleus. Thus, in embodiments, ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B protein can be increased using the methods of the invention to treat a condition caused by ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B deficiency.

In other embodiments, the methods of the invention can be used to increase ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B production to treat a condition in a subject in need thereof. In embodiments, the subject has a condition in which ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B is not necessarily deficient relative to wild-type, but where an increase in ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B mitigates the condition nonetheless. In embodiments, the condition can be caused by a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B haploinsufficiency.

In other embodiments, the methods of the invention can be used to increase ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B production to treat a condition in a subject in need thereof. In embodiments, the subject has a condition in which ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B is not necessarily deficient relative to wild-type, but where an increase in ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B mitigates the condition nonetheless. In embodiments, the condition can be caused by a ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B haploinsufficiency.

In additional embodiments, the methods of the invention can be used to increase ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B production to treat a condition in a subject in need thereof. In embodiments, the subject has a condition in which ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B is not necessarily deficient relative to wild-type, but where an increase in ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B mitigates the condition nonetheless. In embodiments, the condition can be caused by a ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B haploinsufficiency.

In embodiments, the described compositions and methods are used to treat a subject or patient having a CNS disease or condition that is caused by a deficiency in the target protein. In embodiments the described compositions and methods are used to treat a subject or patient having a CNS disease or condition that is not caused by a deficiency in the target protein. In embodiments, the subject or patient having a CNS disease or condition can benefit from increased production of the target protein by supplementing normal production of the target protein. In embodiments, the target protein acts on a secondary target to ameliorate or treat the CNS disease or condition in the subject. In embodiments, the secondary target protein is deficient in the subject. In embodiments, the secondary target protein is not deficient in the subject.

ATP1A2

ATP1A2, encodes the α2 isoform of Na+K+-ATPase (sodium potassium ATPase). The α2 isoform belongs to the family of P-type cation transport ATPases, and to the sub-family of Na+/K+-ATPases. Na+/K+-ATPase is an integral membrane protein responsible for establishing and maintaining the electrochemical gradients of Na and K ions across the plasma membrane. These gradients are essential for osmoregulation, for sodium-coupled transport of a variety of organic and inorganic molecules, and for electrical excitability of nerve and muscle. Na+/K+-ATPase transfers Na+ out and K+ into the cell, using ATP as energy source. Na+/K+ ATPases are present in all human cells; however, the α2 isoform is mainly restricted to the brain and muscle. Na+/K+-ATPases that include the α-2 subunit are primarily found in glia cells, particularly in astrocytes, where they contribute to the glial clearance of high extracellular K+ to prevent further depolarization. Through its action in glia, the Na+/K+-ATPase plays a critical role in the normal function of neurons. Communication between neurons depend neurotransmitters. Briefly, neurons release neurotransmitters, which bind to receptor proteins on neighboring neurons. After the neurotransmitters have had their effect, neurotransmitters detach from their receptors and are removed from the spaces between neurons by glia. The Na+/K+ ATPase helps regulate this process by stimulating glia to clear neurotransmitters from the spaces between neurons. Na+/K+-ATPases also removes excess potassium ions from these spaces. In humans, mutations in ATP1A2 are associated with genetic diseases, for example familial hemiplegic migraine-2 (FHM2), familial basilar migraine and alternating hemiplegia of childhood.

Familial Hemiplegic Migraine-2

Familial hemiplegic migraine-2 (FHM2) and familial basilar migraine are caused by heterozygous mutation in ATP1A2. FHM2 is a monogenic variant of migraine with aura. Migraines can cause intense, throbbing pain in one area of the head, often accompanied by nausea, vomiting, and extreme sensitivity to light and sound. These recurrent headaches can begin in childhood or adolescence and can be triggered by certain foods, emotional stress, and minor head trauma. Each headache may last from a few hours to a few days. In some types of migraine, including familial hemiplegic migraine, a pattern of neurological symptoms called an aura precedes the headache. The most common symptoms associated with an aura are temporary visual changes such as blind spots (scotomas), flashing lights, zig-zagging lines, and double vision. In people with familial hemiplegic migraine, auras are also characterized by temporary numbness or weakness, often affecting one side of the body (hemiparesis). Additional features of an aura can include difficulty with speech, confusion, and drowsiness. An aura can develops gradually over a few minutes and lasts about an hour. Familial hemiplegic migraine episodes includes fever, seizures, prolonged weakness, coma, and, rarely, death. Although most people with familial hemiplegic migraine recover completely between episodes, neurological symptoms such as memory loss and problems with attention can last for weeks or months. About 20 percent of people with this condition develop mild but permanent difficulty coordinating movements (ataxia), which may worsen with time, and rapid, involuntary eye movements called nystagmus.

FHM 2 is caused by mutations present in ATP1A2. The mutations and deficiencies in ATP1A2 that cause FHM2 are responsible for approximately 20% of FHM in families. There are over 50 mutations in ATP1A2 that have been identified in association with FHM2. Almost all FHM2 mutations are non-synonymous SNPs, but there are also small deletions and a mutation affecting the stop codon, causing an extension of the ATP1A2 protein by 27 amino acid residues. Most of the mutations are associated with pure FHM without additional clinical symptoms. ATP1A2 is expressed primarily in astrocytes in the adult, where it appears functionally coupled to various transporters (glutamate transporter and $Na^+/Ca^{2+}$ exchanger), and is essential in the clearance of released glutamate and potassium from the extracellular space during neuronal activity. FHM2 mutations that cause loss of function of ATP1A2 may lead to decreased glutamate clearance and an increase of potassium in the synaptic cleft during neuronal activity, which could lead to prolonged recovery time after neuronal excitation, and may render the brain to be more susceptible to cortical spreading depression. Cortical spreading depression is a wave of continual strong neuronal depolarization that slowly progresses across the cortex, generating a brief intense spike of activity that is followed by long-lasting neural suppression. Cortical spreading depression has been shown to activate the trigeminovascular system which is responsible for the headache associated with migraines.

There are two hypothesized mechanisms for the effects of ATP1A2 mutations. First, the mutations cause an increase in extracellular potassium, which can result in the impaired clearance of potassium ions and therefore induce Cortical spreading depression. Second, since the distribution of ATP1A2 is co-localized with the $Na^+/Ca^{2+}$ exchanger, the mutations to ATP1A2 would cause intracellular sodium to increase, which increases intracellular calcium levels through the $Na^+/Ca^{2+}$ exchanger, resulting in glutamate release and a decrease in glutamate clearance which can also lead to Cortical spreading depression. Both hypotheses result in making the brain more susceptible to Cortical spreading depression and therefore more migraines with aura.

Recently, a number of ATP1A2 mutations were reported to be associated with FHM and cerebellar problems, specifically motor problems, childhood convulsions, epilepsy, and mental retardation. Some ATP1A2 mutations have been shown to be associated with non-hemiplegic migraine phenotypes, such as basilar migraine and the common migraine.

Familial Basilar Migraine

Basilar migraine is a subtype of migraine with aura in which the aura symptoms originate from the brainstem or reflect the simultaneous involvement of both hemispheres.

Alternating Hemiplegia of Childhood

Alternating hemiplegia of childhood is an autosomal dominant condition. Alternating hemiplegia of childhood can result from new mutations in the gene and occur in people with no history of the disorder in their family. The primary feature of this condition is recurrent episodes of temporary paralysis, often affecting one side of the body (hemiplegia). During some episodes, the paralysis alternates from one side to the other or affects both sides of the body at the same time. The known ATP1A2 gene mutation associated with this condition replaces a single amino acid in Na+/K+ ATPase: the amino acid threonine is replaced with the amino acid asparagine at protein position 378. This genetic change can impair the protein's ability to transport ions. In addition to paralysis, affected individuals can have sudden attacks of uncontrollable muscle activity; these can cause involuntary limb movements (choreoathetosis), muscle tensing (dystonia), movement of the eyes (nystagmus), or shortness of breath (dyspnea). Individuals with alternating hemiplegia of childhood may also experience sudden redness and warmth (flushing) or unusual paleness (pallor) of the skin. These attacks can occur during or separately from episodes of hemiplegia. The episodes of hemiplegia or uncontrolled movements can be triggered by certain factors, such as stress, extreme tiredness, cold temperatures, or bathing, although the trigger is not always known. The number and length of the episodes initially worsen throughout childhood but then begin to decrease over time. The uncontrollable muscle movements may disappear entirely, but the episodes of hemiplegia occur throughout life. Alternating hemiplegia of childhood also causes mild to severe cognitive problems. Almost all affected individuals have some level of developmental delay and intellectual disability. Their cognitive functioning typically declines over time.

CACNA1A

The CACNA1A gene encodes the alpha-1 subunit of the calcium channel CaV2.1. Voltage-dependent Ca(2+) channels not only mediate the entry of Ca(2+) ions into excitable cells but are also involved in a variety of Ca(2+)-dependent processes, including muscle contraction, hormone or neurotransmitter release, and gene expression. Diriong et al. (1995) noted that calcium channels are multisubunit complexes and that the channel activity is directed by a pore-forming alpha-1 subunit, which is often sufficient to generate voltage-sensitive Ca(2+) channel activity. This subunit forms the pore through which calcium ions can flow. CaV2.1 channels play an essential role in neuronal communication. These channels help control the release of neurotransmitters, and are involved in neuronal plasticity. Different mutations in the alpha-1 subunit the CaV2.1 calcium channel are responsible for familial hemiplegic migraine (FHM), episodic ataxia type 2 (EA2), and spinocerebellar ataxia type 6 (SCA6). Missense and splice site mutations have been found in FHM and episodic ataxia type 2 (EA2), respectively, whereas a CAG repeat in the CACNA1A gene was found expanded in patients with spinocerebellar ataxia type 6 (SCA6).

Episodic Ataxia Type 2 (EA2)

Episodic ataxia is a group of related conditions that affect the nervous system and cause problems with movement. People with episodic ataxia have recurrent episodes of poor coordination and balance (ataxia). During these episodes, many affected individuals also experience dizziness (vertigo), nausea and vomiting, migraine headaches, blurred or double vision, slurred speech, and ringing in the ears (tinnitus). Seizures, muscle weakness, and paralysis affecting one side of the body (hemiplegia) may also occur during attacks. Additionally, some affected individuals have a muscle abnormality called myokymia during or between episodes. This abnormality can cause muscle cramping, stiffness, and continuous, fine muscle twitching that appears as rippling under the skin.

Episodes of ataxia and other symptoms can begin anytime from early childhood to adulthood. They can be triggered by environmental factors such as emotional stress, caffeine, alcohol, certain medications, physical activity, and illness. The frequency of attacks ranges from several per day to one or two per year. Between episodes, some affected individuals continue to experience ataxia, which may worsen over time, as well as involuntary eye movements called nystagmus.

Researchers have identified at least seven types of episodic ataxia, designated type 1 through type 7. The types are distinguished by their pattern of signs and symptoms, age of onset, length of attacks, and, when known, genetic cause.

More than 50 mutations in the CACNA1A gene have been found to cause episodic ataxia type 2 (EA2), the most common form of episodic ataxia. In addition to problems with coordination and balance (ataxia), EA2 is associated with involuntary eye movements called nystagmus. The CACNA1A mutations responsible for EA2 reduce the production of functional CaV2.1 channels or prevent these channels from reaching the cell membrane, where they are needed to transport calcium ions. A decrease in the number of these channels reduces the total flow of calcium ions into neurons, which disrupts the release of neurotransmitters in the brain. Although changes in signaling between neurons underlie the episodes of uncoordinated movement seen in people with episodic ataxia, it is unclear how altered calcium ion transport causes the specific features of the condition.

Familial Hemiplegic Migraine

At least 20 mutations in the CACNA1A gene have been identified in people with familial hemiplegic migraine type 1 (FHM1). FHM is characterized by an aura of hemiplegia that is always associated with at least one other aura symptom (e.g., hemianopsia, hemisensory deficit, aphasia). The aura is followed by a moderate to severe headache. In FHM1, the aura includes temporary numbness or weakness on one side of the body (hemiparesis). Like EA2, FHM1 is commonly associated with ataxia and nystagmus. Most of the mutations that cause FHM1 change single amino acids in the CaV2.1 channel. The most common mutation, which has been found in more than a dozen affected families, replaces the amino acid threonine with the amino acid methionine at protein position 666.

The CACNA1A mutations responsible for familial hemiplegic migraine change the structure of the CaV2.1 channel. The altered channels open more easily than usual, which increases the inward flow of calcium ions. A greater influx of calcium ions through CaV2.1 channels increases the cell's release of neurotransmitters. The resulting changes in signaling between neurons lead to development of these severe headaches in people with familial hemiplegic migraine. Approximately 50% of families with FHM, including all those with permanent cerebellar symptoms, have missense mutations in CACNA1A [Battistini et al 1999, Ducros et al 1999, Friend et al 1999].

Spinocerebellar Ataxia Type 6

Spinocerebellar ataxia type 6 is a late-onset, autosomal dominant disorder. Spinocerebellar ataxia type 6 (SCA6) is another disorder caused by CACNA1A gene mutations. The major features of this condition include progressive ataxia, nystagmus, and impaired speech (dysarthria), most often beginning in a person's forties or fifties. SCA6 results from an increased number of copies (expansion) of the CAG trinucleotide repeat in the CACNA1A gene. Most cases of SCA6 are a result of CAG repeat expansion beyond the normal range, i.e., more than 19 repeats. In people with this condition, the CAG segment is repeated from 20 to more than 30 times. An increase in the length of the CAG segment leads to the production of an abnormally long version of the alpha-1 subunit. The abnormal subunit is found in the cell membrane as well as in the cytoplasm, where it clusters together and forms aggregates. The effect these aggregates have on cell functioning is unknown. The lack of normal calcium channels impairs the cells' ability to transport calcium ions. These changes alter the release of neurotransmitters in the brain and eventually lead to the death of neurons. Certain neurons called Purkinje cells seem to be particularly sensitive to a disruption in calcium transport. Purkinje cells are located in the part of the brain that coordinates movement (cerebellum). Over time, the loss of Purkinje cells and other cells of the cerebellum causes the movement problems characteristic of SCA6.

SETD5

SETD5 expression in adult brain, followed by spinal cord, most isolated adult brain regions, and ovary. Much lower expression was detected in other adult peripheral tissues and in fetal brain and liver. The SETD5 gene encodes a 1,442-residue protein that is a putative methyltransferase. Mutations in this gene have been associated with autosomal dominant mental retardation-23.

Mental Retardation-23 (MRD23)

Autosomal dominant mental retardation-23 (MRD23) is caused by heterozygous mutation in the SETD5 gene on chromosome 3p25. Mental retardation, autosomal dominant 23 (MRD23) is a disorder characterized by significantly below average general intellectual functioning associated with impairments in adaptive behavior and manifested during the developmental period. MRD23 patients manifest moderate to severe intellectual disability with additional variable features of brachycephaly, a low hairline, depressed nasal bridge, prominent high nasal root, tubular nose, upslanting palpebral fissures, long and smooth philtrum, micrognathia, thin upper lip, and crowded teeth. Behavioral problems, including obsessive-compulsive disorder, hand flapping with ritualized behavior, and autism, are prominent features. The disease is caused by mutations affecting the gene represented in this entry.

3p25 Microdeletion Syndrome

De novo loss-of-function mutations in SETD5, encoding a methyltransferase in a 3p25 microdeletion syndrome critical region, causes intellectual disability. Characteristic features of the distal 3p-syndrome include low birth weight, microcephaly, trigonocephaly, hypotonia, psychomotor and growth retardation, ptosis, telecanthus, downslanting palpebral fissures, and micrognathia. Postaxial polydactyly, renal anomalies, cleft palate, congenital heart defects (especially atrioventricular septal defects), preauricular pits, sacral dimple, and gastrointestinal anomalies are variable features. Although intellectual deficits are almost invariably associated with cytogenetically visible 3p deletions, rare patients with a 3p26-p25 deletion and normal intelligence or only mild abnormalities have been described.

SHANK3

In humans, SHANK3 encodes SH3 and multiple ankyrin repeat domains 3 (SHANK3), also known as proline-rich synapse-associated protein 2 (ProSAP2). Northern blot analysis indicated that human PSAP2 is expressed primarily in brain as 7- and 8-kb transcripts. The SHANK3 gene spans 60 kb and contains 22 exons. In rats and humans, PSAP2 is expressed preferentially in cerebral cortex and cerebellum. This gene is a member of the Shank gene family. Shank proteins are multidomain scaffold proteins of the postsynaptic density that connect neurotransmitter receptors, ion channels, and other membrane proteins to the actin cytoskeleton and G-protein-coupled signaling pathways. Shank proteins also play a role in synapse formation and dendritic spine maturation. SHANK3 is one of the genes disrupted in patients with the 22q13.3 deletion syndrome, also known as Phelan-McDermid syndrome.

Phelan-McDermid Syndrome (PHMDS)

Phelan-McDermid syndrome (PHMDS) can be caused by a heterozygous contiguous gene deletion at chromosome 22q13 or by mutation in the SHANK3 gene. Phelan-McDermid syndrome is a developmental disorder with variable features. Common features include neonatal hypotonia, global developmental delay, normal to accelerated growth, absent to severely delayed speech, autistic behavior, and minor dysmorphic features. Other less common features associated with this syndrome included increased tolerance to pain, dysplastic toenails, chewing behavior, fleshy hands, dysplastic ears, pointed chin, dolichocephaly, ptosis, tendency to overheat, and epicanthic folds. Researchers have showed that Phelan-McDermid syndrome neurons have reduced SHANK3 expression and major defects in excitatory, but not inhibitory, synaptic transmission. Excitatory synaptic transmission in Phelan-McDermid syndrome neurons could be corrected by restoring SHANK3 expression or by treating neurons with insulin-like growth factor-1. IGF1 treatment promoted formation of mature excitatory synapses that lack SHANK3 but contained PSD95 and NMDA receptors with fast deactivation kinetics.

Schizophrenia-15 (SCZD15)

Susceptibility to schizophrenia-15 (SCZD15) has been associated with mutation in the SH3 and multiple ankyrin repeat domains-3 gene (SHANK3). Schizophrenia-15 is a complex, multifactorial psychotic disorder or group of disorders characterized by disturbances in the form and content of thought (e.g. delusions, hallucinations), in mood (e.g. inappropriate affect), in sense of self and relationship to the external world (e.g. loss of ego boundaries, withdrawal), and in behavior (e.g., bizarre or apparently purposeless behavior). Although it affects emotions, it is distinguished from mood disorders in which such disturbances are primary. Similarly, there may be mild impairment of cognitive function, and it is distinguished from the dementias in which disturbed cognitive function is considered primary. Some patients manifest schizophrenic as well as bipolar disorder symptoms and are often given the diagnosis of schizoaffective disorder.

NF2

The NF2 gene encodes the protein merlin, also known as schwannomin. Merlin is a membrane-cytoskeleton scaffolding protein, i.e. linking actin filaments to cell membrane or membrane glycoproteins. Human merlin is predominantly found in nervous tissue, but also in several other fetal tissues, and is mainly located in adherens junctions. NF2 belongs to the tumor suppressor group of genes. The phosphorylation of serine 518 is known to alter the functional state of merlin. The signaling pathway of merlin is proposed to include several salient cell growth controlling molecules, including eIF3c, CD44, protein kinase A, and p21 activated kinases. Mutations of the NF2 gene cause a human autosomal dominant disease called neurofibromatosis type 2. It is characterized by the development of tumors of the nervous system, most commonly of bilateral vestibular schwannomas (also called acoustic neuromas).

Neurofibromatosis, Type 2

Neurofibromatosis type II is caused by mutation in the gene encoding neurofibromin-2, which is also called merlin, on chromosome 22q12.2. Neurofibromatosis type II is an inheritable disorder with an autosomal dominant mode of transmission. Incidence of the disease is about 1 in 60,000. Through statistics, it is suspected that one-half of cases are inherited, and one-half are the result of new, de novo mutations.

More than 200 mutations in the NF2 gene have been identified in people with neurofibromatosis type 2. About 90 percent of NF2 mutations result in an abnormally shortened version of the merlin protein. This short protein cannot perform its normal tumor suppressor function in cells. Research suggests that the loss of merlin allows cells, especially Schwann cells, to multiply too frequently and form noncancerous tumors. The most common tumors in neurofibromatosis type 2 are vestibular schwannomas, which develop along the nerve that carries information from the inner ear to the brain. Other tumors affecting the nervous system also occur in people with this condition. Somatic mutations in the NF2 gene are involved in the development of several types of tumors, both noncancerous (benign) and cancerous (malignant).

It is known that merlin's deficiency can result in unmediated progression through the cell cycle due to the lack of contact-mediated tumor suppression, sufficient to result in the tumors characteristic of Neurofibromatosis type II. Mutations of NF II is presumed to result in either a failure to synthesize merlin or the production of a defective peptide that lacks the normal tumor-suppressive effect.

Meningioma, NF2-Related

Somatic mutations in the gene encoding merlin NF2 on chromosome 22q12 have also been found in tumor tissues of a subset of patients with meningiomas without other features of neurofibromatosis-2. Meningioma, is a relatively common neoplasm of the central nervous system that arises from arachnoidal cells. The majority are well differentiated vascular tumors which grow slowly and have a low potential to be invasive, although malignant subtypes occur. Meningiomas have a predilection to arise from the parasagittal region, cerebral convexity, sphenoidal ridge, olfactory groove, and spinal canal. Meningiomas tend to present in the fourth to sixth decades of life with signs indicative of a slowly progressive mass lesion. Specific clinical manifestations depend on the location of the tumor, but may include intracranial hypertension, cranial neuropathies, ataxia, and other focal neurologic signs. Most meningiomas are benign; only a very small percentage of meningiomas become malignant. Many meningiomas are asymptomatic, producing no symptoms throughout a person's life, and if discovered, require no treatment other than periodic observation. Typically, symptomatic meningiomas are treated with either radiosurgery or conventional surgery. Historical evidence of meningiomas has been found going back hundreds of years, with some successful surgeries for their removal beginning in the 1800s.

Schwannomatosis 1

Individual schwannoma tumors from patients with schwannomatosis have been found to harbor somatic mutations in the neurofibromin-2 gene (NF2). Schwannomas are benign tumors of the peripheral nerve sheath that usually occur singly in otherwise normal individuals. Multiple schwannomas in the same individual suggest an underlying tumor predisposition syndrome. The most common such syndrome is neurofibromatosis II. The hallmark of NF2 is the development of bilateral vestibular nerve schwannomas, but two-thirds or more of all NF2-affected individuals develop schwannomas in other locations, and dermal schwannomas (or neurilemmomas) may precede vestibular tumors in NF2-affected children.

DNMT1

The DNMT1 gene encodes the enzyme DNA (cytosine-5)-methyltransferase 1. This enzyme is involved in DNA methylation. In particular, the enzyme helps add methyl groups to cytosines. DNA methylation is important in many cellular functions. These functions include gene silencing, regulating reactions involving proteins and lipids, and controlling the processing of neurotransmitters. DNA (cytosine-5)-methyltransferase 1 is active in the adult nervous system. Although its specific function is not well understood, the enzyme may help regulate neuron maturation and differentiation, the ability of neurons to migrate where needed and connect with each other, and neuron survival. In vitro functional expression studies in *E. coli* and HeLa cells showed that the mutations affected proper folding of DNMT1 and resulted in premature degradation, reduced methyltransferase activity, and impaired heterochromatin binding during the G2 cell cycle phase, leading to global hypomethylation and site-specific hypermethylation. These changes indicated epigenetic dysregulation.

Hereditary Sensory Neuropathy Type IE (HSN1E)

Hereditary sensory neuropathy type IE (HSN1E) is caused by heterozygous mutation in the DNMT1 gene on chromosome 19p13. Hereditary sensory neuropathy type IE is an autosomal dominant neurodegenerative disorder characterized by adult onset of progressive peripheral sensory loss associated with progressive hearing impairment and early-onset dementia. At least three DNMT1 gene mutations have been identified in people with hereditary sensory and autonomic neuropathy (HSAN IE), a disorder characterized by a gradual dementia, deafness, and sensory problems in the feet. HSAN IE is further characterized by impaired function of sensory neurons, which transmit information about sensations such as pain, temperature, and touch. Sensations in the feet and legs are particularly affected in people with HSAN IE. Gradual loss of sensation in the feet (peripheral neuropathy), which usually begins in adolescence or early adulthood, can lead to difficulty walking. Affected individuals may not be aware of injuries to their feet, which can lead to open sores and infections. If these complications are severe, amputation of the affected areas may be required. HSAN IE is also characterized by a loss of the ability to sweat (sudomotor function), especially on the hands and feet. Sweating is a function of the autonomic nervous system, which also controls involuntary body functions such as heart rate, digestion, and breathing. These other autonomic functions are unaffected in people with HSAN IE. The severity of the signs and symptoms of HSAN IE and their age of onset are variable, even within the same family. The mutations in exon 20, reduce or eliminate the DNA (cytosine-5)-methyltransferase 1 enzyme's methylation function. As a result, maintenance of the neurons that make up the nervous system is impaired. However, it is not known how the mutations cause the specific signs and symptoms of HSAN IE.

Autosomal Dominant Cerebellar Ataxia, Deafness, and Narcolepsy (ADCADN)

Autosomal dominant cerebellar ataxia, deafness, and narcolepsy (ADCADN) is caused by heterozygous mutation in the DNMT1 gene on chromosome 19p13. ADCADN is an autosomal dominant neurologic disorder characterized by adult onset of progressive cerebellar ataxia, narcolepsy/cataplexy, sensorineural deafness, and dementia. More variable features include optic atrophy, sensory neuropathy, psychosis, and depression.

At least three DNMT1 gene mutations have been identified in people with autosomal dominant cerebellar ataxia, deafness, and narcolepsy. The mutations associated with this disorder are in exon 2 the DNMT1 gene. Mutations in different locations within the gene may affect the DNA (cytosine-5)-methyltransferase 1 enzyme differently, which can lead to particular combinations of signs and symptoms.

TCF4

TCF4 encodes transcription factor 4, a basic helix-loop-helix transcription factor. The encoded protein recognizes an Ephrussi-box ('E-box') binding site ('CANNTG')-a motif first identified in immunoglobulin enhancers. This gene is broadly expressed, and may play an important role in nervous system development. The TCF4 protein is found in the brain, muscles, lungs, and heart. This protein also appears to be active in various tissues before birth. The TCF4 protein plays a role cell differentiation and apoptosis.

Pitt-Hopkins Syndrome

Pitt-Hopkins syndrome is characterized by mental retardation, wide mouth and distinctive facial features, and intermittent hyperventilation followed by apnea. Pitt-Hopkins syndrome is linked to haploinsufficiency of the TCF4 transcription factor gene. At least 50 mutations in the TCF4 gene have been found to cause Pitt-Hopkins syndrome. Some mutations delete a nucleotide within the TCF4 gene, while other mutations delete the TCF4 gene as well as a number of genes that surround it. Still other TCF4 gene mutations replace single nucleotides. The size of the mutation does not appear to affect the severity of the condition; individuals with large deletions and those with single nucleotide changes seem to have similar signs and symptoms. TCF4 gene mutations disrupt the protein's ability to bind to DNA and control the activity of certain genes. These gene mutations typically do not affect the TCF4 protein's ability to bind to other proteins. The TCF4 protein's inability to bind to DNA and control the activity of certain genes, particularly those genes involved in nervous system development and function, contributes to the signs and symptoms of Pitt-Hopkins syndrome. It is also likely that the loss of the normal proteins that are attached to the nonfunctional TCF4 proteins contribute to the features of this condition.

RAI1

The RAI1 gene encodes Retinoic acid-induced protein 1. Retinoic acid-induced protein 1 is an important transcriptional regulator of the circadian clock components: CLOCK, ARNTL/BMAL1, ARNTL2/BMAL2, PER1/3, CRY1/2, NR1D1/2 and RORA/C. Retinoic acid-induced protein 1 positively regulates the transcriptional activity of CLOCK a core component of the circadian clock. Retinoic acid-induced protein 1 regulates transcription through chromatin remodeling by interacting with other proteins in chromatin as well as proteins in the basic transcriptional machinery. Retinoic acid-induced protein 1 may be important for embryonic and postnatal development. Retinoic acid-induced protein 1 may be involved in neuronal differentiation. Mutations in one copy of this gene lead to the production of a nonfunctional version of the RAI1 protein or reduce the amount of this protein that is produced.

Smith-Magenis Syndrome

Smith-Magenis syndrome (SMS) is caused in most cases (90%) by a 3.7-Mb interstitial deletion in chromosome 17p11.2. The disorder can also be caused by mutations in the RAI1 gene, which is within the Smith-Magenis chromosome region. Smith-Magenis syndrome is a developmental disorder that affects many parts of the body. The major features of this condition include mild to moderate intellectual disability, delayed speech and language skills, distinctive facial features, sleep disturbances, and behavioral problems. Most people with Smith-Magenis syndrome have a broad, square-shaped face with deep-set eyes, full cheeks, and a prominent lower jaw. The middle of the face and the bridge of the nose often appear flattened. The mouth tends to turn downward with a full, outward-curving upper lip. These facial differences can be subtle in early childhood, but they usually become more distinctive in later childhood and adulthood. Dental abnormalities are also common in affected individuals. Disrupted sleep patterns are characteristic of Smith-Magenis syndrome, typically beginning early in life. Affected individuals may be very sleepy during the day, but they have trouble falling asleep and awaken several times each night. Individuals with Smith-Magenis syndrome have affectionate, engaging personalities, but most also have behavioral problems. These include frequent temper tantrums and outbursts, aggression, anxiety, impulsiveness, and difficulty paying attention. Self-injury, including biting, hitting, head banging, and skin picking, is very common. Repetitive self-hugging is a behavioral trait that may be unique to Smith-Magenis syndrome. Individuals with this condition also compulsively lick their fingers and flip pages of books and magazines (a behavior known as "lick and flip"). Other signs and symptoms of Smith-Magenis syndrome include short stature, abnormal curvature of the spine (scoliosis), reduced sensitivity to pain and temperature, and a hoarse voice. Some people with this disorder have ear abnormalities that lead to hearing loss. Affected individuals may have eye abnormalities that cause nearsightedness (myopia) and other vision problems. Although less common, heart and kidney defects also have been reported in people with Smith-Magenis syndrome. A small percentage of individuals with Smith-Magenis syndrome have a mutation in the RAI1, gene instead of a chromosomal deletion. Although these individuals have many of the major features of the condition, they are less likely than people with a chromosomal deletion to have short stature, hearing loss, and heart or kidney abnormalities.

PEX1

The PEX1 gene encodes peroxisomal biogenesis factor 1 (Pex1p), which is part of a group of proteins called peroxins. Peroxins are essential for the formation and normal functioning of cell structures called peroxisomes. Peroxisomes are sac-like compartments that contain enzymes needed to break down many different substances, including fatty acids and certain toxic compounds. They are also important for the production of lipids used in digestion and in the nervous system. Peroxins assist in the biogenesis of peroxisomes by producing the membrane that separates the peroxisome from the rest of the cell and by importing enzymes into the peroxisome. Pex1p enables other peroxins to bring enzymes into the peroxisome.

Peroxisome Biogenesis Disorder 1a (Zellweger Syndrome) (PBD1A)

Zellweger syndrome (PBD1A) is caused by homozygous or compound heterozygous mutation in the PEX1 gene on chromosome 7q21-q22. Zellweger syndrome is an autosomal recessive systemic disorder characterized clinically by severe neurologic dysfunction, craniofacial abnormalities, and liver dysfunction, and biochemically by the absence of peroxisomes. Most severely affected individuals with classic Zellweger syndrome phenotype die within the first year of life.

At least 114 mutations in the PEX1 gene have been identified in people with Zellweger spectrum disorder. The conditions' features, which vary in severity, can include weak muscle tone (hypotonia), developmental delay, and vision and hearing problems. Mutations in the PEX1 gene are the most common cause of Zellweger spectrum disorder and are found in nearly 70 percent of affected individuals. There are two common PEX1 gene mutations found in people with Zellweger spectrum disorder. One mutation replaces the amino acid glycine with the amino acid aspartic acid at position 843 in Pex1p (written as Gly843Asp or G843D). This mutation leads to reduced levels of the protein. Individuals who have the G843D mutation tend to have signs and symptoms that are at the less-severe end of the condition spectrum. The other common mutation, which is known as the 1700fs mutation, leads to the production of an abnormally short, nonfunctional Pex1p. Individuals who have the 1700fs mutation often have signs and symptoms that are at the severe end of the condition spectrum. Mutations in the PEX1 gene that cause Zellweger spectrum disorder reduce or eliminate the activity of the Pex1p protein. Without enough functional Pex1p, enzymes are not properly imported into peroxisomes. As a result, cells contain empty peroxisomes that cannot carry out their usual functions. The severe end of the condition spectrum is caused by the absence of functional peroxisomes within cells. The less severe end of the condition spectrum results from mutations that allow some peroxisomes to form.

Heimler Syndrome-1 (HMLR1)

Heimler syndrome-1 (HMLR1) is caused by homozygous or compound heterozygous mutations in the PEX1 gene on chromosome 7q21. Heimler syndrome-1 (HMLR1), represents the mildest end of the peroxisomal biogenesis disorder spectrum. Heimler syndrome-1 is a rare autosomal recessive disorder characterized by sensorineural hearing loss, enamel hypoplasia of the secondary dentition, and nail abnormalities.

ARSA

The ARSA encodes enzyme arylsulfatase A. This enzyme is localized in lysosomes. Arylsulfatase A aids the processing of sulfatides. For example, Arylsulfatase A hydrolyzes cerebroside sulfate to cerebroside and sulfate. Sulfatides are a subgroup of sphingolipids, a category of fats that are important components of cell membranes. Sulfatides are abundant in the nervous system's white matter, consisting of nerve fibers covered by myelin.

Metachromatic Leukodystrophy

Metachromatic leukodystrophy is caused by mutation in the arylsulfatase A gene (ARSA) on chromosome 22q13. Metachromatic leukodystrophy is an inherited disorder characterized by the accumulation of sulfatides in cells. This accumulation especially affects cells in the nervous system that produce myelin. Sulfatide accumulation in myelin-producing cells causes progressive destruction of white matter (leukodystrophy) throughout the nervous system, including in the central nervous system and the nerves connecting the brain and spinal cord to muscles and sensory cells that detect sensations such as touch, pain, heat, and sound (the peripheral nervous system). In individuals with metachromatic leukodystrophy, white matter damage causes progressive deterioration of intellectual functions and motor skills, such as the ability to walk. Affected individuals also develop loss of sensation in the extremities (peripheral neuropathy), incontinence, seizures, paralysis, an inability to speak, blindness, and hearing loss. Eventually they lose awareness of their surroundings and become unresponsive. While neurological problems are the primary feature of metachromatic leukodystrophy, effects of sulfatide accumulation on other organs and tissues have been reported, most often involving the gallbladder.

The most common form of metachromatic leukodystrophy, affecting about 50 to 60 percent of all individuals with this disorder, is called the late infantile form. This form of the disorder usually appears in the second year of life. Affected children lose any speech they have developed, become weak, and develop problems with walking (gait disturbance). As the disorder worsens, muscle tone generally first decreases, and then increases to the point of rigidity. Individuals with the late infantile form of metachromatic leukodystrophy typically do not survive past childhood. In 20 to 30 percent of individuals with metachromatic leukodystrophy, onset occurs between the age of 4 and adolescence. In this juvenile form, the first signs of the disorder may be behavioral problems and increasing difficulty with schoolwork. Progression of the disorder is slower than in the late infantile form, and affected individuals may survive for about 20 years after diagnosis.

The adult form of metachromatic leukodystrophy affects approximately 15 to 20 percent of individuals with the disorder. In this form, the first symptoms appear during the teenage years or later. Often behavioral problems such as alcoholism, drug abuse, or difficulties at school or work are the first symptoms to appear. The affected individual may experience psychiatric symptoms such as delusions or hallucinations. People with the adult form of metachromatic leukodystrophy may survive for 20 to 30 years after diagnosis. During this time there may be some periods of relative stability and other periods of more rapid decline.

EIF2b5/EIF2B1/EIF2B2

The EIF2B5, EIF2B1 and EIF2B2 genes encodes a sub-unit of eukaryotic translation initiation factor 2B (eIF2B), a heteropentameric guanine nucleotide exchange factor necessary for the proper function of the translation initiation factor eIF2, and an essential regulator for protein synthesis. eIF2B catalyzes the exchange of GDP for GTP. Under some conditions, eIF2B increases protein synthesis under other conditions, eLF2B slows protein synthesis. Proper regulation of protein synthesis is vital for ensuring that the correct levels of protein are available for the cell to cope with changing conditions. Mutations in eIF2B can cause partial loss of eIF2B function. Impairment of eIF2B function makes it more difficult for cells to regulate protein synthesis and deal with changing conditions and stress.

Leukoencephalopathy with Vanishing White Matter (VWM)

Leukoencephalopathy with vanishing white matter (VWM) can be caused by homozygous or compound heterozygous mutation in any of the 5 genes encoding subunits of the translation initiation factor EIF2B: EIF2B1 on chromosome 12q24, EIF2B2 on chromosome 14q24, EIF2B3 on chromosome 1p34, EIF2B4 on chromosome 2p23, or EIF2B5 on chromosome 3q27. Vanishing white matter leukodystrophy is an autosomal recessive neurologic disorder characterized by variable neurologic features, including progressive cerebellar ataxia, spasticity, and cognitive impairment associated with white matter lesions on brain imaging. The age at onset can range from early infancy to adulthood. Rapid neurologic deterioration can occur following minor head trauma. Female mutation carriers may develop ovarian failure, manifest as primary amenorrhea or as secondary amenorrhea lasting more than 6 months, associated with elevated gonadotropin levels at age less than 40 years.

Neurologic deterioration usually begins in late infancy or early childhood, but juvenile- and adult-onset cases have been described. Mild and severe cases have been observed, even within families. The neurologic signs include progressive cerebellar ataxia, spasticity, inconstant optic atrophy, and relatively preserved mental abilities. Disease is chronic-progressive with, in most individuals, additional episodes of rapid deterioration following febrile infections or minor head trauma. Head trauma leads only to motor deterioration, whereas infections with fever may end in coma. Death occurs after a variable period of several years to a few decades, usually following an episode of fever and coma. MRI is diagnostic and shows a diffuse abnormality of the cerebral white matter beginning in the presymptomatic stage. Both MRI and magnetic resonance spectroscopy indicate that, with time, an increasing amount of the abnormal white matter vanishes and is replaced by cerebrospinal fluid. The mode of inheritance is autosomal recessive.

NPC1

NPC1 encodes Niemann-Pick disease, type C1 (NPC1), a large protein that resides in the limiting membrane of endosomes and lysosomes and mediates intracellular cholesterol trafficking via binding of cholesterol to its N-terminal domain. It is predicted to have a cytoplasmic C-terminus, 13 transmembrane domains, and 3 large loops in the lumen of the endosome—the last loop being at the N-terminus. This protein transports low-density lipoproteins to late endosomal/lysosomal compartments where they are hydrolized and released as free cholesterol.

Mutations in NPC1 leads to a shortage of NPC1, which prevents movement of cholesterol and other lipids, leading to their accumulation in cells. Because these lipids are not in their proper location in cells, many normal cell functions that require lipids (such as cell membrane formation) are impaired. The accumulation of lipids as well as the cell dysfunction eventually leads to cell death, causing the tissue and organ damage seen in Niemann-Pick disease types C1.

Niemann-Pick Disease Type C1 and Niemann-Pick Disease Type D

Niemann-Pick disease type C1 and Niemann-Pick disease type D, also known as the Nova Scotian type, are caused by mutation in the NPC1 gene. Niemann-Pick type C (NPC) disease is an autosomal recessive lipid storage disorder characterized by progressive neurodegeneration. Approximately 95% of cases are caused by mutations in the NPC1 gene, referred to as type C1; 5% are caused by mutations in the NPC2 gene, referred to as type C2. The clinical manifestations of types C1 and C2 are similar because the respective genes are both involved in egress of lipids, particularly cholesterol, from late endosomes or lysosomes. Niemann-Pick disease types C1 and C2 usually become apparent in childhood, although signs and symptoms can develop at any time. People with these types usually develop difficulty coordinating movements (ataxia), an inability to move the eyes vertically (vertical supranuclear gaze palsy), poor muscle tone (dystonia), severe liver disease, and interstitial lung disease. Individuals with Niemann-Pick disease types C1 and C2 have problems with speech and swallowing that worsen over time, eventually interfering with feeding. Affected individuals often experience progressive decline in intellectual function and about one-third have seizures.

ADAR

ADAR (adenosine deaminase acting on RNA) encodes Double-stranded RNA-specific adenosine deaminase. ADAR catalyzes the deamination of adenosine to inosine in dsRNA substrates, induces translation within the nucleus, possibly at the surface of the nucleolus. ADAR catalyzes the hydrolytic deamination of adenosine to inosine in double-stranded RNA (dsRNA) referred to as A-to-I RNA editing. This may affect gene expression and function in a number of ways that include mRNA translation by changing codons and hence the amino acid sequence of proteins; pre-mRNA splicing by altering splice site recognition sequences; RNA stability by changing sequences involved in nuclease recognition; genetic stability in the case of RNA virus genomes by changing sequences during viral RNA replication; and RNA structure-dependent activities such as microRNA production or targeting or protein-RNA interactions. ADAR can edit both viral and cellular RNAs and can edit RNAs at multiple sites (hyper-editing) or at specific sites (site-specific editing). ADAR cellular RNA substrates include: bladder cancer-associated protein (BLCAP), neurotransmitter receptors for glutamate (GRIA2) and serotonin (HTR2C) and GABA receptor (GABRA3). Site-specific RNA editing of transcripts encoding these proteins results in amino acid substitutions which consequently alters their functional activities. Exhibits low-level editing at the GRIA2 Q/R site, but edits efficiently at the R/G site and HOTSPOT1. Its viral RNA substrates include: hepatitis C virus (HCV), vesicular stomatitis virus (VSV), measles virus (MV), hepatitis delta virus (HDV), and human immunodeficiency virus type 1 (HIV-1). ADAR exhibits either a proviral (HDV, MV, VSV and HIV-1) or an antiviral effect (HCV) and this can be editing-dependent (HDV and HCV), editing-independent (VSV and MV) or both (HIV-1). ADAR impairs HCV replication via RNA editing at multiple sites. ADAR enhances the replication of MV, VSV and HIV-1 through an editing-independent mechanism via suppression of EIF2AK2/PKR activation and function. ADAR stimulates both the release and infectivity of HIV-1 viral particles by an editing-dependent mechanism where it associates with viral RNAs and edits adenosines in the 5'UTR and the Rev and Tat coding sequence. ADAR can enhance viral replication of HDV via A-to-I editing at a site designated as amber/W, thereby changing an UAG amber stop codon to an UIG tryptophan (W) codon that permits synthesis of the large delta antigen (L-HDAg) which has a key role in the assembly of viral particles. However, high levels of ADAR1 inhibit HDV replication.

Aicardi-Goutieres Syndrome-6 (AGS6)

Aicardi-Goutieres syndrome-6 (AGS6) can be caused by homozygous, compound heterozygous, or heterozygous mutation in the ADAR gene on chromosome 1q21.3. Aicardi-Goutiéres syndrome (AGS) manifests as an early-onset encephalopathy that usually, but not always, results in severe intellectual and physical handicap. A subgroup of infants with AGS present at birth with abnormal neurologic findings, hepatosplenomegaly, elevated liver enzymes, and thrombocytopenia, a picture highly suggestive of congenital infection. Otherwise, most affected infants present at variable times after the first few weeks of life, frequently after a period of apparently normal development. Typically, they demonstrate the subacute onset of a severe encephalopathy characterized by extreme irritability, intermittent sterile pyrexias, loss of skills, and slowing of head growth. Over time, as many as 40% develop chilblain skin lesions on the fingers, toes, and ears. It is becoming apparent that atypical, sometimes milder, cases of AGS exist, and thus the true extent of the phenotype associated with mutation of the AGS-related genes is not yet known. For example, mutation of ADAR has recently been associated with a clinical presentation of acute bilateral striatal necrosis.
MFSD8

MFSD8 gene, encodes a putative lysosomal transporter, on chromosome 4q28. The MFSD8 protein is found in lysosomes. The MFSD8 protein belongs to a large group of related proteins called the major facilitator superfamily of secondary active transporter proteins. Proteins in this family move certain molecules between structures in cells or in and out of cells. While it is likely that the MFSD8 protein transports molecules, the specific molecules it moves are unknown. The MFSD8 protein probably transports substances across the membranes of lysosomes.
Neuronal Ceroid Lipofuscinosis-7

Neuronal ceroid lipofuscinosis-7 (CLN7) is caused by homozygous or compound heterozygous mutation in the MFSD8 gene, which encodes a putative lysosomal transporter, on chromosome 4q28. The neuronal ceroid-lipofuscinoses (NCLs) are a group of inherited, neurodegenerative, lysosomal storage disorders characterized by progressive intellectual and motor deterioration, seizures, and early death. Visual loss is a feature of most forms. Clinical phenotypes have been characterized traditionally according to the age of onset and order of appearance of clinical features into infantile, late-infantile, juvenile, adult, and Northern epilepsy (also known as progressive epilepsy with mental retardation).
STXBP1

STXBP1 gene, encodes a syntaxin-binding protein. The encoded protein can play a role in release of neurotransmitters via regulation of syntaxin, a transmembrane attachment protein receptor. Mutations in STXBP1 gene is associated with infantile epileptic encephalopathy-4. STXBP1 can participate in the regulation of synaptic vesicle docking and fusion, through interaction with GTP-binding proteins. STXBP1 can interact with syntaxins 1, 2, and 3 but not syntaxin 4. STXBP1 can play a role in determining the specificity of intracellular fusion reactions.

In humans, STXBP1 is expressed as a 4-kb transcript in various tissues. The highest levels of expression can be observed in the retina and cerebellum.
Early Infantile Epileptic Encephalopathy-4

Epileptic encephalopathy, early infantile, 4 (EIEE4) is a severe form of epilepsy characterized by frequent tonic seizures or spasms beginning in infancy with a specific EEG finding of suppression-burst patterns, characterized by high-voltage bursts alternating with almost flat suppression phases. Affected individuals can have neonatal or infantile onset of seizures, profound mental retardation, and MRI evidence of brain hypomyelination.

In some cases, in a patient with early infantile epileptic encephalopathy-4, a heterozygous 1631G-A transition in the STXBP1 gene, resulting in a gly544-to-asp (G544D) substitution can be identified. In some cases, a patient with early infantile epileptic encephalopathy-4 can develop seizures by age 10 days with a suppression-burst pattern on EEG. In some cases, a patient with early infantile epileptic encephalopathy-4 can have profound mental retardation and spastic paraplegia at about age 37 years.

In some cases, in a patient with early infantile epileptic encephalopathy-4, a heterozygous 539G-A transition in the STXBP1 gene, resulting in a cys180-to-tyr (C180Y) substitution can be identified. In some cases, a patient with early infantile epileptic encephalopathy-4 can have infantile onset of tonic and myoclonic seizures with suppression-burst pattern and hypsarrhythmia, delayed brain myelination, and spastic quadriplegia. In embodiments, mutations in the STXBP1 gene can impair structural stability, lower thermostability, and decrease binding to several functional synaptic proteins.

In some cases, in a patient with early infantile epileptic encephalopathy-4, a heterozygous 1328T-G transversion in the STXBP1 gene, resulting in a met443-to-arg (M443R) substitution can be identified. In some cases, a patient with early infantile epileptic encephalopathy-4 can develop tonic seizures at age 6 weeks and can later have profoundly delayed development. In some cases, a patient with early infantile epileptic encephalopathy-4 can have delayed brain myelination.

In some cases, in a patient with early infantile epileptic encephalopathy-4, a heterozygous 251T-A transversion in the STXBP1 gene, resulting in a val84-to-asp (V84D) substitution can be identified. In some cases, a patient with early infantile epileptic encephalopathy-4 can develop tonic seizures at age 2 months with suppression-burst pattern and hypsarrhythmia, and can later show profound mental retardation.

In some cases, in a patient with Early infantile epileptic encephalopathy-4, a de novo heterozygous 1162C-T transition in exon 14 of the STXBP1 gene, resulting in an arg388-to-ter (R388X) substitution, predicted to truncate the domain-3 region, which together with domain-1 provides a binding surface for syntaxin-1 can be identified. In some cases, a patient with early infantile epileptic encephalopathy-4 can have severe mental retardation, with hypotonia, abnormal gait, tremor, and/or seizures.

In some cases, in a patient with early infantile epileptic encephalopathy-4, a de novo heterozygous G-to-A transition in intron 3 of the STXBP1 gene, resulting in the creation of a stop codon downstream of exon 3 can be identified. In some cases, a patient with early infantile epileptic encephalopathy-4 can have severe mental retardation, with hypotonia, abnormal gait, tremor, and/or seizures.

In some cases, in a patient with Early infantile epileptic encephalopathy-4, a de novo heterozygous 847G-A transition in the STXBP1 gene, resulting in a glu283-to-lys (E283K) substitution at a highly conserved residue can be identified.
PRICKLE2

The PRICKLE2 gene encodes a postsynaptic protein involved in neuronal architecture and function, prickle planar cell polarity protein 2. Mutations in this gene are associated with progressive myoclonic epilepsy type 5.
Progressive Myoclonic Epilepsy 5

Epilepsy, progressive myoclonic 5 (EPM5) is a neurodegenerative disorder characterized by myoclonic seizures and variable neurologic symptoms including cognitive decline and persistent movement abnormalities.

In some cases, a heterozygosity for a complex mutation in the PRICKLE2 gene, a 443G-A transition, resulting in an arg148-to-his (R148H) substitution, and a 457G-A transition, resulting in a val153-to-ile (V153I) substitution can be identified in a progressive myoclonic epilepsy patient. In some cases, a heterozygous 1813G-T transversion in the PRICKLE2 gene, resulting in a val605-to-phe (V605F) substitution can be identified in a progressive myoclonic epilepsy patient.
PRRT2

The PRRT2 gene provides instructions for making the proline-rich transmembrane protein 2 (PRRT2). The function of this protein is thought to be involved in signaling in the brain. Studies show that PRRT2 protein interacts with SNAP25, which is involved in signaling between nerve cells in the brain. SNAP25 helps control the release of neurotransmitters.

Familial Infantile Convulsion with Paroxysmal Choreoathetosis

Infantile Convulsions and paroxysmal ChoreoAthetosis (ICCA) syndrome is a neurological condition characterized by the occurrence of seizures during the first year of life (Benign familial infantile epilepsy) and choreoathetotic dyskinetic attacks during childhood or adolescence. Benign familial infantile epilepsy can begin at 3 to 12 months of age with a family history of the same type of seizures. Seizures are afebrile, partial or sometimes generalized, and normally disappear after the first year of life. During childhood or adolescence, affected individuals present with paroxysmal kinesigenic dyskinesia with frequent and recurrent episodic choreoathetotic or dystonic movements that last less than 1 minute. The attacks can be triggered by the initiation of voluntary movements or startle. The association with other paroxysmal disorders such as migraine, with or without aura, hemiplegic migraine, episodic ataxia and tics has also been described. The genetic loci of ICCA syndrome have been described on chromosomes 16p11.2-q12.1, 16q13-q22.1 and 3q29-29. Mutations in the Proline-rich transmembrane protein 2 (PRRT2) gene, located on 16p11.2, have recently been found in families affected by ICCA syndrome. This gene encodes a membrane protein that interacts with the presynaptic protein SNAP-25 but the mechanism leading to the disease remains unknown. The diagnosis is mainly clinical, based on the appearance of infantile convulsions with benign evolution followed by kinesigenic dyskinesia attacks later on. Genetic testing can confirm the diagnosis. Differential diagnosis can include other paroxysmal dystonias such as paroxysmal exertion-induced dyskinesia and paroxysmal non-kinesigenic dyskinesia triggered by drugs or food intake (such as caffeine and alcohol). ICCA syndrome can present as sporadic or familial; in the latter case, it is transmitted as an autosomal dominant trait that can be variably expressed within the same family. Antiepileptic drugs, mainly phenytoin or carbamazepine, can be effective in controlling seizures and dyskinesia during the active phase of the disorder.

In some cases, in patients familial infantile convulsions with paroxysmal choreoathetosis, a heterozygous 950G-A transition in the PRRT2 gene, resulting in a ser317-to-asn (S317N) substitution in a highly conserved residue can be identified.

In some cases, in patients with familial infantile convulsions with paroxysmal choreoathetosis, a heterozygous C-to-T transition in the PRRT2 gene, resulting in an arg240-to-ter (R240X) substitution can be identified. In some cases, in patients with familial infantile convulsions with paroxysmal choreoathetosis, a heterozygous 1-bp insertion (516insT) in the PRRT2 gene, resulting in premature termination at residue 173 can be identified. In some cases, in patients with familial infantile convulsions with paroxysmal choreoathetosis, a heterozygous 562C-T transition in the PRRT2 gene, resulting in a gln188-to-ter (Q188X) substitution can be identified.

Episodic Kinesigenic Dyskinesia 1

Episodic kinesigenic dyskinesia 1 can be referred to as familial paroxysmal kinesigenic dyskinesia. Familial paroxysmal kinesigenic dyskinesia is a disorder characterized by episodes of abnormal movement that range from mild to severe. In the condition name, paroxysmal indicates that the abnormal movements come and go over time, kinesigenic indicates that episodes are triggered by movement, and dyskinesia refers to involuntary movement of the body.

People with familial paroxysmal kinesigenic dyskinesia experience episodes of irregular jerking or shaking movements that are induced by sudden motion, such as standing up quickly or being startled. An episode may involve slow, prolonged muscle contractions (dystonia); small, fast, "dance-like" motions (chorea); writhing movements of the limbs (athetosis); or, rarely, flailing movements of the limbs (ballismus). Familial paroxysmal kinesigenic dyskinesia may affect one or both sides of the body. The type of abnormal movement varies among affected individuals, even among members of the same family. In many people with familial paroxysmal kinesigenic dyskinesia, a pattern of symptoms called an aura immediately precedes the episode. The aura is often described as a crawling or tingling sensation in the affected body part. Individuals with this condition do not lose consciousness during an episode and do not experience any symptoms between episodes.

Individuals with familial paroxysmal kinesigenic dyskinesia usually begin to show signs and symptoms of the disorder during childhood or adolescence. Episodes typically last less than five minutes, and the frequency of episodes ranges from one per month to 100 per day. In most affected individuals, episodes occur less often with age.

In some people with familial paroxysmal kinesigenic dyskinesia the disorder begins in infancy with recurring seizures called benign infantile convulsions. These seizures usually develop in the first year of life and stop by age 3. When benign infantile convulsions are associated with familial paroxysmal kinesigenic dyskinesia, the condition is known as infantile convulsions and choreoathetosis (ICCA). In families with ICCA, some individuals develop only benign infantile convulsions, some have only familial paroxysmal kinesigenic dyskinesia, and others develop both.

In some cases, in a patient with episodic kinesigenic dyskinesia 1, a heterozygous 1-bp duplication (649dupC) in exon 2 of the PRRT2 gene in the proline-rich domain, resulting in a frameshift and introduction of a stop codon 7 amino acids downstream of the insertion (Arg217ProfsTer8) can be identified. In some cases, in a patient with episodic kinesigenic dyskinesia 1, a heterozygous 4-bp deletion (514delTCTG) in exon 2 of the PRRT2 gene in the proline-rich domain, resulting in a frameshift and premature termination can be identified. In some cases, in a patient with episodic kinesigenic dyskinesia 1, a heterozygous 1-bp deletion (972delA) in exon 3 of the PRRT2 gene, resulting in a frameshift and premature termination in the second transmembrane motif can be identified. In some cases, in a patient with episodic kinesigenic dyskinesia 1, identified a heterozygous 487C-T transition in exon 2 of the PRRT2 gene can be identified. In some cases, in a patient with episodic kinesigenic dyskinesia 1, a heterozygous 796C-T transition in exon 2 of the PRRT2 gene, resulting in an arg266-to-trp (R266W) substitution in a highly conserved residue can be identified. In some cases, in a patient with Episodic kinesigenic dyskinesia 1, a heterozygous 1-bp deletion (649delC) in the PRRT2 gene, resulting in a frameshift and premature termination (Arg217GlufsTer12) can be identified. In some cases, in a patient with Episodic kinesigenic dyskinesia 1, a heterozygous 748C-T transition in the PRRT2 gene, resulting in a gln250-to-ter (Q250X) substitution in the N-terminal extracellular domain can be identified.

Benign Familial Infantile Seizuers-2

Benign familial infantile epilepsy (BFIE) is a genetic epileptic syndrome characterized by the occurrence of afebrile repeated seizures in healthy infants, between the third and eighth month of life. Although BFIE cases have been reported worldwide, prevalence and incidence remain unknown. In an Argentinian case series, BFIE have been listed as the third most common type of epilepsy in the first two years of life. Seizures usually occur between 3 to 8 months of life, with clusters (8-10 a day) of repeated and brief episodes (2-5 minutes) over a few days. They are usually focal but can sometimes become generalized. Patients present with motor arrest, unresponsiveness, head and/or eye deviation to one side, staring, fluttering of eyelids, grunting, cyanosis, diffuse hypertonia and unilateral or bilateral clonic jerks of the limbs. During the interictal period, patients regain full consciousness and activity. Psychomotor development is normal. A family history of the same epilepsy is a constant finding. A syndrome called familial infantile convulsions and choreoathetosis has been observed in which BFIE patients present in childhood and/or adolescence with choreoathetotic dyskinetic attacks occurring spontaneously or following diverse stimuli (e.g. exercise, stress). In some rare cases, BFIE has been associated with familial or sporadic hemiplegic migraine.

BFIE is a genetically heterogeneous disease. In the majority of cases, mutations in the proline-rich transmembrane protein 2 (PRRT2) gene located at 16p11.2 have been found. This gene encodes a membrane protein that interacts with the presynaptic protein SNAP-25. Mutations have also been found in the SCN2A gene (2q24.3) encoding the brain sodium channel NaV1.2 and rarely in the KCNQ2 (20q13.33) and KCNQ3 (8q24) genes both encoding potassium channels. Additionally, three other chromosomal loci have been identified that are mapped to chromosome 19q, 16p and 1p.

Family history can orient the diagnosis which can be based on electroencephalography (EEG) and video recordings. EEG can show that partial seizures originate from the parietal-occipital region and that the side of the hemisphere involved can vary between episodes. Seizures can sometimes spread and involve the entire brain. During a cluster of seizures, postictal EEG shows lateralized occipito-parietal delta waves and spikes. Outside the cluster, waking and sleeping interictal EEG is normal. Interictal neurological examination and brain imaging (brain CT and/or MRI) are normal. Genetic testing can confirm the diagnosis.

Differential diagnosis can include benign familial neonatal-infantile seizures, an epileptic syndrome with an intermediate onset between the neonatal and infantile age that shares overlapping clinical characteristics with BFIE and that is mainly due to mutations in the SCN2A gene. Other differential diagnoses are benign non-familial infantile seizures, benign infantile seizures associated with mild gastroenteritis and benign infantile focal epilepsy with midline spikes and waves during sleep (BIMSE)

BFIE is transmitted as an autosomal dominant trait with incomplete penetrance. With anti-epileptic treatment (e.g. carbamazepine, valproate, phenobarbital), symptoms quickly disappear and no other type of epilepsy has been reported to reappear.

In some cases, in patients with benign familial infantile seizuers-2, a heterozygous 1-bp deletion (629delC) in the PRRT2 gene, resulting in a frameshift and premature termination (Pro210GlnfsTer19) can be identified. In some cases, in patients with benign familial infantile seizures-2, a heterozygous 1-bp deletion (291delC) in the PRRT2 gene, resulting in a frameshift and premature termination (Asn98ThrfsTer17) can be identified. In some cases, in patients with Benign familial infantile seizuers-2, a heterozygous 1-bp deletion (c.650delG) in the PRRT2 gene, resulting in a frameshift and premature termination (Arg217GlnfsTer12) can be identified.

STX1B

The protein encoded by this gene belongs to a family of proteins thought to play a role in the exocytosis of synaptic vesicles. Vesicle exocytosis releases vesicular contents and is important to various cellular functions. For instance, the secretion of transmitters from neurons plays an important role in synaptic transmission. After exocytosis, the membrane and proteins from the vesicle are retrieved from the plasma membrane through the process of endocytosis. Mutations in this gene have been identified as one cause of fever-associated epilepsy syndromes. A possible link between this gene and Parkinson's disease has also been suggested.

Syntaxins are cellular receptors for transport vesicles. One of these proteins, designated syntaxin 1B (STX1B), is directly implicated in the process of calcium-dependent synaptic transmission in rat brain. The expression of this protein is transiently induced by long-term potentiation of synaptic responses in the rat hippocampus. The protein may play an important role in the excitatory pathway of synaptic transmission, which is known to be implicated in several neurologic diseases.

Generalized Epilepsy with Febrile Seizure Plus Type 9

Generalized epilepsy with febrile seizures plus-9 is an autosomal dominant neurologic disorder characterized by onset of febrile and/or afebrile seizures in early childhood, usually before age 3 years. Seizure types are variable and include generalized tonic-clonic, atonic, myoclonic, complex partial, and absence. Most patients have remission of seizures later in childhood with no residual neurologic deficits, but rare patients may show mild developmental delay or mild intellectual disabilities.

In some cases, in a patient with generalized epilepsy with febrile seizure plus type 9, a heterozygous c.166C-T transition in the STX1B gene, resulting in a gln56-to-ter (Q56X) substitution can be identified.

In some cases, in a patient with generalized epilepsy with febrile seizure plus type 9, a heterozygous complex insertion/deletion mutation in the STX1B gene c.133_134insGGATGTGCATTG, resulting in Lys45delinsArgMetCysIleGlu, and c.135_136AC-GA, resulting in a leu46-to-met (L46M) substitution) can be identified. In some cases, in a patient with generalized epilepsy with febrile seizure plus type 9, a heterozygous c.140C-A transversion in the STX1B gene, resulting in a ser47-to-ter (S47X) substitution can be identified In some cases, in a patient with generalized epilepsy with febrile seizure plus type 9,) identified a heterozygous c.657T-A transversion in the STX1B gene, resulting in a val216-to-glu (V216E) substitution at a highly conserved residue in the SNARE motif can be identified. In some cases, in a patient with generalized epilepsy with febrile seizure plus type 9, a de novo heterozygous c.676G-C transversion in the STX1B gene, resulting in a gly226-to-arg (G226R) substitution at a highly conserved residue in the SNARE motif can be identified.

IDUA

The IDUA gene provides instructions for producing the enzyme alpha-L-iduronidase, which is essential for the breakdown of large sugar molecules, for example glycosaminoglycans (GAGs). Through hydrolysis, alpha-L-iduronidase uses water molecules to break down unsulfated alpha-L-iduronic acid, which is present in heparan sulfate and dermatan sulfate. Alpha-L-iduronidase can be located in lysosomes. More than 100 mutations in the IDUA gene have been found to cause mucopolysaccharidosis type I (MPS I). Many mutations that cause MPS I reduce or completely eliminate the function of alpha-L-iduronidase. It usually cannot be determined whether a certain mutation will cause severe or attenuated MPS I; however, people who do not produce alpha-L-iduronidase have the severe form of this disorder.

The lack of alpha-L-iduronidase enzyme activity leads to the accumulation of heparan sulfate and dermatan sulfate within the lysosomes. The buildup of GAGs increases the size of the lysosomes. The accumulated GAGs may also interfere with the functions of other proteins inside the lysosomes and disrupt the movement of molecules inside the cell.

Hurler-Scheie Syndrome

Hurler-Scheie syndrome is the intermediate form of mucopolysaccharidosis type 1 (MPS1) between the two extremes Hurler syndrome and Scheie syndrome, it is a rare lysosomal storage disease, characterized by skeletal deformities and a delay in motor development. The prevalence of MPS I has been estimated at 1/100,000, with Hurler-Scheie syndrome accounting for 23% of cases or a prevalence of approximately 1/435,000. Patients with Hurler-Scheie syndrome have normal or almost normal intelligence but exhibit various degrees of physical impairment. Patients present in the first years of life with musculoskeletal alterations to different degrees including short stature, multiple dysostosis, thoracic-lumbar kyphosis, progressive coarsening of the facial features to different degrees, cardiomyopathy and valvular abnormalities, neurosensorial hearing loss, enlarged tonsils and adenoids, and nasal secretion. Hydrocephaly can occur after the age of two. Corneal opacity is seen between two and four years of age and requires keratoplasty to restore sight. Other manifestations may include organomegaly, hernias and hirsutism.

Hurler-Scheie syndrome is caused by mutations in the IDUA gene (4p16.3) leading to partial deficiency in the alpha-L-iduronidase enzyme and lysosomal accumulation of dermatan sulfate and heparan sulfate. Early diagnosis is difficult because the first clinical signs are not specific. Diagnosis can be based on detection of increased urinary secretion of heparan and dermatan sulfate through 1,9-dimethylmethylene blue (DMB) test and glycosaminoglycan (GAG) electrophoresis, and demonstration of enzymatic deficiency in leukocytes or fibroblasts. Genetic testing is available. Differential diagnoses can include the milder and more severe forms of mucopolysaccharidosis type 1 (Scheie syndrome and Hurler syndrome respectively), mucopolysaccharidosis typeVI and mucopolysaccharidosis type II. Antenatal diagnosis is possible by measurement of enzymatic activity in cultivated chorionic villus or amniocytes and by genetic testing if the disease-causing mutation is known. Transmission is autosomal recessive. Bone marrow or umbilical cord blood transplant has been successful and can preserve neurocognition, improve some aspects of the somatic disease and increase survival. However, it is associated with many risks and most of the positive effects occur only if the procedure is performed in the first two years of life.

The enzyme substitute (laronidase) obtained EU marketing authorization as an orphan drug in 2003. Given through weekly infusions it leads to improvement of lung function and joint mobility. Enzyme replacement therapy (ERT) can be started at diagnosis and may be beneficial in patients awaiting hematopoietic stem cell transplantation (HSCT). Early treatment can slow the progression of the disease. In individual patients with MPS1 of intermediate severity, HSCT may be considered if there is a suitable donor. There are however no data on the efficacy of HSCT in patients with this form of the disease.

Life expectancy for Hurler-Scheie syndrome may be reduced, with death occurring before adolescence due to serious cardiovascular and respiratory complications.

In some cases, in a patient with hurler scheie syndrome, homozygosity for an arg619-to-gly (R619G) mutation due to a C-to-G transversion at nucleotide 1943 can be identified. In some cases, in a patient with hurler scheie syndrome, homozygosity for a thr364-to-met (T364M) mutation in the IDUA gene can be identified.

Retained Intron Containing Pre-mRNA (RIC Pre-mRNA)

In embodiments, the methods of the present invention can exploit the presence of retained-intron-containing pre-mRNA (RIC pre-mRNA) transcribed from the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B gene and encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, in the cell nucleus. Splicing of ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA species to produce mature, fully-spliced, ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B mRNA, can be induced using ASOs that stimulate splicing out of the retained introns. The resulting mature ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B mRNA can be exported to the cytoplasm and translated, thereby increasing the amount of ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein in the patient's cells and alleviating symptoms of the CNS disease or conditions caused by deficiency in ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B. This method, described further below, is known as Targeted Augmentation of Nuclear Gene Output (TANGO).

In some cases, the methods of the present invention can exploit the presence of retained-intron-containing pre-mRNA (RIC pre-mRNA) transcribed from the ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B gene and encoding ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein, in the cell nucleus. Splicing of ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B RIC pre-mRNA species to produce mature, fully-spliced, ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B mRNA, can be induced using ASOs that stimulate splicing out of the retained introns. The resulting mature ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B mRNA can be exported to the cytoplasm and translated, thereby increasing the amount of ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein in the patient's cells and alleviating symptoms of the CNS disease or conditions caused by deficiency in ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B. This method, described further below, is known as Targeted Augmentation of Nuclear Gene Output (TANGO).

In some instances, the methods of the present invention can exploit the presence of retained-intron-containing pre-mRNA (RIC pre-mRNA) transcribed from the ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B gene and encoding ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B protein, in the cell nucleus. Splicing of ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B RIC pre-mRNA species to produce mature, fully-spliced, ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B mRNA, can be induced using ASOs that stimulate splicing out of the retained introns. The resulting mature ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B mRNA can be exported to the cytoplasm and translated, thereby increasing the amount of ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B protein in the patient's cells and alleviating symptoms of the CNS disease or conditions caused by deficiency in ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B. This method, described further below, is known as Targeted Augmentation of Nuclear Gene Output (TANGO).

Nuclear Transcripts

ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B gene can be analyzed for intron-retention events. In some cases, ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B gene can be analyzed for intron-retention events. In some cases, ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B gene can be analyzed for intron-retention events. RNA sequencing (RNAseq), can be visualized in the UCSC genome browser, and can show ATP1A2, CACNA1A, SETD5, SHANK3, NF2, DNMT1, TCF4, RAI1, PEX1, ARSA, MFSD8, EIF2B5, EIF2B1, EIF2B2, NPC1, ADAR, STXBP1, PRICKLE2, PRRT2, or STX1B transcripts expressed in human cortical neurons (HCN) or (AST) and localized in either the cytoplasmic or nuclear fraction. The retained-intron containing pre-mRNA transcripts are retained in the nucleus and are not exported out to the cytoplasm.

In embodiments, a retained intron is an intron that is identified as a retained intron based on a determination of at least about 5%, at least about 10%, at least about 15%, at least about 20%, at least about 25%, at least about 30%, at least about 35%, at least about 40%, at least about 45%, or at least about 50%, retention. In embodiments, a retained intron is an intron that is identified as a retained intron based on a determination of about 5% to about 100%, about 5% to about 95%, about 5% to about 90%, about 5% to about 85%, about 5% to about 80%, about 5% to about 75%, about 5% to about 70%, about 5% to about 65%, about 5% to about 60%, about 5% to about 65%, about 5% to about 60%, about 5% to about 55%, about 5% to about 50%, about 5% to about 45%, about 5% to about 40%, about 5% to about 35%, about 5% to about 30%, about 5% to about 25%, about 5% to about 20%, about 5% to about 15%, about 10% to about 100%, about 10% to about 95%, about 10% to about 90%, about 10% to about 85%, about 10% to about 80%, about 10% to about 75%, about 10% to about 70%, about 10% to about 65%, about 10% to about 60%, about 10% to about 65%, about 10% to about 60%, about 10% to about 55%, about 10% to about 50%, about 10% to about 45%, about 10% to about 40%, about 10% to about 35%, about 10% to about 30%, about 10% to about 25%, about 10% to about 20%, about 15% to about 100%, about 15% to about 95%, about 15% to about 90%, about 15% to about 85%, about 15% to about 80%, about 15% to about 75%, about 15% to about 70%, about 15% to about 65%, about 15% to about 60%, about 15% to about 65%, about 15% to about 60%, about 15% to about 55%, about 15% to about 50%, about 15% to about 45%, about 15% to about 40%, about 15% to about 35%, about 15% to about 30%, about 15% to about 25%, about 20% to about 100%, about 20% to about 95%, about 20% to about 90%, about 20% to about 85%, about 20% to about 80%, about 20% to about 75%, about 20% to about 70%, about 20% to about 65%, about 20% to about 60%, about 20% to about 65%, about 20% to about 60%, about 20% to about 55%, about 20% to about 50%, about 20% to about 45%, about 20% to about 40%, about 20% to about 35%, about 20% to about 30%, about 25% to about 100%, about 25% to about 95%, about 25% to about 90%, about 25% to about 85%, about 25% to about 80%, about 25% to about 75%, about 25% to about 70%, about 25% to about 65%, about 25% to about 60%, about 25% to about 65%, about 25% to about 60%, about 25% to about 55%, about 25% to about 50%, about 25% to about 45%, about 25% to about 40%, or about 25% to about 35%, retention. In embodiments, other ASOs useful for this purpose are identified, using, e.g., methods described herein.

Table 7 provides a non-limiting list of target sequences of RIC pre-mRNA transcript of ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, and STX1B by sequence ID, and ASOs by sequence ID, useful for increasing production of a protein by targeting a region of a RIC pre-mRNA of ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B. In embodiments, other ASOs useful for these purposes are identified, using, e.g., methods described herein.

TABLE 7

List of targets and ASOs that targeting a gene disclosed herein

| Gene SEQ ID NO: | Pre-mRNA SEQ ID NO: | ASOs | Retained Intron | Target Sequence SEQ ID NO: |
|---|---|---|---|---|
| ADAR SEQ ID NO: 6274 | ADAR: NM_001193495 SEQ ID NO: 6293 | SEQ ID NOs: 6354-6872 | 2 | 30656 |
| | ADAR: NM_015841 SEQ ID NO: 6294 | SEQ ID NOs: 6873-7391 | 2 | 30656 |
| | ADAR: NM_015840 SEQ ID NO: 6295 | SEQ ID NOs: 7392-7910 | 2 | 30656 |
| | ADAR: NM_001111 SEQ ID NO: 6296 | SEQ ID NOs: 7911-8429 | 2 | 30656 |
| | ADAR: NM_001025107 SEQ ID NO: 6297 | SEQ ID NOs: 8430-8948 | 2 | 30656 |
| ATP1A2 SEQ ID NO: 6275 | ATP1A2: NM_000702 SEQ ID NO: 6298 | SEQ ID NOs: 8949-9575 | 22 | 30632 |
| PRICKLE2 SEQ ID NO: 6276 | PRICKLE2: NM_198859 SEQ ID NO: 6299 | SEQ ID NOs: 9576-9825 | 4 | 30645 |
| SETD5 SEQ ID NO: 6277 | SETD5: NM_001080517 SEQ ID NO: 6300 | SEQ ID NOs: 9826-9946 | 4 | 30659 |
| | SETD5: NM_001292043 SEQ ID NO: 6301 | SEQ ID NOs: 9947-10067 | 5 | 30659 |
| EIF2B5 SEQ ID NO: 6278 | EIF2B5: NM_003907 SEQ ID NO: 6302 | SEQ ID NOs: 10068-10159 | 12 | 30649 |
| | | SEQ ID NOs: 10160-10305 | 13 | 30637 |
| PEX1 SEQ ID NO: 6279 | PEX1: NM_000466 SEQ ID NO: 6303 | SEQ ID NOs: 10306-10476 | 10 | 30634 |
| | | SEQ ID NOs: 10307-10718 | 19 | 30643 |
| | | SEQ ID NOs: 10719-10988 | 21 | 30653 |
| | | SEQ ID NOs: 10989-11098 | 14 | 30629 |
| | PEX1: NM_001282677 SEQ ID NO: 6304 | SEQ ID NOs: 11099-11269 | 10 | 30634 |
| | | SEQ ID NOs: 11100-11511 | 18 | 30643 |
| | | SEQ ID NOs: 11512-11781 | 20 | 30653 |
| | | SEQ ID NOs: 11782-11891 | 13 | 30629 |
| | PEX1: NM_001282678 SEQ ID NO: 6305 | SEQ ID NOs: 11892-12062 | 10 | 30634 |
| | | SEQ ID NOs: 11893-12304 | 19 | 30643 |
| | | SEQ ID NOs: 12305-12574 | 21 | 30653 |
| | | SEQ ID NOs: 12306-12684 | 14 | 30629 |
| STXBP1 SEQ ID NO: 6278 | STXBP1: NM_003165 SEQ ID NO: 6306 | SEQ ID NOs: 12685-12918 | 18 | 30627 |
| | | SEQ ID NOs: 12919-13469 | 19 | 30624 |
| | STXBP1: NM_001032221 SEQ ID NO: 6307 | SEQ ID NOs: 13470-14026 | 18 | 30633 |
| EIF2B1 SEQ ID NO: 6279 | EIF2B1: NM_001414 SEQ ID NO: 6308 | SEQ ID NOs: 14027-14237 | 6 | 30626 |
| EIF2B2 SEQ ID NO: 6280 | EIF2B2: NM_014239 SEQ ID NO: 6309 | SEQ ID NOs: 14238-14326 | 1 | 30631 |
| PRRT2 SEQ ID NO: 6281 | PRRT2: NM_001256443 SEQ ID NO: 6310 | SEQ ID NOs: 14327-14983 | 1 | 30642 |
| | PRRT2: NM_145239 SEQ ID NO: 6311 | SEQ ID NOs: 14984-15294 | 1 | 30638 |
| | PRRT2: NM_001256442 SEQ ID NO: 6312 | SEQ ID NOs: 15295-15605 | 1 | 30638 |
| STX1B SEQ ID NO: 6282 | STX1B: NM_052874 SEQ ID NO: 6313 | SEQ ID NOs: 15606-15652 | 6 | 30658 |
| | | SEQ ID NOs: 15653-15873 | 7 | 30648 |
| RAI1 SEQ ID NO: 6283 | RAI1: NM_030665 SEQ ID NO: 6314 | SEQ ID NOs: 15874-16076 | 4 | 30655 |
| TCF4 SEQ ID NO: 6284 | TCF4: NM_001243236 SEQ ID NO: 6315 | SEQ ID NOs: 30660-30916 | 10 | 34789 |
| | TCF4: NM_001243235 SEQ ID NO: 6316 | SEQ ID NOs: 30917-31173 | 10 | 34789 |
| | TCF4: NM_001243234 SEQ ID NO: 6317 | SEQ ID NOs: 31174-31432 | 10 | 34788 |
| | TCF4: NM_001243233 SEQ ID NO: 6318 | SEQ ID NOs: 31433-31689 | 13 | 34789 |
| | TCF4: NM_001243232 SEQ ID NO: 6319 | SEQ ID NOs: 31690-31948 | 13 | 34788 |
| | TCF4: NM_001243231 SEQ ID NO: 6320 | SEQ ID NOs: 31949-32205 | 15 | 34789 |
| | TCF4: NM_003199 SEQ ID NO: 6321 | SEQ ID NOs: 32206-32462 | 17 | 34789 |
| | TCF4: NM_001306207 SEQ ID NO: 6322 | SEQ ID NOs: 32463-32719 | 16 | 34789 |

TABLE 7-continued

List of targets and ASOs that targeting a gene disclosed herein

| Gene SEQ ID NO: | Pre-mRNA SEQ ID NO: | ASOs | Retained Intron | Target Sequence SEQ ID NO: |
|---|---|---|---|---|
| | TCF4: NM_001306208 SEQ ID NO: 6323 | SEQ ID NOs: 32720-32976 | 13 | 34789 |
| | TCF4: NM_001243227 SEQ ID NO: 6324 | SEQ ID NOs: 32977-33235 | 16 | 34788 |
| | TCF4: NM_001243228 SEQ ID NO: 6325 | SEQ ID NOs: 33236-33494 | 17 | 34788 |
| | TCF4: NM_001243230 SEQ ID NO: 6326 | SEQ ID NOs: 33495-33751 | 16 | 34789 |
| | TCF4: NM_001243226 SEQ ID NO: 6327 | SEQ ID NOs: 33752-34010 | 18 | 34788 |
| | TCF4: NM_001083962 SEQ ID NO: 6328 | SEQ ID NOs: 34011-34269 | 17 | 34788 |
| | TCF4: NM_001330605 SEQ ID NO: 6329 | SEQ ID NOs: 34270-34528 | 12 | 34788 |
| | TCF4: NM_001330604 SEQ ID NO: 6330 | SEQ ID NOs: 34529-34787 | 17 | 34788 |
| NPC1 SEQ ID NO: 6285 | NPC1: NM_000271 SEQ ID NO: 6331 | SEQ ID NOs: 19965-20033 | 15 | 30655 |
| CACNA1A SEQ ID NO: 6286 | CACNA1A: NM_000068 SEQ ID NO: 6332 | SEQ ID NOs: 20034-20253 SEQ ID NOs: 20254-20469 | 36 37 | 30657 30650 |
| | CACNA1A: NM_023035 SEQ ID NO: 6333 | SEQ ID NOs: 20470-20689 SEQ ID NOs: 20690-20905 | 36 37 | 30657 30650 |
| | CACNA1A: NM_001174080 SEQ ID NO: 6334 | SEQ ID NOs: 20906-21125 SEQ ID NOs: 21126-21341 | 36 37 | 30657 30650 |
| | CACNA1A: NM_001127222 SEQ ID NO: 6335 | SEQ ID NOs: 21342-21561 SEQ ID NOs: 21562-21777 | 36 37 | 30657 30650 |
| | CACNA1A: NM_001127221 SEQ ID NO: 6336 | SEQ ID NOs: 21778-21983 SEQ ID NOs: 21984-22187 | 36 37 | 30647 30639 |
| DNMT1 SEQ ID NO: 6287 | DNMT1: NM_001379 SEQ ID NO: 6337 | SEQ ID NOs: 22188-22400 SEQ ID NOs: 22401-22441 | 29 14 | 30644 30635 |
| | DNMT1: NM_001130823 SEQ ID NO: 6338 | SEQ ID NOs: 22442-22654 SEQ ID NOs: 22655-22695 | 30 15 | 30644 30635 |
| | DNMT1: NM_001318730 SEQ ID NO: 6339 | SEQ ID NOs: 22696-22908 SEQ ID NOs: 22909-22949 | 29 14 | 30644 30635 |
| | DNMT1: NM_001318731 SEQ ID NO: 6340 | SEQ ID NOs: 22950-23162 SEQ ID NOs: 23163-23203 | 30 15 | 30644 30635 |
| NF2 SEQ ID NO: 6288 | NF2: NM_181830 SEQ ID NO: 6341 | SEQ ID NOs: 23204-24115 | 14 | 30646 |
| | NF2: NM_181829 SEQ ID NO: 6342 | SEQ ID NOs: 24116-25027 | 15 | 30646 |
| | NF2: NM_181833 SEQ ID NO: 6343 | SEQ ID NOs: 25028-25945 | 4 | 30640 |
| | NF2: NM_181832 SEQ ID NO: 6344 | SEQ ID NOs: 25946-26860 | 16 | 30625 |
| | NF2: NM_181828 SEQ ID NO: 6345 | SEQ ID NOs: 26861-27772 | 15 | 30646 |
| | NF2: NM_016418 SEQ ID NO: 6346 | SEQ ID NOs: 27773-28684 | 16 | 30646 |
| | NF2: NM_000268 SEQ ID NO: 6347 | SEQ ID NOs: 28685-29620 | 15 | 30641 |
| SHANK3 SEQ ID NO: 6289 | SHANK3: NM_033517 SEQ ID NO: 6348 | SEQ ID NOs: 29621-29808 | 16 | 30630 |
| ARSA SEQ ID NO: 6290 | ARSA: NM_000487 SEQ ID NO: 6349 | SEQ ID NOs: 29808-29895 SEQ ID NOs: 29895-29971 | 2 3 | 30651 30636 |
| | ARSA: NM_001085425 SEQ ID NO: 6350 | SEQ ID NOs: 29972-30058 SEQ ID NOs: 30059-30134 | 3 4 | 30651 30636 |
| | ARSA: NM_001085426 SEQ ID NO: 6351 | SEQ ID NOs: 30135-30221 SEQ ID NOs: 30222-30297 | 3 4 | 30651 30636 |
| | ARSA: NM_001085427 SEQ ID NO: 6352 | SEQ ID NOs: 30298-30384 SEQ ID NOs: 30385-30460 | 3 4 | 30651 30636 |
| | ARSA: NM_001085428 SEQ ID NO: 6353 | SEQ ID NOs: 30461-30547 SEQ ID NOs: 30548-30623 | 2 3 | 30651 30636 |

In some embodiments, the ASOs disclosed herein target a RIC pre-mRNA transcribed from a ADAR genomic sequence. In some embodiments, the ASO targets a RIC pre-mRNA transcript from a ADAR genomic sequence comprising a retained intron. In some embodiments, the ASO targets a RIC pre-mRNA transcript of SEQ ID NO: 6274. In some embodiments, the ASO targets a RIC pre-mRNA transcript of SEQ ID NO: 6274 comprising a retained intron. In some embodiments, the ASOs disclosed herein target a ADAR RIC pre-mRNA sequence. In some embodiments, the ASO targets a ADAR RIC pre-mRNA transcript comprising a retained intron at 2, wherein the intron numbering correspond to the mRNA sequence at NM_001193495. In some embodiments, the ASO targets a ADAR RIC pre-mRNA transcript comprising a retained intron at 2, wherein the intron numbering correspond to the mRNA sequence at NM_015841. In some embodiments, the ASO targets a ADAR RIC pre-mRNA transcript comprising a retained intron at 2, wherein the intron numbering correspond to the mRNA sequence at NM_015840. In some embodiments, the ASO targets a ADAR RIC pre-mRNA transcript comprising a retained intron at 2, wherein the intron numbering correspond to the mRNA sequence at NM_001111. In some embodiments, the ASO targets a ADAR RIC pre-mRNA transcript comprising a retained intron at 2, wherein the intron numbering correspond to the mRNA sequence at NM_001025107.

In some embodiments, the ASO targets a ADAR RIC pre-mRNA sequence according to SEQ ID NO: 6293. In some embodiments, the ASO targets a ADAR RIC pre-mRNA sequence according to SEQ ID NO: 6293 comprising a retained intron 2. In some embodiments, the ASO targets a ADAR RIC pre-mRNA sequence according to SEQ ID NO: 6294. In some embodiments, the ASO targets a ADAR RIC pre-mRNA sequence according to SEQ ID NO: 6294 comprising a retained intron 2. In some embodiments, the ASO targets a ADAR RIC pre-mRNA sequence according to SEQ ID NO: 6295. In some embodiments, the ASO targets a ADAR RIC pre-mRNA sequence according to SEQ ID NO: 62952 comprising a retained intron 2. In some embodiments, the ASO targets a ADAR RIC pre-mRNA sequence according to SEQ ID NO: 6296. In some embodiments, the ASO targets a ADAR RIC pre-mRNA sequence according to SEQ ID NO: 6296 comprising a retained intron 2. In some embodiments, the ASO targets a ADAR RIC pre-mRNA sequence according to SEQ ID NO: 6297. In some embodiments, the ASO targets a ADAR RIC pre-mRNA sequence according to SEQ ID NO: 6297 comprising a retained intron 2. In some embodiments, the ASOs disclosed herein target SEQ ID NO: 30656. In some embodiments, the ASO has a sequence according to any one of SEQ ID NOs: 6364-8948.

In some embodiments, the ASO targets exon 2 or exon 3 of a ADAR RIC pre-mRNA comprising a retained intron 2, wherein the intron numbering correspond to the mRNA sequence at NM_001193495. In some embodiments, the ASO targets an exon 2 sequence upstream (or 5') from the 5' splice site of a ADAR RIC pre-mRNA comprising the retained intron 2. In some embodiments, the ASO targets an exon 2 sequence about 4 to about 1566 or about 14 to about 1566 nucleotides upstream (or 5') from the 5' splice site of a ADAR RIC pre-mRNA comprising the retained intron 2. In some embodiments, the ASO targets an exon 3 sequence downstream (or 3') from the 3' splice site of a ADAR RIC pre-mRNA comprising the retained intron 2. In some embodiments, the ASO targets an exon 3 sequence about 2 to about 165 nucleotides downstream (or 3') from the 3' splice site of a ADAR RIC pre-mRNA comprising the retained intron 2.

In some embodiments, the ASO targets intron 2 in a ADAR RIC pre-mRNA comprising a retained intron 2, wherein the intron numbering correspond to the mRNA sequence at NM_001193495. In some embodiments, the ASO targets an intron 2 sequence downstream (or 3') from the 5' splice site of a ADAR RIC pre-mRNA comprising the retained intron 2. In some embodiments, the ASO targets an intron 2 sequence about 6 to about 500 nucleotides downstream (or 3') from the 5' splice site of a ADAR RIC pre-mRNA comprising the retained intron 2. In some embodiments, the ASO targets an intron 2 sequence upstream (or 5') from the 3' splice site of a ADAR RIC pre-mRNA comprising the retained intron 2. In some embodiments, the ASO targets an intron 2 sequence about 16 to about 499 nucleotides upstream (or 5') from the 3' splice site of a ADAR RIC pre-mRNA comprising the retained intron 2.

In some embodiments, the ASO targets exon 2 or exon 3 of a ADAR RIC pre-mRNA comprising a retained intron 2, wherein the intron numbering correspond to the mRNA sequence at NM_015841. In some embodiments, the ASO targets an exon 2 sequence upstream (or 5') from the 5' splice site of a ADAR RIC pre-mRNA comprising the retained intron 2. In some embodiments, the ASO targets an exon 2 sequence about 4 to about 1566 or about 14 to about 1566 nucleotides upstream (or 5') from the 5' splice site of a ADAR RIC pre-mRNA comprising the retained intron 2. In some embodiments, the ASO targets an exon 3 sequence downstream (or 3') from the 3' splice site of a ADAR RIC pre-mRNA comprising the retained intron 2. In some embodiments, the ASO targets an exon 3 sequence about 2 to about 165 nucleotides downstream (or 3') from the 3' splice site of a ADAR RIC pre-mRNA comprising the retained intron 2.

In some embodiments, the ASO targets intron 2 in a ADAR RIC pre-mRNA comprising a retained intron 2, wherein the intron numbering correspond to the mRNA sequence at NM_015841. In some embodiments, the ASO targets an intron 2 sequence downstream (or 3') from the 5' splice site of a ADAR RIC pre-mRNA comprising the retained intron 2. In some embodiments, the ASO targets an intron 2 sequence about 6 to about 500 nucleotides downstream (or 3') from the 5' splice site of a ADAR RIC pre-mRNA comprising the retained intron 2. In some embodiments, the ASO targets an intron 2 sequence upstream (or 5') from the 3' splice site of a ADAR RIC pre-mRNA comprising the retained intron 2. In some embodiments, the ASO targets an intron 2 sequence about 16 to about 499 nucleotides upstream (or 5') from the 3' splice site of a ADAR RIC pre-mRNA comprising the retained intron 2.

In some embodiments, the ASO targets exon 2 or exon 3 of a ADAR RIC pre-mRNA comprising a retained intron 2, wherein the intron numbering correspond to the mRNA sequence at NM_015840. In some embodiments, the ASO targets an exon 2 sequence upstream (or 5') from the 5' splice site of a ADAR RIC pre-mRNA comprising the retained intron 2. In some embodiments, the ASO targets an exon 2 sequence about 4 to about 1566 or about 14 to about 1566 nucleotides upstream (or 5') from the 5' splice site of a ADAR RIC pre-mRNA comprising the retained intron 2. In some embodiments, the ASO targets an exon 3 sequence downstream (or 3') from the 3' splice site of a ADAR RIC pre-mRNA comprising the retained intron 2. In some embodiments, the ASO targets an exon 3 sequence about 2 to about 165 nucleotides downstream (or 3') from the 3' splice site of a ADAR RIC pre-mRNA comprising the retained intron 2.

In some embodiments, the ASO targets intron 2 in a ADAR RIC pre-mRNA comprising a retained intron 2, wherein the intron numbering correspond to the mRNA sequence at NM_015840. In some embodiments, the ASO targets an intron 2 sequence downstream (or 3') from the 5' splice site of a ADAR RIC pre-mRNA comprising the retained intron 2. In some embodiments, the ASO targets an intron 2 sequence about 6 to about 500 nucleotides downstream (or 3') from the 5' splice site of a ADAR RIC pre-mRNA comprising the retained intron 2. In some embodiments, the ASO targets an intron 2 sequence upstream (or 5') from the 3' splice site of a ADAR RIC pre-mRNA comprising the retained intron 2. In some embodiments, the ASO targets an intron 2 sequence about 16 to about 499 nucleotides upstream (or 5') from the 3' splice site of a ADAR RIC pre-mRNA comprising the retained intron 2.

In some embodiments, the ASO targets exon 2 or exon 3 of a ADAR RIC pre-mRNA comprising a retained intron 2, wherein the intron numbering correspond to the mRNA sequence at NM_001111. In some embodiments, the ASO targets an exon 2 sequence upstream (or 5') from the 5' splice site of a ADAR RIC pre-mRNA comprising the retained intron 2. In some embodiments, the ASO targets an exon 2 sequence about 4 to about 1566 or about 14 to about 1566 nucleotides upstream (or 5') from the 5' splice site of a ADAR RIC pre-mRNA comprising the retained intron 2. In some embodiments, the ASO targets an exon 3 sequence downstream (or 3') from the 3' splice site of a ADAR RIC pre-mRNA comprising the retained intron 2. In some embodiments, the ASO targets an exon 3 sequence about 2 to about 165 nucleotides downstream (or 3') from the 3' splice site of a ADAR RIC pre-mRNA comprising the retained intron 2.

In some embodiments, the ASO targets intron 2 in a ADAR RIC pre-mRNA comprising a retained intron 2, wherein the intron numbering correspond to the mRNA sequence at NM_001111. In some embodiments, the ASO targets an intron 2 sequence downstream (or 3') from the 5' splice site of a ADAR RIC pre-mRNA comprising the retained intron 2. In some embodiments, the ASO targets an intron 2 sequence about 6 to about 500 nucleotides downstream (or 3') from the 5' splice site of a ADAR RIC pre-mRNA comprising the retained intron 2. In some embodiments, the ASO targets an intron 2 sequence upstream (or 5') from the 3' splice site of a ADAR RIC pre-mRNA comprising the retained intron 2. In some embodiments, the ASO targets an intron 2 sequence about 16 to about 499 nucleotides upstream (or 5') from the 3' splice site of a ADAR RIC pre-mRNA comprising the retained intron 2.

In some embodiments, the ASO targets exon 2 or exon 3 of a ADAR RIC pre-mRNA comprising a retained intron 2, wherein the intron numbering correspond to the mRNA sequence at NM_001025107. In some embodiments, the ASO targets an exon 2 sequence upstream (or 5') from the 5' splice site of a ADAR RIC pre-mRNA comprising the retained intron 2. In some embodiments, the ASO targets an exon 2 sequence about 4 to about 1566 or about 14 to about 1566 nucleotides upstream (or 5') from the 5' splice site of a ADAR RIC pre-mRNA comprising the retained intron 2. In some embodiments, the ASO targets an exon 3 sequence downstream (or 3') from the 3' splice site of a ADAR RIC pre-mRNA comprising the retained intron 2. In some embodiments, the ASO targets an exon 3 sequence about 2 to about 165 nucleotides downstream (or 3') from the 3' splice site of a ADAR RIC pre-mRNA comprising the retained intron 2.

In some embodiments, the ASO targets intron 2 in a ADAR RIC pre-mRNA comprising a retained intron 2, wherein the intron numbering correspond to the mRNA sequence at NM_001025107. In some embodiments, the ASO targets an intron 2 sequence downstream (or 3') from the 5' splice site of a ADAR RIC pre-mRNA comprising the retained intron 2. In some embodiments, the ASO targets an intron 2 sequence about 6 to about 500 nucleotides downstream (or 3') from the 5' splice site of a ADAR RIC pre-mRNA comprising the retained intron 2. In some embodiments, the ASO targets an intron 2 sequence upstream (or 5') from the 3' splice site of a ADAR RIC pre-mRNA comprising the retained intron 2. In some embodiments, the ASO targets an intron 2 sequence about 16 to about 499 nucleotides upstream (or 5') from the 3' splice site of a ADAR RIC pre-mRNA comprising the retained intron 2.

In some embodiments, the ASOs disclosed herein target a RIC pre-mRNA transcribed from a ATP1A2 genomic sequence. In some embodiments, the ASO targets a RIC pre-mRNA transcript from a ATP1A2 genomic sequence comprising a retained intron. In some embodiments, the ASO targets a RIC pre-mRNA transcript of SEQ ID NO: 6275. In some embodiments, the ASO targets a RIC pre-mRNA transcript of SEQ ID NO: 6275 comprising a retained intron. In some embodiments, the ASOs disclosed herein target a ATP1A2 RIC pre-mRNA sequence. In some embodiments, the ASO targets a ATP1A2 RIC pre-mRNA transcript comprising a retained intron at 22, wherein the intron numbering correspond to the mRNA sequence at NM_000702.

In some embodiments, the ASO targets a ATP1A2 RIC pre-mRNA sequence according to SEQ ID NO: 6298. In some embodiments, the ASO targets a ATP1A2 RIC pre-mRNA sequence according to SEQ ID NO: 6298 comprising a retained intron 22. In some embodiments, the ASOs disclosed herein target SEQ ID NO: 30632. In some embodiments, the ASO has a sequence according to any one of SEQ ID NOs: 8949-9575.

In some embodiments, the ASO targets exon 22 or exon 23 of a ATP1A2 RIC pre-mRNA comprising a retained intron 22, wherein the intron numbering correspond to the mRNA sequence at NM_000702. In some embodiments, the ASO targets an exon 22 sequence upstream (or 5') from the 5' splice site of a ATP1A2 RIC pre-mRNA comprising the retained intron 22. In some embodiments, the ASO targets an exon 22 sequence about 4 to about 71 nucleotides upstream (or 5') from the 5' splice site of a ATP1A2 RIC pre-mRNA comprising the retained intron 22. In some embodiments, the ASO targets an exon 23 sequence downstream (or 3') from the 3' splice site of a ATP1A2 RIC pre-mRNA comprising the retained intron 22. In some embodiments, the ASO targets an exon 23 sequence about 2 to about 2271 nucleotides downstream (or 3') from the 3' splice site of a ATP1A2 RIC pre-mRNA comprising the retained intron 22.

In some embodiments, the ASO targets intron 22 in a ATP1A2 RIC pre-mRNA comprising a retained intron 22, wherein the intron numbering correspond to the mRNA sequence at NM_000702. In some embodiments, the ASO targets an intron 22 sequence downstream (or 3') from the 5' splice site of a ATP1A2 RIC pre-mRNA comprising the retained intron 22. In some embodiments, the ASO targets an intron 22 sequence about 6 to about 498 or about 21 to about 498 nucleotides downstream (or 3') from the 5' splice site of a ATP1A2 RIC pre-mRNA comprising the retained intron 22. In some embodiments, the ASO targets an intron 22 sequence upstream (or 5') from the 3' splice site of a ATP1A2 RIC pre-mRNA comprising the retained intron 22. In some embodiments, the ASO targets an intron 22 sequence about 16 to about 500 nucleotides upstream (or 5') from the 3' splice site of a ATP1A2 RIC pre-mRNA comprising the retained intron 22.

In some embodiments, the ASOs disclosed herein target a RIC pre-mRNA transcribed from a PRICKLE2 genomic sequence. In some embodiments, the ASO targets a RIC pre-mRNA transcript from a PRICKLE2 genomic sequence comprising a retained intron. In some embodiments, the ASO targets a RIC pre-mRNA transcript of SEQ ID NO: 6276. In some embodiments, the ASO targets a RIC pre-mRNA transcript of SEQ ID NO: 6276 comprising a retained intron. In some embodiments, the ASOs disclosed herein target a PRICKLE2 RIC pre-mRNA sequence. In some embodiments, the ASO targets a PRICKLE2 RIC pre-mRNA transcript comprising a retained intron at 4, wherein the intron numbering correspond to the mRNA sequence at NM_198859.

In some embodiments, the ASO targets a PRICKLE2 RIC pre-mRNA sequence according to SEQ ID NO: 6299. In some embodiments, the ASO targets a PRICKLE2 RIC pre-mRNA sequence according to SEQ ID NO: 6299 comprising a retained intron 4. In some embodiments, the ASOs disclosed herein target SEQ ID NO: 30645. In some embodiments, the ASO has a sequence according to any one of SEQ ID NOs: 9576-9825.

In some embodiments, the ASO targets exon 4 or exon 5 of a PRICKLE2 RIC pre-mRNA comprising a retained intron 4, wherein the intron numbering correspond to the mRNA sequence at NM_198859. In some embodiments, the ASO targets an exon 4 sequence upstream (or 5') from the 5' splice site of a PRICKLE2 RIC pre-mRNA comprising the retained intron 4. In some embodiments, the ASO targets an exon 4 sequence about 4 to about 119 nucleotides upstream (or 5') from the 5' splice site of a PRICKLE2 RIC pre-mRNA comprising the retained intron 4. In some embodiments, the ASO targets an exon 5 sequence downstream (or 3') from the 3' splice site of a PRICKLE2 RIC pre-mRNA comprising the retained intron 4. In some embodiments, the ASO targets an exon 5 sequence about 2 to about 187 nucleotides downstream (or 3') from the 3' splice site of a PRICKLE2 RIC pre-mRNA comprising the retained intron 4.

In some embodiments, the ASO targets intron 4 in a PRICKLE2 RIC pre-mRNA comprising a retained intron 4, wherein the intron numbering correspond to the mRNA sequence at NM_198859. In some embodiments, the ASO targets an intron 4 sequence downstream (or 3') from the 5' splice site of a PRICKLE2 RIC pre-mRNA comprising the retained intron 4. In some embodiments, the ASO targets an intron 4 sequence about 6 to about 496 nucleotides downstream (or 3') from the 5' splice site of a PRICKLE2 RIC pre-mRNA comprising the retained intron 4. In some embodiments, the ASO targets an intron 4 sequence upstream (or 5') from the 3' splice site of a PRICKLE2 RIC pre-mRNA comprising the retained intron 4. In some embodiments, the ASO targets an intron 4 sequence about 16 to about 499 nucleotides upstream (or 5') from the 3' splice site of a PRICKLE2 RIC pre-mRNA comprising the retained intron 4.

In some embodiments, the ASOs disclosed herein target a RIC pre-mRNA transcribed from a SETD5 genomic sequence. In some embodiments, the ASO targets a RIC pre-mRNA transcript from a SETD5 genomic sequence comprising a retained intron. In some embodiments, the ASO targets a RIC pre-mRNA transcript of SEQ ID NO: 6277. In some embodiments, the ASO targets a RIC pre-mRNA transcript of SEQ ID NO: 6277 comprising a retained intron. In some embodiments, the ASOs disclosed herein target a SETD5 RIC pre-mRNA sequence. In some embodiments, the ASO targets a SETD5 RIC pre-mRNA transcript comprising a retained intron at 4, wherein the intron numbering correspond to the mRNA sequence at NM_001080517. In some embodiments, the ASO targets a SETD5 RIC pre-mRNA transcript comprising a retained intron at 5, wherein the intron numbering correspond to the mRNA sequence at NM_001292043.

In some embodiments, the ASO targets a SETD5 RIC pre-mRNA sequence according to SEQ ID NO: 6300. In some embodiments, the ASO targets a SETD5 RIC pre-mRNA sequence according to SEQ ID NO: 6300 comprising a retained intron 4. In some embodiments, the ASO targets a SETD5 RIC pre-mRNA sequence according to SEQ ID NO: 6301. In some embodiments, the ASO targets a SETD5 RIC pre-mRNA sequence according to SEQ ID NO: 6301 comprising a retained intron 5. In some embodiments, the ASOs disclosed herein target SEQ ID NO: 30659. In some embodiments, the ASO has a sequence according to any one of SEQ ID NOs: 9826-10067.

In some embodiments, the ASO targets exon 4 or exon 5 of a SETD5 RIC pre-mRNA comprising a retained intron 4, wherein the intron numbering correspond to the mRNA sequence at NM_001080517. In some embodiments, the ASO targets an exon 4 sequence upstream (or 5') from the 5' splice site of a SETD5 RIC pre-mRNA comprising the retained intron 4. In some embodiments, the ASO targets an exon 4 sequence about 4 to about 89 nucleotides upstream (or 5') from the 5' splice site of a SETD5 RIC pre-mRNA comprising the retained intron 4. In some embodiments, the ASO targets an exon 5 sequence downstream (or 3') from the 3' splice site of a SETD5 RIC pre-mRNA comprising the retained intron 4. In some embodiments, the ASO targets an exon 5 sequence about 2 to about 132 nucleotides downstream (or 3') from the 3' splice site of a SETD5 RIC pre-mRNA comprising the retained intron 4.

In some embodiments, the ASO targets intron 4 in a SETD5 RIC pre-mRNA comprising a retained intron 4, wherein the intron numbering correspond to the mRNA sequence at NM_001080517. In some embodiments, the ASO targets an intron 4 sequence downstream (or 3') from the 5' splice site of a SETD5 RIC pre-mRNA comprising the retained intron 4. In some embodiments, the ASO targets an intron 4 sequence about 6 to about 204 nucleotides downstream (or 3') from the 5' splice site of a SETD5 RIC pre-mRNA comprising the retained intron 4. In some embodiments, the ASO targets an intron 4 sequence upstream (or 5') from the 3' splice site of a SETD5 RIC pre-mRNA comprising the retained intron 4. In some embodiments, the ASO targets an intron 4 sequence about 16 to about 204 nucleotides upstream (or 5') from the 3' splice site of a SETD5 RIC pre-mRNA comprising the retained intron 4.

In some embodiments, the ASO targets exon 5 or exon 6 of a SETD5 RIC pre-mRNA comprising a retained intron 5, wherein the intron numbering correspond to the mRNA sequence at NM_001292043. In some embodiments, the ASO targets an exon 5 sequence upstream (or 5') from the 5' splice site of a SETD5 RIC pre-mRNA comprising the retained intron 5. In some embodiments, the ASO targets an exon 5 sequence about 4 to about 89 nucleotides upstream (or 5') from the 5' splice site of a SETD5 RIC pre-mRNA comprising the retained intron 5. In some embodiments, the ASO targets an exon 6 sequence downstream (or 3') from the 3' splice site of a SETD5 RIC pre-mRNA comprising the retained intron 5. In some embodiments, the ASO targets an exon 6 sequence about 2 to about 132 nucleotides downstream (or 3') from the 3' splice site of a SETD5 RIC pre-mRNA comprising the retained intron 5.

In some embodiments, the ASO targets intron 5 in a SETD5 RIC pre-mRNA comprising a retained intron 5, wherein the intron numbering correspond to the mRNA sequence at NM_001292043. In some embodiments, the ASO targets an intron 5 sequence downstream (or 3') from the 5' splice site of a SETD5 RIC pre-mRNA comprising the retained intron 5. In some embodiments, the ASO targets an intron 5 sequence about 6 to about 204 nucleotides downstream (or 3') from the 5' splice site of a SETD5 RIC pre-mRNA comprising the retained intron 5. In some embodiments, the ASO targets an intron 5 sequence upstream (or 5') from the 3' splice site of a SETD5 RIC pre-mRNA comprising the retained intron 5. In some embodiments, the ASO targets an intron 5 sequence about 16 to about 204 nucleotides upstream (or 5') from the 3' splice site of a SETD5 RIC pre-mRNA comprising the retained intron 5.

In some embodiments, the ASOs disclosed herein target a RIC pre-mRNA transcribed from a EIF2B5 genomic sequence. In some embodiments, the ASO targets a RIC pre-mRNA transcript from a EIF2B5 genomic sequence comprising a retained intron. In some embodiments, the ASO targets a RIC pre-mRNA transcript of SEQ ID NO: 6278. In some embodiments, the ASO targets a RIC pre-mRNA transcript of SEQ ID NO: 6278 comprising a retained intron. In some embodiments, the ASOs disclosed herein target a EIF2B5 RIC pre-mRNA sequence. In some embodiments, the ASO targets a EIF2B5 RIC pre-mRNA transcript comprising a retained intron at 12, 13 or a combination thereof, wherein the intron numbering correspond to the mRNA sequence at NM_003907.

In some embodiments, the ASO targets a EIF2B5 RIC pre-mRNA sequence according to SEQ ID NO: 6302. In some embodiments, the ASO targets a EIF2B5 RIC pre-mRNA sequence according to SEQ ID NO: 6302 comprising a retained intron 12, a retained intron 13, or a combination thereof. In some embodiments, the ASOs disclosed herein target SEQ ID NOs: 30637 or 30649. In some embodiments, the ASO has a sequence according to any one of SEQ ID NOs: 10068-10305.

In some embodiments, the ASO targets exon 12 or exon 13 of a EIF2B5 RIC pre-mRNA comprising a retained intron 12, wherein the intron numbering correspond to the mRNA sequence at NM_003907. In some embodiments, the ASO targets an exon 12 sequence upstream (or 5') from the 5' splice site of a EIF2B5 RIC pre-mRNA comprising the retained intron 12. In some embodiments, the ASO targets an exon 12 sequence about 4 to about 74 nucleotides upstream (or 5') from the 5' splice site of a EIF2B5 RIC pre-mRNA comprising the retained intron 12. In some embodiments, the ASO targets an exon 13 sequence downstream (or 3') from the 3' splice site of a EIF2B5 RIC pre-mRNA comprising the retained intron 12. In some embodiments, the ASO targets an exon 13 sequence about 2 to about 105 nucleotides downstream (or 3') from the 3' splice site of a EIF2B5 RIC pre-mRNA comprising the retained intron 12.

In some embodiments, the ASO targets intron 12 in a EIF2B5 RIC pre-mRNA comprising a retained intron 12, wherein the intron numbering correspond to the mRNA sequence at NM_003907. In some embodiments, the ASO targets an intron 12 sequence downstream (or 3') from the 5' splice site of a EIF2B5 RIC pre-mRNA comprising the retained intron 12. In some embodiments, the ASO targets an intron 12 sequence about 6 to about 161 nucleotides downstream (or 3') from the 5' splice site of a EIF2B5 RIC pre-mRNA comprising the retained intron 12. In some embodiments, the ASO targets an intron 12 sequence upstream (or 5') from the 3' splice site of a EIF2B5 RIC pre-mRNA comprising the retained intron 12. In some embodiments, the ASO targets an intron 12 sequence about 16 to about 164 nucleotides upstream (or 5') from the 3' splice site of a EIF2B5 RIC pre-mRNA comprising the retained intron 12.

In some embodiments, the ASO targets exon 13 or exon 14 of a EIF2B5 RIC pre-mRNA comprising a retained intron 13, wherein the intron numbering correspond to the mRNA sequence at NM_003907. In some embodiments, the ASO targets an exon 13 sequence upstream (or 5') from the 5' splice site of a EIF2B5 RIC pre-mRNA comprising the retained intron 13. In some embodiments, the ASO targets an exon 13 sequence about 4 to about 104 nucleotides upstream (or 5') from the 5' splice site of a EIF2B5 RIC pre-mRNA comprising the retained intron 13. In some embodiments, the ASO targets an exon 14 sequence downstream (or 3') from the 3' splice site of a EIF2B5 RIC pre-mRNA comprising the retained intron 13. In some embodiments, the ASO targets an exon 14 sequence about 2 to about 107 nucleotides downstream (or 3') from the 3' splice site of a EIF2B5 RIC pre-mRNA comprising the retained intron 13.

In some embodiments, the ASO targets intron 13 in a EIF2B5 RIC pre-mRNA comprising a retained intron 13, wherein the intron numbering correspond to the mRNA sequence at NM_003907. In some embodiments, the ASO targets an intron 13 sequence downstream (or 3') from the 5' splice site of a EIF2B5 RIC pre-mRNA comprising the retained intron 13. In some embodiments, the ASO targets an intron 13 sequence about 6 to about 276 nucleotides downstream (or 3') from the 5' splice site of a EIF2B5 RIC pre-mRNA comprising the retained intron 13. In some embodiments, the ASO targets an intron 13 sequence upstream (or 5') from the 3' splice site of a EIF2B5 RIC pre-mRNA comprising the retained intron 13. In some embodiments, the ASO targets an intron 13 sequence about 16 to about 281 nucleotides upstream (or 5') from the 3' splice site of a EIF2B5 RIC pre-mRNA comprising the retained intron 13.

In some embodiments, the ASOs disclosed herein target a RIC pre-mRNA transcribed from a PEX1 genomic sequence. In some embodiments, the ASO targets a RIC pre-mRNA transcript from a PEX1 genomic sequence comprising a retained intron. In some embodiments, the ASO targets a RIC pre-mRNA transcript of SEQ ID NO: 6279. In some embodiments, the ASO targets a RIC pre-mRNA transcript of SEQ ID NO: 6279 comprising a retained intron. In some embodiments, the ASOs disclosed herein target a PEX1 RIC pre-mRNA sequence. In some embodiments, the ASO targets a PEX1 RIC pre-mRNA transcript comprising a retained intron at 10, 19, 21, 14 or a combination thereof, wherein the intron numbering correspond to the mRNA sequence at NM_000466. In some embodiments, the ASO targets a PEX1 RIC pre-mRNA transcript comprising a retained intron at 10, 18, 20, 13 or a combination thereof, wherein the intron numbering correspond to the mRNA sequence at NM_001282677. In some embodiments, the ASO targets a PEX1 RIC pre-mRNA transcript comprising a retained intron at 10, 19, 21, 14 or a combination thereof, wherein the intron numbering correspond to the mRNA sequence at NM_001282678.

In some embodiments, the ASO targets a PEX1 RIC pre-mRNA sequence according to SEQ ID NO: 6303. In some embodiments, the ASO targets a PEX1 RIC pre-mRNA sequence according to SEQ ID NO: 6303 comprising a retained intron 10, a retained intron 19, a retained intron 21, a retained intron 14, or a combination thereof. In some embodiments, the ASO targets a PEX1 RIC pre-mRNA sequence according to SEQ ID NO: 6304. In some embodiments, the ASO targets a PEX1 RIC pre-mRNA sequence according to SEQ ID NO: 6304 comprising a retained intron 10, a retained intron 18, a retained intron 20, a retained intron 13, or a combination thereof. In some embodiments, the ASO targets a PEX1 RIC pre-mRNA sequence according to SEQ ID NO: 6305. In some embodiments, the ASO targets a PEX1 RIC pre-mRNA sequence according to SEQ ID NO: 6305 comprising a retained intron 10, a retained intron 19, a retained intron 21, a retained intron 14, or a combination thereof. In some embodiments, the ASOs disclosed herein target SEQ ID NOs: 30629, 30653, 30643, or 30634. In some embodiments, the ASO has a sequence according to any one of SEQ ID NOs: 4033-641110306-12684.

In some embodiments, the ASO targets exon 10 or exon 11 of a PEX1 RIC pre-mRNA comprising a retained intron 10, wherein the intron numbering correspond to the mRNA sequence at NM_000466. In some embodiments, the ASO targets an exon 10 sequence upstream (or 5') from the 5' splice site of a PEX1 RIC pre-mRNA comprising the retained intron 10. In some embodiments, the ASO targets an exon 10 sequence about 4 to about 114 nucleotides upstream (or 5') from the 5' splice site of a PEX1 RIC pre-mRNA comprising the retained intron 10. In some embodiments, the ASO targets an exon 11 sequence downstream (or 3') from the 3' splice site of a PEX1 RIC pre-mRNA comprising the retained intron 10. In some embodiments, the ASO targets an exon 11 sequence about 2 to about 77 nucleotides downstream (or 3') from the 3' splice site of a PEX1 RIC pre-mRNA comprising the retained intron 10.

In some embodiments, the ASO targets intron 10 in a PEX1 RIC pre-mRNA comprising a retained intron 10, wherein the intron numbering correspond to the mRNA sequence at NM_000466. In some embodiments, the ASO targets an intron 10 sequence downstream (or 3') from the 5' splice site of a PEX1 RIC pre-mRNA comprising the retained intron 10. In some embodiments, the ASO targets an intron 10 sequence about 6 to about 336 nucleotides downstream (or 3') from the 5' splice site of a PEX1 RIC pre-mRNA comprising the retained intron 10. In some embodiments, the ASO targets an intron 10 sequence upstream (or 5') from the 3' splice site of a PEX1 RIC pre-mRNA comprising the retained intron 10. In some embodiments, the ASO targets an intron 10 sequence about 16 to about 336 nucleotides upstream (or 5') from the 3' splice site of a PEX1 RIC pre-mRNA comprising the retained intron 10.

In some embodiments, the ASO targets exon 19 or exon 20 of a PEX1 RIC pre-mRNA comprising a retained intron 19, wherein the intron numbering correspond to the mRNA sequence at NM_000466. In some embodiments, the ASO targets an exon 19 sequence upstream (or 5') from the 5' splice site of a PEX1 RIC pre-mRNA comprising the retained intron 19. In some embodiments, the ASO targets an exon 19 sequence about 4 to about 84 nucleotides upstream (or 5') from the 5' splice site of a PEX1 RIC pre-mRNA comprising the retained intron 19. In some embodiments, the ASO targets an exon 20 sequence downstream (or 3') from the 3' splice site of a PEX1 RIC pre-mRNA comprising the retained intron 19. In some embodiments, the ASO targets an exon 20 sequence about 2 to about 157 nucleotides downstream (or 3') from the 3' splice site of a PEX1 RIC pre-mRNA comprising the retained intron 19.

In some embodiments, the ASO targets intron 19 in a PEX1 RIC pre-mRNA comprising a retained intron 19, wherein the intron numbering correspond to the mRNA sequence at NM_000466. In some embodiments, the ASO targets an intron 19 sequence downstream (or 3') from the 5' splice site of a PEX1 RIC pre-mRNA comprising the retained intron 19. In some embodiments, the ASO targets an intron 19 sequence about 6 to about 496 nucleotides downstream (or 3') from the 5' splice site of a PEX1 RIC pre-mRNA comprising the retained intron 19. In some embodiments, the ASO targets an intron 19 sequence upstream (or 5') from the 3' splice site of a PEX1 RIC pre-mRNA comprising the retained intron 19. In some embodiments, the ASO targets an intron 19 sequence about 16 to about 496 nucleotides upstream (or 5') from the 3' splice site of a PEX1 RIC pre-mRNA comprising the retained intron 19.

In some embodiments, the ASO targets exon 21 or exon 22 of a PEX1 RIC pre-mRNA comprising a retained intron 21, wherein the intron numbering correspond to the mRNA sequence at NM_000466. In some embodiments, the ASO targets an exon 21 sequence upstream (or 5') from the 5' splice site of a PEX1 RIC pre-mRNA comprising the retained intron 21. In some embodiments, the ASO targets an exon 21 sequence about 4 to about 214 nucleotides upstream (or 5') from the 5' splice site of a PEX1 RIC pre-mRNA comprising the retained intron 21. In some embodiments, the ASO targets an exon 22 sequence downstream (or 3') from the 3' splice site of a PEX1 RIC pre-mRNA comprising the retained intron 21. In some embodiments, the ASO targets an exon 22 sequence about 2 to about 177 nucleotides downstream (or 3') from the 3' splice site of a PEX1 RIC pre-mRNA comprising the retained intron 21.

In some embodiments, the ASO targets intron 21 in a PEX1 RIC pre-mRNA comprising a retained intron 21, wherein the intron numbering correspond to the mRNA sequence at NM_000466. In some embodiments, the ASO targets an intron 21 sequence downstream (or 3') from the 5' splice site of a PEX1 RIC pre-mRNA comprising the retained intron 21. In some embodiments, the ASO targets an intron 21 sequence about 6 to about 496 nucleotides downstream (or 3') from the 5' splice site of a PEX1 RIC pre-mRNA comprising the retained intron 21. In some embodiments, the ASO targets an intron 21 sequence upstream (or 5') from the 3' splice site of a PEX1 RIC pre-mRNA comprising the retained intron 21. In some embodiments, the ASO targets an intron 21 sequence about 16 to about 497 nucleotides upstream (or 5') from the 3' splice site of a PEX1 RIC pre-mRNA comprising the retained intron 21.

In some embodiments, the ASO targets exon 14 or exon 15 of a PEX1 RIC pre-mRNA comprising a retained intron 14, wherein the intron numbering correspond to the mRNA sequence at NM_000466. In some embodiments, the ASO targets an exon 14 sequence upstream (or 5') from the 5' splice site of a PEX1 RIC pre-mRNA comprising the retained intron 14. In some embodiments, the ASO targets an exon 14 sequence about 4 to about 169 nucleotides upstream (or 5') from the 5' splice site of a PEX1 RIC pre-mRNA comprising the retained intron 14. In some embodiments, the ASO targets an exon 15 sequence downstream (or 3') from the 3' splice site of a PEX1 RIC pre-mRNA comprising the retained intron 14. In some embodiments, the ASO targets an exon 15 sequence about 2 to about 147 nucleotides downstream (or 3') from the 3' splice site of a PEX1 RIC pre-mRNA comprising the retained intron 14.

In some embodiments, the ASO targets intron 14 in a PEX1 RIC pre-mRNA comprising a retained intron 14, wherein the intron numbering correspond to the mRNA sequence at NM_000466. In some embodiments, the ASO targets an intron 14 sequence downstream (or 3') from the 5' splice site of a PEX1 RIC pre-mRNA comprising the retained intron 14. In some embodiments, the ASO targets an intron 14 sequence about 6 to about 121 nucleotides downstream (or 3') from the 5' splice site of a PEX1 RIC pre-mRNA comprising the retained intron 14. In some embodiments, the ASO targets an intron 14 sequence upstream (or 5') from the 3' splice site of a PEX1 RIC pre-mRNA comprising the retained intron 14. In some embodiments, the ASO targets an intron 14 sequence about 16 to about 121 nucleotides upstream (or 5') from the 3' splice site of a PEX1 RIC pre-mRNA comprising the retained intron 14.

In some embodiments, the ASO targets exon 10 or exon 11 of a PEX1 RIC pre-mRNA comprising a retained intron 10, wherein the intron numbering correspond to the mRNA sequence at NM_001282677. In some embodiments, the ASO targets an exon 10 sequence upstream (or 5') from the 5' splice site of a PEX1 RIC pre-mRNA comprising the retained intron 10. In some embodiments, the ASO targets an exon 10 sequence about 4 to about 114 nucleotides upstream (or 5') from the 5' splice site of a PEX1 RIC pre-mRNA comprising the retained intron 10. In some embodiments, the ASO targets an exon 11 sequence downstream (or 3') from the 3' splice site of a PEX1 RIC pre-mRNA comprising the retained intron 10. In some embodiments, the ASO targets an exon 11 sequence about 2 to about 77 nucleotides downstream (or 3') from the 3' splice site of a PEX1 RIC pre-mRNA comprising the retained intron 10.

In some embodiments, the ASO targets intron 10 in a PEX1 RIC pre-mRNA comprising a retained intron 10, wherein the intron numbering correspond to the mRNA sequence at NM_001282677. In some embodiments, the ASO targets an intron 10 sequence downstream (or 3') from the 5' splice site of a PEX1 RIC pre-mRNA comprising the retained intron 10. In some embodiments, the ASO targets an intron 10 sequence about 6 to about 336 nucleotides downstream (or 3') from the 5' splice site of a PEX1 RIC pre-mRNA comprising the retained intron 10. In some embodiments, the ASO targets an intron 10 sequence upstream (or 5') from the 3' splice site of a PEX1 RIC pre-mRNA comprising the retained intron 10. In some embodiments, the ASO targets an intron 10 sequence about 16 to about 336 nucleotides upstream (or 5') from the 3' splice site of a PEX1 RIC pre-mRNA comprising the retained intron 10.

In some embodiments, the ASO targets exon 18 or exon 19 of a PEX1 RIC pre-mRNA comprising a retained intron 18, wherein the intron numbering correspond to the mRNA sequence at NM_001282677. In some embodiments, the ASO targets an exon 18 sequence upstream (or 5') from the 5' splice site of a PEX1 RIC pre-mRNA comprising the retained intron 18. In some embodiments, the ASO targets an exon 18 sequence about 4 to about 84 nucleotides upstream (or 5') from the 5' splice site of a PEX1 RIC pre-mRNA comprising the retained intron 18. In some embodiments, the ASO targets an exon 19 sequence downstream (or 3') from the 3' splice site of a PEX1 RIC pre-mRNA comprising the retained intron 18. In some embodiments, the ASO targets an exon 19 sequence about 2 to about 157 nucleotides downstream (or 3') from the 3' splice site of a PEX1 RIC pre-mRNA comprising the retained intron 18.

In some embodiments, the ASO targets intron 18 in a PEX1 RIC pre-mRNA comprising a retained intron 18, wherein the intron numbering correspond to the mRNA sequence at NM_001282677. In some embodiments, the ASO targets an intron 18 sequence downstream (or 3') from the 5' splice site of a PEX1 RIC pre-mRNA comprising the retained intron 18. In some embodiments, the ASO targets an intron 18 sequence about 6 to about 496 nucleotides downstream (or 3') from the 5' splice site of a PEX1 RIC pre-mRNA comprising the retained intron 18. In some embodiments, the ASO targets an intron 18 sequence upstream (or 5') from the 3' splice site of a PEX1 RIC pre-mRNA comprising the retained intron 18. In some embodiments, the ASO targets an intron 18 sequence about 16 to about 496 nucleotides upstream (or 5') from the 3' splice site of a PEX1 RIC pre-mRNA comprising the retained intron 18.

In some embodiments, the ASO targets exon 20 or exon 21 of a PEX1 RIC pre-mRNA comprising a retained intron 20, wherein the intron numbering correspond to the mRNA sequence at NM_001282677. In some embodiments, the ASO targets an exon 20 sequence upstream (or 5') from the 5' splice site of a PEX1 RIC pre-mRNA comprising the retained intron 20. In some embodiments, the ASO targets an exon 20 sequence about 4 to about 214 nucleotides upstream (or 5') from the 5' splice site of a PEX1 RIC pre-mRNA comprising the retained intron 20. In some embodiments, the ASO targets an exon 21 sequence downstream (or 3') from the 3' splice site of a PEX1 RIC pre-mRNA comprising the retained intron 20. In some embodiments, the ASO targets an exon 21 sequence about 2 to about 177 nucleotides downstream (or 3') from the 3' splice site of a PEX1 RIC pre-mRNA comprising the retained intron 20.

In some embodiments, the ASO targets intron 20 in a PEX1 RIC pre-mRNA comprising a retained intron 20, wherein the intron numbering correspond to the mRNA sequence at NM_001282677. In some embodiments, the ASO targets an intron 20 sequence downstream (or 3') from the 5' splice site of a PEX1 RIC pre-mRNA comprising the retained intron 20. In some embodiments, the ASO targets an intron 20 sequence about 6 to about 496 nucleotides downstream (or 3') from the 5' splice site of a PEX1 RIC pre-mRNA comprising the retained intron 20. In some embodiments, the ASO targets an intron 20 sequence upstream (or 5') from the 3' splice site of a PEX1 RIC pre-mRNA comprising the retained intron 20. In some embodiments, the ASO targets an intron 20 sequence about 16 to about 497 nucleotides upstream (or 5') from the 3' splice site of a PEX1 RIC pre-mRNA comprising the retained intron 20.

In some embodiments, the ASO targets exon 13 or exon 14 of a PEX1 RIC pre-mRNA comprising a retained intron 13, wherein the intron numbering correspond to the mRNA sequence at NM_001282677. In some embodiments, the ASO targets an exon 13 sequence upstream (or 5') from the 5' splice site of a PEX1 RIC pre-mRNA comprising the retained intron 13. In some embodiments, the ASO targets an exon 13 sequence about 4 to about 169 nucleotides upstream (or 5') from the 5' splice site of a PEX1 RIC pre-mRNA comprising the retained intron 13. In some embodiments, the ASO targets an exon 14 sequence downstream (or 3') from the 3' splice site of a PEX1 RIC pre-mRNA comprising the retained intron 13. In some embodiments, the ASO targets an exon 14 sequence about 2 to about 147 nucleotides downstream (or 3') from the 3' splice site of a PEX1 RIC pre-mRNA comprising the retained intron 13.

In some embodiments, the ASO targets intron 13 in a PEX1 RIC pre-mRNA comprising a retained intron 13, wherein the intron numbering correspond to the mRNA sequence at NM_001282677. In some embodiments, the ASO targets an intron 13 sequence downstream (or 3') from the 5' splice site of a PEX1 RIC pre-mRNA comprising the retained intron 13. In some embodiments, the ASO targets an intron 13 sequence about 6 to about 121 nucleotides downstream (or 3') from the 5' splice site of a PEX1 RIC pre-mRNA comprising the retained intron 13. In some embodiments, the ASO targets an intron 13 sequence upstream (or 5') from the 3' splice site of a PEX1 RIC pre-mRNA comprising the retained intron 13. In some embodiments, the ASO targets an intron 13 sequence about 16 to about 121 nucleotides upstream (or 5') from the 3' splice site of a PEX1 RIC pre-mRNA comprising the retained intron 13.

In some embodiments, the ASO targets exon 10 or exon 11 of a PEX1 RIC pre-mRNA comprising a retained intron 10, wherein the intron numbering correspond to the mRNA sequence at NM_001282678. In some embodiments, the ASO targets an exon 10 sequence upstream (or 5') from the 5' splice site of a PEX1 RIC pre-mRNA comprising the retained intron 10. In some embodiments, the ASO targets an exon 10 sequence about 4 to about 114 nucleotides upstream (or 5') from the 5' splice site of a PEX1 RIC pre-mRNA comprising the retained intron 10. In some embodiments, the ASO targets an exon 11 sequence downstream (or 3') from the 3' splice site of a PEX1 RIC pre-mRNA comprising the retained intron 10. In some embodiments, the ASO targets an exon 11 sequence about 2 to about 77 nucleotides downstream (or 3') from the 3' splice site of a PEX1 RIC pre-mRNA comprising the retained intron 10.

In some embodiments, the ASO targets intron 10 in a PEX1 RIC pre-mRNA comprising a retained intron 10, wherein the intron numbering correspond to the mRNA sequence at NM_001282678. In some embodiments, the ASO targets an intron 10 sequence downstream (or 3') from the 5' splice site of a PEX1 RIC pre-mRNA comprising the retained intron 10. In some embodiments, the ASO targets an intron 10 sequence about 6 to about 336 nucleotides downstream (or 3') from the 5' splice site of a PEX1 RIC pre-mRNA comprising the retained intron 10. In some embodiments, the ASO targets an intron 10 sequence upstream (or 5') from the 3' splice site of a PEX1 RIC pre-mRNA comprising the retained intron 10. In some embodiments, the ASO targets an intron 10 sequence about 16 to about 336 nucleotides upstream (or 5') from the 3' splice site of a PEX1 RIC pre-mRNA comprising the retained intron 10.

In some embodiments, the ASO targets exon 19 or exon 20 of a PEX1 RIC pre-mRNA comprising a retained intron 19, wherein the intron numbering correspond to the mRNA sequence at NM_001282678. In some embodiments, the ASO targets an exon 19 sequence upstream (or 5') from the 5' splice site of a PEX1 RIC pre-mRNA comprising the retained intron 19. In some embodiments, the ASO targets an exon 19 sequence about 4 to about 84 nucleotides upstream (or 5') from the 5' splice site of a PEX1 RIC pre-mRNA comprising the retained intron 19. In some embodiments, the ASO targets an exon 20 sequence downstream (or 3') from the 3' splice site of a PEX1 RIC pre-mRNA comprising the retained intron 19. In some embodiments, the ASO targets an exon 20 sequence about 2 to about 157 nucleotides downstream (or 3') from the 3' splice site of a PEX1 RIC pre-mRNA comprising the retained intron 19.

In some embodiments, the ASO targets intron 19 in a PEX1 RIC pre-mRNA comprising a retained intron 19, wherein the intron numbering correspond to the mRNA sequence at NM_001282678. In some embodiments, the ASO targets an intron 19 sequence downstream (or 3') from the 5' splice site of a PEX1 RIC pre-mRNA comprising the retained intron 19. In some embodiments, the ASO targets an intron 19 sequence about 6 to about 496 nucleotides downstream (or 3') from the 5' splice site of a PEX1 RIC pre-mRNA comprising the retained intron 19. In some embodiments, the ASO targets an intron 19 sequence upstream (or 5') from the 3' splice site of a PEX1 RIC pre-mRNA comprising the retained intron 19. In some embodiments, the ASO targets an intron 19 sequence about 16 to about 496 nucleotides upstream (or 5') from the 3' splice site of a PEX1 RIC pre-mRNA comprising the retained intron 19.

In some embodiments, the ASO targets exon 21 or exon 22 of a PEX1 RIC pre-mRNA comprising a retained intron 21, wherein the intron numbering correspond to the mRNA sequence at NM_001282678. In some embodiments, the ASO targets an exon 21 sequence upstream (or 5') from the 5' splice site of a PEX1 RIC pre-mRNA comprising the retained intron 21. In some embodiments, the ASO targets an exon 21 sequence about 4 to about 214 nucleotides upstream (or 5') from the 5' splice site of a PEX1 RIC pre-mRNA comprising the retained intron 21. In some embodiments, the ASO targets an exon 22 sequence downstream (or 3') from the 3' splice site of a PEX1 RIC pre-mRNA comprising the retained intron 21. In some embodiments, the ASO targets an exon 22 sequence about 2 to about 177 nucleotides downstream (or 3') from the 3' splice site of a PEX1 RIC pre-mRNA comprising the retained intron 21.

In some embodiments, the ASO targets intron 21 in a PEX1 RIC pre-mRNA comprising a retained intron 21, wherein the intron numbering correspond to the mRNA sequence at NM_001282678. In some embodiments, the ASO targets an intron 21 sequence downstream (or 3') from the 5' splice site of a PEX1 RIC pre-mRNA comprising the retained intron 21. In some embodiments, the ASO targets an intron 21 sequence about 6 to about 496 nucleotides downstream (or 3') from the 5' splice site of a PEX1 RIC pre-mRNA comprising the retained intron 21. In some embodiments, the ASO targets an intron 21 sequence upstream (or 5') from the 3' splice site of a PEX1 RIC pre-mRNA comprising the retained intron 21. In some embodiments, the ASO targets an intron 21 sequence about 16 to about 497 nucleotides upstream (or 5') from the 3' splice site of a PEX1 RIC pre-mRNA comprising the retained intron 21.

In some embodiments, the ASO targets exon 14 or exon 15 of a PEX1 RIC pre-mRNA comprising a retained intron 14, wherein the intron numbering correspond to the mRNA sequence at NM_001282678. In some embodiments, the ASO targets an exon 14 sequence upstream (or 5') from the 5' splice site of a PEX1 RIC pre-mRNA comprising the retained intron 14. In some embodiments, the ASO targets an exon 14 sequence about 4 to about 169 nucleotides upstream (or 5') from the 5' splice site of a PEX1 RIC pre-mRNA comprising the retained intron 14. In some embodiments, the ASO targets an exon 15 sequence downstream (or 3') from the 3' splice site of a PEX1 RIC pre-mRNA comprising the retained intron 14. In some embodiments, the ASO targets an exon 15 sequence about 2 to about 147 nucleotides downstream (or 3') from the 3' splice site of a PEX1 RIC pre-mRNA comprising the retained intron 14.

In some embodiments, the ASO targets intron 14 in a PEX1 RIC pre-mRNA comprising a retained intron 14, wherein the intron numbering correspond to the mRNA sequence at NM_001282678. In some embodiments, the ASO targets an intron 14 sequence downstream (or 3') from the 5' splice site of a PEX1 RIC pre-mRNA comprising the retained intron 14. In some embodiments, the ASO targets an intron 14 sequence about 6 to about 121 nucleotides downstream (or 3') from the 5' splice site of a PEX1 RIC pre-mRNA comprising the retained intron 14. In some embodiments, the ASO targets an intron 14 sequence upstream (or 5') from the 3' splice site of a PEX1 RIC pre-mRNA comprising the retained intron 14. In some embodiments, the ASO targets an intron 14 sequence about 16 to about 121 nucleotides upstream (or 5') from the 3' splice site of a PEX1 RIC pre-mRNA comprising the retained intron 14.

In some embodiments, the ASOs disclosed herein target a RIC pre-mRNA transcribed from a STXBP1 genomic sequence. In some embodiments, the ASO targets a RIC pre-mRNA transcript from a STXBP1 genomic sequence comprising a retained intron. In some embodiments, the ASO targets a RIC pre-mRNA transcript of SEQ ID NO: 6280. In some embodiments, the ASO targets a RIC pre-mRNA transcript of SEQ ID NO: 6280 comprising a retained intron. In some embodiments, the ASOs disclosed herein target a STXBP1 RIC pre-mRNA sequence. In some embodiments, the ASO targets a STXBP1 RIC pre-mRNA transcript comprising a retained intron at 18, 19 or a combination thereof, wherein the intron numbering correspond to the mRNA sequence at NM_003165. In some embodiments, the ASO targets a STXBP1 RIC pre-mRNA transcript comprising a retained intron at 18, wherein the intron numbering correspond to the mRNA sequence at NM_001032221.

In some embodiments, the ASO targets a STXBP1 RIC pre-mRNA sequence according to SEQ ID NO: 6306. In some embodiments, the ASO targets a STXBP1 RIC pre-mRNA sequence according to SEQ ID NO: 6306 comprising a retained intron 18, a retained intron 19, or a combination thereof. In some embodiments, the ASO targets a STXBP1 RIC pre-mRNA sequence according to SEQ ID NO: 6307. In some embodiments, the ASO targets a STXBP1 RIC pre-mRNA sequence according to SEQ ID NO: 6307 comprising a retained intron 18. In some embodiments, the ASOs disclosed herein target SEQ ID NOs: 30627, 30624, or 30633. In some embodiments, the ASO has a sequence according to any one of SEQ ID NOs: 12685-14026.

In some embodiments, the ASO targets exon 18 or exon 19 of a STXBP1 RIC pre-mRNA comprising a retained intron 18, wherein the intron numbering correspond to the mRNA sequence at NM_003165. In some embodiments, the ASO targets an exon 18 sequence upstream (or 5') from the 5' splice site of a STXBP1 RIC pre-mRNA comprising the retained intron 18. In some embodiments, the ASO targets an exon 18 sequence about 4 to about 136 nucleotides upstream (or 5') from the 5' splice site of a STXBP1 RIC pre-mRNA comprising the retained intron 18. In some embodiments, the ASO targets an exon 19 sequence downstream (or 3') from the 3' splice site of a STXBP1 RIC pre-mRNA comprising the retained intron 18. In some embodiments, the ASO targets an exon 19 sequence about 2 to about 106 nucleotides downstream (or 3') from the 3' splice site of a STXBP1 RIC pre-mRNA comprising the retained intron 18.

In some embodiments, the ASO targets intron 18 in a STXBP1 RIC pre-mRNA comprising a retained intron 18, wherein the intron numbering correspond to the mRNA sequence at NM_003165. In some embodiments, the ASO targets an intron 18 sequence downstream (or 3') from the 5' splice site of a STXBP1 RIC pre-mRNA comprising the retained intron 18. In some embodiments, the ASO targets an intron 18 sequence about 6 to about 496 nucleotides downstream (or 3') from the 5' splice site of a STXBP1 RIC pre-mRNA comprising the retained intron 18. In some embodiments, the ASO targets an intron 18 sequence upstream (or 5') from the 3' splice site of a STXBP1 RIC pre-mRNA comprising the retained intron 18. In some embodiments, the ASO targets an intron 18 sequence about 16 to about 498 nucleotides upstream (or 5') from the 3' splice site of a STXBP1 RIC pre-mRNA comprising the retained intron 18.

In some embodiments, the ASO targets exon 19 or exon 20 of a STXBP1 RIC pre-mRNA comprising a retained intron 19, wherein the intron numbering correspond to the mRNA sequence at NM_003165. In some embodiments, the ASO targets an exon 19 sequence upstream (or 5') from the 5' splice site of a STXBP1 RIC pre-mRNA comprising the retained intron 19. In some embodiments, the ASO targets an exon 19 sequence about 4 to about 109 nucleotides upstream (or 5') from the 5' splice site of a STXBP1 RIC pre-mRNA comprising the retained intron 19. In some embodiments, the ASO targets an exon 20 sequence downstream (or 3') from the 3' splice site of a STXBP1 RIC pre-mRNA comprising the retained intron 19. In some embodiments, the ASO targets an exon 20 sequence about 2 to about 1922 nucleotides downstream (or 3') from the 3' splice site of a STXBP1 RIC pre-mRNA comprising the retained intron 19.

In some embodiments, the ASO targets intron 19 in a STXBP1 RIC pre-mRNA comprising a retained intron 19, wherein the intron numbering correspond to the mRNA sequence at NM_003165. In some embodiments, the ASO targets an intron 19 sequence downstream (or 3') from the 5' splice site of a STXBP1 RIC pre-mRNA comprising the retained intron 19. In some embodiments, the ASO targets an intron 19 sequence about 6 to about 499 nucleotides downstream (or 3') from the 5' splice site of a STXBP1 RIC pre-mRNA comprising the retained intron 19. In some embodiments, the ASO targets an intron 19 sequence upstream (or 5') from the 3' splice site of a STXBP1 RIC pre-mRNA comprising the retained intron 19. In some embodiments, the ASO targets an intron 19 sequence about 16 to about 500 nucleotides upstream (or 5') from the 3' splice site of a STXBP1 RIC pre-mRNA comprising the retained intron 19.

In some embodiments, the ASO targets exon 18 or exon 19 of a STXBP1 RIC pre-mRNA comprising a retained intron 18, wherein the intron numbering correspond to the mRNA sequence at NM_001032221. In some embodiments, the ASO targets an exon 18 sequence upstream (or 5') from the 5' splice site of a STXBP1 RIC pre-mRNA comprising the retained intron 18. In some embodiments, the ASO targets an exon 18 sequence about 4 to about 136 nucleotides upstream (or 5') from the 5' splice site of a STXBP1 RIC pre-mRNA comprising the retained intron 18. In some embodiments, the ASO targets an exon 19 sequence downstream (or 3') from the 3' splice site of a STXBP1 RIC pre-mRNA comprising the retained intron 18. In some embodiments, the ASO targets an exon 19 sequence about 2 to about 1922 nucleotides downstream (or 3') from the 3' splice site of a STXBP1 RIC pre-mRNA comprising the retained intron 18.

In some embodiments, the ASO targets intron 18 in a STXBP1 RIC pre-mRNA comprising a retained intron 18, wherein the intron numbering correspond to the mRNA sequence at NM_001032221. In some embodiments, the ASO targets an intron 18 sequence downstream (or 3') from the 5' splice site of a STXBP1 RIC pre-mRNA comprising the retained intron 18. In some embodiments, the ASO targets an intron 18 sequence about 6 to about 496 nucleotides downstream (or 3') from the 5' splice site of a STXBP1 RIC pre-mRNA comprising the retained intron 18. In some embodiments, the ASO targets an intron 18 sequence upstream (or 5') from the 3' splice site of a STXBP1 RIC pre-mRNA comprising the retained intron 18. In some embodiments, the ASO targets an intron 18 sequence about 16 to about 500 nucleotides upstream (or 5') from the 3' splice site of a STXBP1 RIC pre-mRNA comprising the retained intron 18.

In some embodiments, the ASOs disclosed herein target a RIC pre-mRNA transcribed from a EIF2B1 genomic sequence. In some embodiments, the ASO targets a RIC pre-mRNA transcript from a EIF2B1 genomic sequence comprising a retained intron. In some embodiments, the ASO targets a RIC pre-mRNA transcript of SEQ ID NO: 6281. In some embodiments, the ASO targets a RIC pre-mRNA transcript of SEQ ID NO: 6281 comprising a retained intron. In some embodiments, the ASOs disclosed herein target a EIF2B1 RIC pre-mRNA sequence. In some embodiments, the ASO targets a EIF2B1 RIC pre-mRNA transcript comprising a retained intron at 6, wherein the intron numbering correspond to the mRNA sequence at NM_001414.

In some embodiments, the ASO targets a EIF2B1 RIC pre-mRNA sequence according to SEQ ID NO: 6380. In some embodiments, the ASO targets a EIF2B1 RIC pre-mRNA sequence according to SEQ ID NO: 6380 comprising a retained intron 6. In some embodiments, the ASOs disclosed herein target SEQ ID NO: 30626. In some embodiments, the ASO has a sequence according to any one of SEQ ID NOs: 14027-14237.

In some embodiments, the ASO targets exon 6 or exon 7 of a EIF2B1 RIC pre-mRNA comprising a retained intron 6, wherein the intron numbering correspond to the mRNA sequence at NM_001414. In some embodiments, the ASO targets an exon 6 sequence upstream (or 5') from the 5' splice site of a EIF2B1 RIC pre-mRNA comprising the retained intron 6. In some embodiments, the ASO targets an exon 6 sequence about 4 to about 49 nucleotides upstream (or 5') from the 5' splice site of a EIF2B1 RIC pre-mRNA comprising the retained intron 6. In some embodiments, the ASO targets an exon 7 sequence downstream (or 3') from the 3' splice site of a EIF2B1 RIC pre-mRNA comprising the retained intron 6. In some embodiments, the ASO targets an exon 7 sequence about 2 to about 57 nucleotides downstream (or 3') from the 3' splice site of a EIF2B1 RIC pre-mRNA comprising the retained intron 6.

In some embodiments, the ASO targets intron 6 in a EIF2B1 RIC pre-mRNA comprising a retained intron 6, wherein the intron numbering correspond to the mRNA sequence at NM_001414. In some embodiments, the ASO targets an intron 6 sequence downstream (or 3') from the 5' splice site of a EIF2B1 RIC pre-mRNA comprising the retained intron 6. In some embodiments, the ASO targets an intron 6 sequence about 19 to about 496 nucleotides downstream (or 3') from the 5' splice site of a EIF2B1 RIC pre-mRNA comprising the retained intron 6. In some embodiments, the ASO targets an intron 6 sequence upstream (or 5') from the 3' splice site of a EIF2B1 RIC pre-mRNA comprising the retained intron 6. In some embodiments, the ASO targets an intron 6 sequence about 16 to about 498 nucleotides upstream (or 5') from the 3' splice site of a EIF2B1 RIC pre-mRNA comprising the retained intron 6.

In some embodiments, the ASOs disclosed herein target a RIC pre-mRNA transcribed from a EIF2B2 genomic sequence. In some embodiments, the ASO targets a RIC pre-mRNA transcript from a EIF2B2 genomic sequence comprising a retained intron. In some embodiments, the ASO targets a RIC pre-mRNA transcript of SEQ ID NO: 6282. In some embodiments, the ASO targets a RIC pre-mRNA transcript of SEQ ID NO: 6282 comprising a retained intron. In some embodiments, the ASOs disclosed herein target a EIF2B2 RIC pre-mRNA sequence. In some embodiments, the ASO targets a EIF2B2 RIC pre-mRNA transcript comprising a retained intron at 1, wherein the intron numbering correspond to the mRNA sequence at NM_014239.

In some embodiments, the ASO targets a EIF2B2 RIC pre-mRNA sequence according to SEQ ID NO: 6309. In some embodiments, the ASO targets a EIF2B2 RIC pre-mRNA sequence according to SEQ ID NO: 6309 comprising a retained intron 1. In some embodiments, the ASOs disclosed herein target SEQ ID NO: 30631. In some embodiments, the ASO has a sequence according to any one of SEQ ID NOs: 14238-14326.

In some embodiments, the ASO targets exon 1 or exon 2 of a EIF2B2 RIC pre-mRNA comprising a retained intron 1, wherein the intron numbering correspond to the mRNA sequence at NM_014239. In some embodiments, the ASO targets an exon 1 sequence upstream (or 5') from the 5' splice site of a EIF2B2 RIC pre-mRNA comprising the retained intron 1. In some embodiments, the ASO targets an exon 1 sequence about 4 to about 219 nucleotides upstream (or 5') from the 5' splice site of a EIF2B2 RIC pre-mRNA comprising the retained intron 1. In some embodiments, the ASO targets an exon 2 sequence downstream (or 3') from the 3' splice site of a EIF2B2 RIC pre-mRNA comprising the retained intron 1. In some embodiments, the ASO targets an exon 2 sequence about 2 to about 102 nucleotides downstream (or 3') from the 3' splice site of a EIF2B2 RIC pre-mRNA comprising the retained intron 1.

In some embodiments, the ASO targets intron 1 in a EIF2B2 RIC pre-mRNA comprising a retained intron 1, wherein the intron numbering correspond to the mRNA sequence at NM_014239. In some embodiments, the ASO targets an intron 1 sequence downstream (or 3') from the 5' splice site of a EIF2B2 RIC pre-mRNA comprising the retained intron 1. In some embodiments, the ASO targets an intron 1 sequence about 6 to about 70 nucleotides downstream (or 3') from the 5' splice site of a EIF2B2 RIC pre-mRNA comprising the retained intron 1. In some embodiments, the ASO targets an intron 1 sequence upstream (or 5') from the 3' splice site of a EIF2B2 RIC pre-mRNA comprising the retained intron 1. In some embodiments, the ASO targets an intron 1 sequence about 16 to about 70 nucleotides upstream (or 5') from the 3' splice site of a EIF2B2 RIC pre-mRNA comprising the retained intron 1.

In some embodiments, the ASOs disclosed herein target a RIC pre-mRNA transcribed from a PRRT2 genomic sequence. In some embodiments, the ASO targets a RIC pre-mRNA transcript from a PRRT2 genomic sequence comprising a retained intron. In some embodiments, the ASO targets a RIC pre-mRNA transcript of SEQ ID NO: 6283. In some embodiments, the ASO targets a RIC pre-mRNA transcript of SEQ ID NO: 6283 comprising a retained intron. In some embodiments, the ASOs disclosed herein target aPRRT2 RIC pre-mRNA sequence. In some embodiments, the ASO targets aPRRT2 RIC pre-mRNA transcript comprising a retained intron at 1, wherein the intron numbering correspond to the mRNA sequence at NM_001256443. In some embodiments, the ASO targets a PRRT2 RIC pre-mRNA transcript comprising a retained intron at 1, wherein the intron numbering correspond to the mRNA sequence at NM_145239. In some embodiments, the ASO targets a PRRT2 RIC pre-mRNA transcript comprising a retained intron at 1, wherein the intron numbering correspond to the mRNA sequence at NM_001256442.

In some embodiments, the ASO targets a PRRT2 RIC pre-mRNA sequence according to SEQ ID NO: 6310. In some embodiments, the ASO targets a PRRT2 RIC pre-mRNA sequence according to SEQ ID NO: 6310 comprising a retained intron 1. In some embodiments, the ASO targets a PRRT2 RIC pre-mRNA sequence according to SEQ ID NO: 38. In some embodiments, the ASO targets a PRRT2 RIC pre-mRNA sequence according to SEQ ID NO: 6311 comprising a retained intron 1. In some embodiments, the ASO targets a PRRT2 RIC pre-mRNA sequence according to SEQ ID NO: 6312. In some embodiments, the ASO targets a PRRT2 RIC pre-mRNA sequence according to SEQ ID NO: 6313 comprising a retained intron 1. In some embodiments, the ASOs disclosed herein target SEQ ID NOs: 30642 or 30638. In some embodiments, the ASO has a sequence according to any one of SEQ ID NOs: 14327-15605.

In some embodiments, the ASO targets exon 1 or exon 2 of a PRRT2 RIC pre-mRNA comprising a retained intron 1, wherein the intron numbering correspond to the mRNA sequence at NM_001256443. In some embodiments, the ASO targets an exon 1 sequence upstream (or 5') from the 5' splice site of a PRRT2 RIC pre-mRNA comprising the retained intron 1. In some embodiments, the ASO targets an exon 1 sequence about 4 to about 244 nucleotides upstream (or 5') from the 5' splice site of a PRRT2 RIC pre-mRNA comprising the retained intron 1. In some embodiments, the ASO targets an exon 2 sequence downstream (or 3') from the 3' splice site of a PRRT2 RIC pre-mRNA comprising the retained intron 1. In some embodiments, the ASO targets an exon 2 sequence about 2 to about 2875 nucleotides downstream (or 3') from the 3' splice site of a PRRT2 RIC pre-mRNA comprising the retained intron 1.

In some embodiments, the ASO targets intron 1 in a PRRT2 RIC pre-mRNA comprising a retained intron 1, wherein the intron numbering correspond to the mRNA sequence at NM_001256443. In some embodiments, the ASO targets an intron 1 sequence downstream (or 3') from the 5' splice site of a PRRT2 RIC pre-mRNA comprising the retained intron 1. In some embodiments, the ASO targets an intron 1 sequence about 6 to about 333 nucleotides downstream (or 3') from the 5' splice site of a PRRT2 RIC pre-mRNA comprising the retained intron 1. In some embodiments, the ASO targets an intron 1 sequence upstream (or 5') from the 3' splice site of a PRRT2 RIC pre-mRNA comprising the retained intron 1. In some embodiments, the ASO targets an intron 1 sequence about 16 to about 330 or about 26 to about 330 nucleotides upstream (or 5') from the 3' splice site of a PRRT2 RIC pre-mRNA comprising the retained intron 1.

In some embodiments, the ASO targets exon 1 or exon 2 of a PRRT2 RIC pre-mRNA comprising a retained intron 1, wherein the intron numbering correspond to the mRNA sequence at NM_145239. In some embodiments, the ASO targets an exon 1 sequence upstream (or 5') from the 5' splice site of a PRRT2 RIC pre-mRNA comprising the retained intron 1. In some embodiments, the ASO targets an exon 1 sequence about 4 to about 219 nucleotides upstream (or 5') from the 5' splice site of a PRRT2 RIC pre-mRNA comprising the retained intron 1. In some embodiments, the ASO targets an exon 2 sequence downstream (or 3') from the 3' splice site of a PRRT2 RIC pre-mRNA comprising the retained intron 1. In some embodiments, the ASO targets an exon 2 sequence about 2 to about 924 nucleotides downstream (or 3') from the 3' splice site of a PRRT2 RIC pre-mRNA comprising the retained intron 1.

In some embodiments, the ASO targets intron 1 in a PRRT2 RIC pre-mRNA comprising a retained intron 1, wherein the intron numbering correspond to the mRNA sequence at NM_145239. In some embodiments, the ASO targets an intron 1 sequence downstream (or 3') from the 5' splice site of a PRRT2 RIC pre-mRNA comprising the retained intron 1. In some embodiments, the ASO targets an intron 1 sequence about 6 to about 346 nucleotides downstream (or 3') from the 5' splice site of a PRRT2 RIC pre-mRNA comprising the retained intron 1. In some embodiments, the ASO targets an intron 1 sequence upstream (or 5') from the 3' splice site of a PRRT2 RIC pre-mRNA comprising the retained intron 1. In some embodiments, the ASO targets an intron 1 sequence about 16 to about 345 nucleotides upstream (or 5') from the 3' splice site of a PRRT2 RIC pre-mRNA comprising the retained intron 1.

In some embodiments, the ASO targets exon 1 or exon 2 of a PRRT2 RIC pre-mRNA comprising a retained intron 1, wherein the intron numbering correspond to the mRNA sequence at NM_001256442. In some embodiments, the ASO targets an exon 1 sequence upstream (or 5') from the 5' splice site of a PRRT2 RIC pre-mRNA comprising the retained intron 1. In some embodiments, the ASO targets an exon 1 sequence about 4 to about 219 nucleotides upstream (or 5') from the 5' splice site of a PRRT2 RIC pre-mRNA comprising the retained intron 1. In some embodiments, the ASO targets an exon 2 sequence downstream (or 3') from the 3' splice site of a PRRT2 RIC pre-mRNA comprising the retained intron 1. In some embodiments, the ASO targets an exon 2 sequence about 2 to about 924 nucleotides downstream (or 3') from the 3' splice site of a PRRT2 RIC pre-mRNA comprising the retained intron 1.

In some embodiments, the ASO targets intron 1 in a PRRT2 RIC pre-mRNA comprising a retained intron 1, wherein the intron numbering correspond to the mRNA sequence at NM_001256442. In some embodiments, the ASO targets an intron 1 sequence downstream (or 3') from the 5' splice site of a PRRT2 RIC pre-mRNA comprising the retained intron 1. In some embodiments, the ASO targets an intron 1 sequence about 6 to about 346 nucleotides downstream (or 3') from the 5' splice site of a PRRT2 RIC pre-mRNA comprising the retained intron 1. In some embodiments, the ASO targets an intron 1 sequence upstream (or 5') from the 3' splice site of a PRRT2 RIC pre-mRNA comprising the retained intron 1. In some embodiments, the ASO targets an intron 1 sequence about 16 to about 345 or about 26 to about 345 nucleotides upstream (or 5') from the 3' splice site of a PRRT2 RIC pre-mRNA comprising the retained intron 1.

In some embodiments, the ASOs disclosed herein target a RIC pre-mRNA transcribed from a STX1B genomic sequence. In some embodiments, the ASO targets a RIC pre-mRNA transcript from a STX1B genomic sequence comprising a retained intron. In some embodiments, the ASO targets a RIC pre-mRNA transcript of SEQ ID NO: 6284. In some embodiments, the ASO targets a RIC pre-mRNA transcript of SEQ ID NO: 6284 comprising a retained intron. In some embodiments, the ASOs disclosed herein target a STX1B RIC pre-mRNA sequence. In some embodiments, the ASO targets a STX1B RIC pre-mRNA transcript comprising a retained intron at 6, 7 or a combination thereof, wherein the intron numbering correspond to the mRNA sequence at NM_052874.

In some embodiments, the ASO targets a STX1B RIC pre-mRNA sequence according to SEQ ID NO: 6313. In some embodiments, the ASO targets a STX1B RIC premRNA sequence according to SEQ ID NO: 6313 comprising a retained intron 6, a retained intron 7, or a combination thereof. In some embodiments, the ASOs disclosed herein target SEQ ID NOs: 30658 or 30648. In some embodiments, the ASO has a sequence according to any one of SEQ ID NOs: 15606-15873.

In some embodiments, the ASO targets exon 6 or exon 7 of a STX1B RIC pre-mRNA comprising a retained intron 6, wherein the intron numbering correspond to the mRNA sequence at NM_052874. In some embodiments, the ASO targets an exon 6 sequence upstream (or 5') from the 5' splice site of a STX1B RIC pre-mRNA comprising the retained intron 6. In some embodiments, the ASO targets an exon 6 sequence about 4 to about 89 nucleotides upstream (or 5') from the 5' splice site of a STX1B RIC pre-mRNA comprising the retained intron 6. In some embodiments, the ASO targets an exon 7 sequence downstream (or 3') from the 3' splice site of a STX1B RIC pre-mRNA comprising the retained intron 6. In some embodiments, the ASO targets an exon 7 sequence about 2 to about 57 nucleotides downstream (or 3') from the 3' splice site of a STX1B RIC pre-mRNA comprising the retained intron 6.

In some embodiments, the ASO targets intron 6 in a STX1B RIC pre-mRNA comprising a retained intron 6, wherein the intron numbering correspond to the mRNA sequence at NM_052874. In some embodiments, the ASO targets an intron 6 sequence downstream (or 3') from the 5' splice site of a STX1B RIC pre-mRNA comprising the retained intron 6. In some embodiments, the ASO targets an intron 6 sequence about 6 to about 99 nucleotides downstream (or 3') from the 5' splice site of a STX1B RIC pre-mRNA comprising the retained intron 6. In some embodiments, the ASO targets an intron 6 sequence upstream (or 5') from the 3' splice site of a STX1B RIC pre-mRNA comprising the retained intron 6. In some embodiments, the ASO targets an intron 6 sequence about 16 to about 94 nucleotides upstream (or 5') from the 3' splice site of a STX1B RIC pre-mRNA comprising the retained intron 6.

In some embodiments, the ASO targets exon 7 or exon 8 of a STX1B RIC pre-mRNA comprising a retained intron 7, wherein the intron numbering correspond to the mRNA sequence at NM_052874. In some embodiments, the ASO targets an exon 7 sequence upstream (or 5') from the 5' splice site of a STX1B RIC pre-mRNA comprising the retained intron 7. In some embodiments, the ASO targets an exon 7 sequence about 4 to about 54 nucleotides upstream (or 5') from the 5' splice site of a STX1B RIC pre-mRNA comprising the retained intron 7. In some embodiments, the ASO targets an exon 8 sequence downstream (or 3') from the 3' splice site of a STX1B RIC pre-mRNA comprising the retained intron 7. In some embodiments, the ASO targets an exon 8 sequence about 2 to about 117 nucleotides downstream (or 3') from the 3' splice site of a STX1B RIC pre-mRNA comprising the retained intron 7.

In some embodiments, the ASO targets intron 7 in a STX1B RIC pre-mRNA comprising a retained intron 7, wherein the intron numbering correspond to the mRNA sequence at NM_052874. In some embodiments, the ASO targets an intron 7 sequence downstream (or 3') from the 5' splice site of a STX1B RIC pre-mRNA comprising the retained intron 7. In some embodiments, the ASO targets an intron 7 sequence about 6 to about 500 nucleotides downstream (or 3') from the 5' splice site of a STX1B RIC pre-mRNA comprising the retained intron 7. In some embodiments, the ASO targets an intron 7 sequence upstream (or 5') from the 3' splice site of a STX1B RIC pre-mRNA comprising the retained intron 7. In some embodiments, the ASO targets an intron 7 sequence about 16 to about 496 nucleotides upstream (or 5') from the 3' splice site of a STX1B RIC pre-mRNA comprising the retained intron 7.

In some embodiments, the ASOs disclosed herein target a RIC pre-mRNA transcribed from a RAI1 genomic sequence. In some embodiments, the ASO targets a RIC pre-mRNA transcript from a RAI1 genomic sequence comprising a retained intron. In some embodiments, the ASO targets a RIC pre-mRNA transcript of SEQ ID NO: 6285. In some embodiments, the ASO targets a RIC pre-mRNA transcript of SEQ ID NO: 6285 comprising a retained intron. In some embodiments, the ASOs disclosed herein target a RAI1 RIC pre-mRNA sequence. In some embodiments, the ASO targets a RAI1 RIC pre-mRNA transcript comprising a retained intron at 4, wherein the intron numbering correspond to the mRNA sequence at NM_030665.

In some embodiments, the ASO targets a RAI1 RIC pre-mRNA sequence according to SEQ ID NO: 6314. In some embodiments, the ASO targets a RAI1 RIC pre-mRNA sequence according to SEQ ID NO: 6314 comprising a retained intron 4. In some embodiments, the ASOs disclosed herein target SEQ ID NO: 30655. In some embodiments, the ASO has a sequence according to any one of SEQ ID NOs: 15874-16076.

In some embodiments, the ASO targets exon 4 or exon 5 of a RAI1 RIC pre-mRNA comprising a retained intron 4, wherein the intron numbering correspond to the mRNA sequence at NM_030665. In some embodiments, the ASO targets an exon 4 sequence upstream (or 5') from the 5' splice site of a RAI1 RIC pre-mRNA comprising the retained intron 4. In some embodiments, the ASO targets an exon 4 sequence about 4 to about 74 nucleotides upstream (or 5') from the 5' splice site of a RAI1 RIC pre-mRNA comprising the retained intron 4. In some embodiments, the ASO targets an exon 5 sequence downstream (or 3') from the 3' splice site of a RAI1 RIC pre-mRNA comprising the retained intron 4. In some embodiments, the ASO targets an exon 5 sequence about 2 to about 32 nucleotides downstream (or 3') from the 3' splice site of a RAI1 RIC pre-mRNA comprising the retained intron 4.

In some embodiments, the ASO targets intron 4 in a RAI1 RIC pre-mRNA comprising a retained intron 4, wherein the intron numbering correspond to the mRNA sequence at NM_030665. In some embodiments, the ASO targets an intron 4 sequence downstream (or 3') from the 5' splice site of a RAI1 RIC pre-mRNA comprising the retained intron 4. In some embodiments, the ASO targets an intron 4 sequence about 6 to about 500 nucleotides downstream (or 3') from the 5' splice site of a RAI1 RIC pre-mRNA comprising the retained intron 4. In some embodiments, the ASO targets an intron 4 sequence upstream (or 5') from the 3' splice site of a RAI1 RIC pre-mRNA comprising the retained intron 4. In some embodiments, the ASO targets an intron 4 sequence about 16 to about 499 nucleotides upstream (or 5') from the 3' splice site of a RAI1 RIC pre-mRNA comprising the retained intron 4.

In some embodiments, the ASOs disclosed herein target a RIC pre-mRNA transcribed from a TCF4 genomic sequence. In some embodiments, the ASO targets a RIC pre-mRNA transcript from a TCF4 genomic sequence comprising a retained intron. In some embodiments, the ASO targets a RIC pre-mRNA transcript of SEQ ID NO: 6286. In some embodiments, the ASO targets a RIC pre-mRNA transcript of SEQ ID NO: 6286 comprising a retained intron. In some embodiments, the ASOs disclosed herein target a TCF4 RIC pre-mRNA sequence. In some embodiments, the ASO targets a TCF4 RIC pre-mRNA transcript comprising a retained intron at 10, wherein the intron numbering correspond to the mRNA sequence at NM_001243236. In some embodiments, the ASO targets a TCF4 RIC pre-mRNA transcript comprising a retained intron at 10, wherein the intron numbering correspond to the mRNA sequence at NM_001243235. In some embodiments, the ASO targets a TCF4 RIC pre-mRNA transcript comprising a retained intron at 10, wherein the intron numbering correspond to the mRNA sequence at NM_001243234. In some embodiments, the ASO targets a TCF4 RIC pre-mRNA transcript comprising a retained intron at 13, wherein the intron numbering correspond to the mRNA sequence at NM_001243233. In some embodiments, the ASO targets a TCF4 RIC pre-mRNA transcript comprising a retained intron at 13, wherein the intron numbering correspond to the mRNA sequence at NM_001243232. In some embodiments, the ASO targets a TCF4 RIC pre-mRNA transcript comprising a retained intron at 15, wherein the intron numbering correspond to the mRNA sequence at NM_001243231. In some embodiments, the ASO targets a TCF4 RIC pre-mRNA transcript comprising a retained intron at 17, wherein the intron numbering correspond to the mRNA sequence at NM_003199. In some embodiments, the ASO targets a TCF4 RIC pre-mRNA transcript comprising a retained intron at 16, wherein the intron numbering correspond to the mRNA sequence at NM_001306207. In some embodiments, the ASO targets a TCF4 RIC pre-mRNA transcript comprising a retained intron at 13, wherein the intron numbering correspond to the mRNA sequence at NM_001306208. In some embodiments, the ASO targets a TCF4 RIC pre-mRNA transcript comprising a retained intron at 16, wherein the intron numbering correspond to the mRNA sequence at NM_001243227. In some embodiments, the ASO targets a TCF4 RIC pre-mRNA transcript comprising a retained intron at 17, wherein the intron numbering correspond to the mRNA sequence at NM_001243228. In some embodiments, the ASO targets a TCF4 RIC pre-mRNA transcript comprising a retained intron at 16, wherein the intron numbering correspond to the mRNA sequence at NM_001243230. In some embodiments, the ASO targets a TCF4 RIC pre-mRNA transcript comprising a retained intron at 18, wherein the intron numbering correspond to the mRNA sequence at NM_001243226. In some embodiments, the ASO targets a TCF4 RIC pre-mRNA transcript comprising a retained intron at 17, wherein the intron numbering correspond to the mRNA sequence at NM_001083962. In some embodiments, the ASO targets a TCF4 RIC pre-mRNA transcript comprising a retained intron at 12, wherein the intron numbering correspond to the mRNA sequence at NM_001330605. In some embodiments, the ASO targets a TCF4 RIC pre-mRNA transcript comprising a retained intron at 17, wherein the intron numbering correspond to the mRNA sequence at NM_001330604.

In some embodiments, the ASO targets a TCF4 RIC pre-mRNA sequence according to SEQ ID NO: 6315. In some embodiments, the ASO targets a TCF4 RIC pre-mRNA sequence according to SEQ ID NO: 6315 comprising a retained intron 10. In some embodiments, the ASO targets a TCF4 RIC pre-mRNA sequence according to SEQ ID NO: 6316. In some embodiments, the ASO targets a TCF4 RIC pre-mRNA sequence according to SEQ ID NO: 6316 comprising a retained intron 10. In some embodiments, the ASO targets a TCF4 RIC pre-mRNA sequence according to SEQ ID NO: 6317. In some embodiments, the ASO targets a TCF4 RIC pre-mRNA sequence according to SEQ ID NO: 6317 comprising a retained intron 10. In some embodiments, the ASO targets a TCF4 RIC pre-mRNA sequence according to SEQ ID NO: 6318. In some embodiments, the ASO targets a TCF4 RIC pre-mRNA sequence according to SEQ ID NO: 6318 comprising a retained intron 13. In some embodiments, the ASO targets a TCF4 RIC pre-mRNA sequence according to SEQ ID NO: 6319. In some embodiments, the ASO targets a TCF4 RIC pre-mRNA sequence according to SEQ ID NO: 6319 comprising a retained intron 13. In some embodiments, the ASO targets a TCF4 RIC pre-mRNA sequence according to SEQ ID NO: 6320. In some embodiments, the ASO targets a TCF4 RIC pre-mRNA sequence according to SEQ ID NO: 6320 comprising a retained intron 15. In some embodiments, the ASO targets a TCF4 RIC pre-mRNA sequence according to SEQ ID NO: 6321. In some embodiments, the ASO targets a TCF4 RIC pre-mRNA sequence according to SEQ ID NO: 6321 comprising a retained intron 17. In some embodiments, the ASO targets a TCF4 RIC pre-mRNA sequence according to SEQ ID NO: 6322. In some embodiments, the ASO targets a TCF4 RIC pre-mRNA sequence according to SEQ ID NO: 6322 comprising a retained intron 16. In some embodiments, the ASO targets a TCF4 RIC pre-mRNA sequence according to SEQ ID NO: 6323. In some embodiments, the ASO targets a TCF4 RIC pre-mRNA sequence according to SEQ ID NO: 6323 comprising a retained intron 13. In some embodiments, the ASO targets a TCF4 RIC pre-mRNA sequence according to SEQ ID NO: 6324. In some embodiments, the ASO targets a TCF4 RIC pre-mRNA sequence according to SEQ ID NO: 6324 comprising a retained intron 16. In some embodiments, the ASO targets a TCF4 RIC pre-mRNA sequence according to SEQ ID NO: 6325. In some embodiments, the ASO targets a TCF4 RIC pre-mRNA sequence according to SEQ ID NO: 6325 comprising a retained intron 17. In some embodiments, the ASO targets a TCF4 RIC pre-mRNA sequence according to SEQ ID NO: 6326. In some embodiments, the ASO targets a TCF4 RIC pre-mRNA sequence according to SEQ ID NO: 6326 comprising a retained intron 16. In some embodiments, the ASO targets a TCF4 RIC pre-mRNA sequence according to SEQ ID NO: 6327. In some embodiments, the ASO targets a TCF4 RIC pre-mRNA sequence according to SEQ ID NO: 6327 comprising a retained intron 18. In some embodiments, the ASO targets a TCF4 RIC pre-mRNA sequence according to SEQ ID NO: 6328. In some embodiments, the ASO targets a TCF4 RIC pre-mRNA sequence according to SEQ ID NO: 6328 comprising a retained intron 17. In some embodiments, the ASO targets a TCF4 RIC pre-mRNA sequence according to SEQ ID NO: 6329. In some embodiments, the ASO targets a TCF4 RIC pre-mRNA sequence according to SEQ ID NO: 6329 comprising a retained intron 12. In some embodiments, the ASO targets a TCF4 RIC pre-mRNA sequence according to SEQ ID NO: 6330. In some embodiments, the ASO targets a TCF4 RIC pre-mRNA sequence according to SEQ ID NO: 6330 comprising a retained intron 17. In some embodiments, the ASOs disclosed herein target SEQ ID NOs: 34788 or 34789. In some embodiments, the ASO has a sequence according to any one of SEQ ID NOs: 30660-30916.

In some embodiments, the ASO targets exon 10 or exon 11 of a TCF4 RIC pre-mRNA comprising a retained intron 10, wherein the intron numbering correspond to the mRNA sequence at NM_001243236. In some embodiments, the ASO targets an exon 10 sequence upstream (or 5') from the 5' splice site of a TCF4 RIC pre-mRNA comprising the retained intron 10. In some embodiments, the ASO targets an exon 10 sequence about 4 to about 134 nucleotides upstream (or 5') from the 5' splice site of a TCF4 RIC pre-mRNA comprising the retained intron 10. In some embodiments, the ASO targets an exon 11 sequence downstream (or 3') from the 3' splice site of a TCF4 RIC pre-mRNA comprising the retained intron 10. In some embodiments, the ASO targets an exon 11 sequence about 2 to about 212 nucleotides downstream (or 3') from the 3' splice site of a TCF4 RIC pre-mRNA comprising the retained intron 10.

In some embodiments, the ASO targets intron 10 in a TCF4 RIC pre-mRNA comprising a retained intron 10, wherein the intron numbering correspond to the mRNA sequence at NM_001243236. In some embodiments, the ASO targets an intron 10 sequence downstream (or 3') from the 5' splice site of a TCF4 RIC pre-mRNA comprising the retained intron 10. In some embodiments, the ASO targets an intron 10 sequence about 6 to about 496 nucleotides downstream (or 3') from the 5' splice site of a TCF4 RIC pre-mRNA comprising the retained intron 10. In some embodiments, the ASO targets an intron 10 sequence upstream (or 5') from the 3' splice site of a TCF4 RIC pre-mRNA comprising the retained intron 10. In some embodiments, the ASO targets an intron 10 sequence about 16 to about 496 nucleotides upstream (or 5') from the 3' splice site of a TCF4 RIC pre-mRNA comprising the retained intron 10.

In some embodiments, the ASO targets exon 10 or exon 11 of a TCF4 RIC pre-mRNA comprising a retained intron 10, wherein the intron numbering correspond to the mRNA sequence at NM_001243235. In some embodiments, the ASO targets an exon 10 sequence upstream (or 5') from the 5' splice site of a TCF4 RIC pre-mRNA comprising the retained intron 10. In some embodiments, the ASO targets an exon 10 sequence about 4 to about 134 nucleotides upstream (or 5') from the 5' splice site of a TCF4 RIC pre-mRNA comprising the retained intron 10. In some embodiments, the ASO targets an exon 11 sequence downstream (or 3') from the 3' splice site of a TCF4 RIC pre-mRNA comprising the retained intron 10. In some embodiments, the ASO targets an exon 11 sequence about 2 to about 212 nucleotides downstream (or 3') from the 3' splice site of a TCF4 RIC pre-mRNA comprising the retained intron 10.

In some embodiments, the ASO targets intron 10 in a TCF4 RIC pre-mRNA comprising a retained intron 10, wherein the intron numbering correspond to the mRNA sequence at NM_001243235. In some embodiments, the ASO targets an intron 10 sequence downstream (or 3') from the 5' splice site of a TCF4 RIC pre-mRNA comprising the retained intron 10. In some embodiments, the ASO targets an intron 10 sequence about 6 to about 496 nucleotides downstream (or 3') from the 5' splice site of a TCF4 RIC pre-mRNA comprising the retained intron 10. In some embodiments, the ASO targets an intron 10 sequence upstream (or 5') from the 3' splice site of a TCF4 RIC pre-mRNA comprising the retained intron 10. In some embodiments, the ASO targets an intron 10 sequence about 16 to about 496 nucleotides upstream (or 5') from the 3' splice site of a TCF4 RIC pre-mRNA comprising the retained intron 10.

In some embodiments, the ASO targets exon 10 or exon 11 of a TCF4 RIC pre-mRNA comprising a retained intron 10, wherein the intron numbering correspond to the mRNA sequence at NM_001243234. In some embodiments, the ASO targets an exon 10 sequence upstream (or 5') from the 5' splice site of a TCF4 RIC pre-mRNA comprising the retained intron 10. In some embodiments, the ASO targets an exon 10 sequence about 4 to about 144 nucleotides upstream (or 5') from the 5' splice site of a TCF4 RIC pre-mRNA comprising the retained intron 10. In some embodiments, the ASO targets an exon 11 sequence downstream (or 3') from the 3' splice site of a TCF4 RIC pre-mRNA comprising the retained intron 10. In some embodiments, the ASO targets an exon 11 sequence about 2 to about 212 nucleotides downstream (or 3') from the 3' splice site of a TCF4 RIC pre-mRNA comprising the retained intron 10.

In some embodiments, the ASO targets intron 10 in a TCF4 RIC pre-mRNA comprising a retained intron 10, wherein the intron numbering correspond to the mRNA sequence at NM_001243234. In some embodiments, the ASO targets an intron 10 sequence downstream (or 3') from the 5' splice site of a TCF4 RIC pre-mRNA comprising the retained intron 10. In some embodiments, the ASO targets an intron 10 sequence about 6 to about 496 nucleotides downstream (or 3') from the 5' splice site of a TCF4 RIC pre-mRNA comprising the retained intron 10. In some embodiments, the ASO targets an intron 10 sequence upstream (or 5') from the 3' splice site of a TCF4 RIC pre-mRNA comprising the retained intron 10. In some embodiments, the ASO targets an intron 10 sequence about 16 to about 496 nucleotides upstream (or 5') from the 3' splice site of a TCF4 RIC pre-mRNA comprising the retained intron 10.

In some embodiments, the ASO targets exon 13 or exon 14 of a TCF4 RIC pre-mRNA comprising a retained intron 13, wherein the intron numbering correspond to the mRNA sequence at NM_001243233. In some embodiments, the ASO targets an exon 13 sequence upstream (or 5') from the 5' splice site of a TCF4 RIC pre-mRNA comprising the retained intron 13. In some embodiments, the ASO targets an exon 13 sequence about 4 to about 134 nucleotides upstream (or 5') from the 5' splice site of a TCF4 RIC pre-mRNA comprising the retained intron 13. In some embodiments, the ASO targets an exon 14 sequence downstream (or 3') from the 3' splice site of a TCF4 RIC pre-mRNA comprising the retained intron 13. In some embodiments, the ASO targets an exon 14 sequence about 2 to about 212 nucleotides downstream (or 3') from the 3' splice site of a TCF4 RIC pre-mRNA comprising the retained intron 13.

In some embodiments, the ASO targets intron 13 in a TCF4 RIC pre-mRNA comprising a retained intron 13, wherein the intron numbering correspond to the mRNA sequence at NM_001243233. In some embodiments, the ASO targets an intron 13 sequence downstream (or 3') from the 5' splice site of a TCF4 RIC pre-mRNA comprising the retained intron 13. In some embodiments, the ASO targets an intron 13 sequence about 6 to about 496 nucleotides downstream (or 3') from the 5' splice site of a TCF4 RIC pre-mRNA comprising the retained intron 13. In some embodiments, the ASO targets an intron 13 sequence upstream (or 5') from the 3' splice site of a TCF4 RIC pre-mRNA comprising the retained intron 13. In some embodiments, the ASO targets an intron 13 sequence about 16 to about 496 nucleotides upstream (or 5') from the 3' splice site of a TCF4 RIC pre-mRNA comprising the retained intron 13.

In some embodiments, the ASO targets exon 13 or exon 14 of a TCF4 RIC pre-mRNA comprising a retained intron 13, wherein the intron numbering correspond to the mRNA sequence at NM_001243232. In some embodiments, the ASO targets an exon 13 sequence upstream (or 5') from the 5' splice site of a TCF4 RIC pre-mRNA comprising the retained intron 13. In some embodiments, the ASO targets an exon 13 sequence about 4 to about 144 nucleotides upstream (or 5') from the 5' splice site of a TCF4 RIC pre-mRNA comprising the retained intron 13. In some embodiments, the ASO targets an exon 14 sequence downstream (or 3') from the 3' splice site of a TCF4 RIC pre-mRNA comprising the retained intron 13. In some embodiments, the ASO targets an exon 14 sequence about 2 to about 212 nucleotides downstream (or 3') from the 3' splice site of a TCF4 RIC pre-mRNA comprising the retained intron 13.

In some embodiments, the ASO targets intron 13 in a TCF4 RIC pre-mRNA comprising a retained intron 13, wherein the intron numbering correspond to the mRNA sequence at NM_001243232. In some embodiments, the ASO targets an intron 13 sequence downstream (or 3') from the 5' splice site of a TCF4 RIC pre-mRNA comprising the retained intron 13. In some embodiments, the ASO targets an intron 13 sequence about 6 to about 496 nucleotides downstream (or 3') from the 5' splice site of a TCF4 RIC pre-mRNA comprising the retained intron 13. In some embodiments, the ASO targets an intron 13 sequence upstream (or 5') from the 3' splice site of a TCF4 RIC pre-mRNA comprising the retained intron 13. In some embodiments, the ASO targets an intron 13 sequence about 16 to about 496 nucleotides upstream (or 5') from the 3' splice site of a TCF4 RIC pre-mRNA comprising the retained intron 13.

In some embodiments, the ASO targets exon 15 or exon 16 of a TCF4 RIC pre-mRNA comprising a retained intron 15, wherein the intron numbering correspond to the mRNA sequence at NM_001243231. In some embodiments, the ASO targets an exon 15 sequence upstream (or 5') from the 5' splice site of a TCF4 RIC pre-mRNA comprising the retained intron 15. In some embodiments, the ASO targets an exon 15 sequence about 4 to about 134 nucleotides upstream (or 5') from the 5' splice site of a TCF4 RIC pre-mRNA comprising the retained intron 15. In some embodiments, the ASO targets an exon 16 sequence downstream (or 3') from the 3' splice site of a TCF4 RIC pre-mRNA comprising the retained intron 15. In some embodiments, the ASO targets an exon 16 sequence about 2 to about 212 nucleotides downstream (or 3') from the 3' splice site of a TCF4 RIC pre-mRNA comprising the retained intron 15.

In some embodiments, the ASO targets intron 15 in a TCF4 RIC pre-mRNA comprising a retained intron 15, wherein the intron numbering correspond to the mRNA sequence at NM_001243231. In some embodiments, the ASO targets an intron 15 sequence downstream (or 3') from the 5' splice site of a TCF4 RIC pre-mRNA comprising the retained intron 15. In some embodiments, the ASO targets an intron 15 sequence about 6 to about 496 nucleotides downstream (or 3') from the 5' splice site of a TCF4 RIC pre-mRNA comprising the retained intron 15. In some embodiments, the ASO targets an intron 15 sequence upstream (or 5') from the 3' splice site of a TCF4 RIC pre-mRNA comprising the retained intron 15. In some embodiments, the ASO targets an intron 15 sequence about 16 to about 496 nucleotides upstream (or 5') from the 3' splice site of a TCF4 RIC pre-mRNA comprising the retained intron 15.

In some embodiments, the ASO targets exon 17 or exon 18 of a TCF4 RIC pre-mRNA comprising a retained intron 17, wherein the intron numbering correspond to the mRNA sequence at NM_003199. In some embodiments, the ASO targets an exon 17 sequence upstream (or 5') from the 5' splice site of a TCF4 RIC pre-mRNA comprising the retained intron 17. In some embodiments, the ASO targets an exon 17 sequence about 4 to about 134 nucleotides upstream (or 5') from the 5' splice site of a TCF4 RIC pre-mRNA comprising the retained intron 17. In some embodiments, the ASO targets an exon 18 sequence downstream (or 3') from the 3' splice site of a TCF4 RIC pre-mRNA comprising the retained intron 17. In some embodiments, the ASO targets an exon 18 sequence about 2 to about 212 nucleotides downstream (or 3') from the 3' splice site of a TCF4 RIC pre-mRNA comprising the retained intron 17.

In some embodiments, the ASO targets intron 17 in a TCF4 RIC pre-mRNA comprising a retained intron 17, wherein the intron numbering correspond to the mRNA sequence at NM_003199. In some embodiments, the ASO targets an intron 17 sequence downstream (or 3') from the 5' splice site of a TCF4 RIC pre-mRNA comprising the retained intron 17. In some embodiments, the ASO targets an intron 17 sequence about 6 to about 496 nucleotides downstream (or 3') from the 5' splice site of a TCF4 RIC pre-mRNA comprising the retained intron 17. In some embodiments, the ASO targets an intron 17 sequence upstream (or 5') from the 3' splice site of a TCF4 RIC pre-mRNA comprising the retained intron 17. In some embodiments, the ASO targets an intron 17 sequence about 16 to about 496 nucleotides upstream (or 5') from the 3' splice site of a TCF4 RIC pre-mRNA comprising the retained intron 17.

In some embodiments, the ASO targets exon 16 or exon 17 of a TCF4 RIC pre-mRNA comprising a retained intron 16, wherein the intron numbering correspond to the mRNA sequence at NM_001306207. In some embodiments, the ASO targets an exon 16 sequence upstream (or 5') from the 5' splice site of a TCF4 RIC pre-mRNA comprising the retained intron 16. In some embodiments, the ASO targets an exon 16 sequence about 4 to about 134 nucleotides upstream (or 5') from the 5' splice site of a TCF4 RIC pre-mRNA comprising the retained intron 16. In some embodiments, the ASO targets an exon 17 sequence downstream (or 3') from the 3' splice site of a TCF4 RIC pre-mRNA comprising the retained intron 16. In some embodiments, the ASO targets an exon 17 sequence about 2 to about 212 nucleotides downstream (or 3') from the 3' splice site of a TCF4 RIC pre-mRNA comprising the retained intron 16.

In some embodiments, the ASO targets intron 16 in a TCF4 RIC pre-mRNA comprising a retained intron 16, wherein the intron numbering correspond to the mRNA sequence at NM_001306207. In some embodiments, the ASO targets an intron 16 sequence downstream (or 3') from the 5' splice site of a TCF4 RIC pre-mRNA comprising the retained intron 16. In some embodiments, the ASO targets an intron 16 sequence about 6 to about 496 nucleotides downstream (or 3') from the 5' splice site of a TCF4 RIC pre-mRNA comprising the retained intron 16. In some embodiments, the ASO targets an intron 16 sequence upstream (or 5') from the 3' splice site of a TCF4 RIC pre-mRNA comprising the retained intron 16. In some embodiments, the ASO targets an intron 16 sequence about 16 to about 496 nucleotides upstream (or 5') from the 3' splice site of a TCF4 RIC pre-mRNA comprising the retained intron 16.

In some embodiments, the ASO targets exon 13 or exon 14 of a TCF4 RIC pre-mRNA comprising a retained intron 13, wherein the intron numbering correspond to the mRNA sequence at NM_001306208. In some embodiments, the ASO targets an exon 13 sequence upstream (or 5') from the 5' splice site of a TCF4 RIC pre-mRNA comprising the retained intron 13. In some embodiments, the ASO targets an exon 13 sequence about 4 to about 134 nucleotides upstream (or 5') from the 5' splice site of a TCF4 RIC pre-mRNA comprising the retained intron 13. In some embodiments, the ASO targets an exon 14 sequence downstream (or 3') from the 3' splice site of a TCF4 RIC pre-mRNA comprising the retained intron 13. In some embodiments, the ASO targets an exon 14 sequence about 2 to about 212 nucleotides downstream (or 3') from the 3' splice site of a TCF4 RIC pre-mRNA comprising the retained intron 13.

In some embodiments, the ASO targets intron 13 in a TCF4 RIC pre-mRNA comprising a retained intron 13, wherein the intron numbering correspond to the mRNA sequence at NM_001306208. In some embodiments, the ASO targets an intron 13 sequence downstream (or 3') from the 5' splice site of a TCF4 RIC pre-mRNA comprising the retained intron 13. In some embodiments, the ASO targets an intron 13 sequence about 6 to about 496 nucleotides downstream (or 3') from the 5' splice site of a TCF4 RIC pre-mRNA comprising the retained intron 13. In some embodiments, the ASO targets an intron 13 sequence upstream (or 5') from the 3' splice site of a TCF4 RIC pre-mRNA comprising the retained intron 13. In some embodiments, the ASO targets an intron 13 sequence about 16 to about 496 nucleotides upstream (or 5') from the 3' splice site of a TCF4 RIC pre-mRNA comprising the retained intron 13.

In some embodiments, the ASO targets exon 16 or exon 17 of a TCF4 RIC pre-mRNA comprising a retained intron 16, wherein the intron numbering correspond to the mRNA sequence at NM_001243227. In some embodiments, the ASO targets an exon 16 sequence upstream (or 5') from the 5' splice site of a TCF4 RIC pre-mRNA comprising the retained intron 16. In some embodiments, the ASO targets an exon 16 sequence about 4 to about 144 nucleotides upstream (or 5') from the 5' splice site of a TCF4 RIC pre-mRNA comprising the retained intron 16. In some embodiments, the ASO targets an exon 17 sequence downstream (or 3') from the 3' splice site of a TCF4 RIC pre-mRNA comprising the retained intron 16. In some embodiments, the ASO targets an exon 17 sequence about 2 to about 212 nucleotides downstream (or 3') from the 3' splice site of a TCF4 RIC pre-mRNA comprising the retained intron 16.

In some embodiments, the ASO targets intron 16 in a TCF4 RIC pre-mRNA comprising a retained intron 16, wherein the intron numbering correspond to the mRNA sequence at NM_001243227. In some embodiments, the ASO targets an intron 16 sequence downstream (or 3') from the 5' splice site of a TCF4 RIC pre-mRNA comprising the retained intron 16. In some embodiments, the ASO targets an intron 16 sequence about 6 to about 496 nucleotides downstream (or 3') from the 5' splice site of a TCF4 RIC pre-mRNA comprising the retained intron 16. In some embodiments, the ASO targets an intron 16 sequence upstream (or 5') from the 3' splice site of a TCF4 RIC pre-mRNA comprising the retained intron 16. In some embodiments, the ASO targets an intron 16 sequence about 16 to about 496 nucleotides upstream (or 5') from the 3' splice site of a TCF4 RIC pre-mRNA comprising the retained intron 16.

In some embodiments, the ASO targets exon 17 or exon 18 of a TCF4 RIC pre-mRNA comprising a retained intron 17, wherein the intron numbering correspond to the mRNA sequence at NM_001243228. In some embodiments, the ASO targets an exon 17 sequence upstream (or 5') from the 5' splice site of a TCF4 RIC pre-mRNA comprising the retained intron 17. In some embodiments, the ASO targets an exon 17 sequence about 4 to about 144 nucleotides upstream (or 5') from the 5' splice site of a TCF4 RIC pre-mRNA comprising the retained intron 17. In some embodiments, the ASO targets an exon 18 sequence downstream (or 3') from the 3' splice site of a TCF4 RIC pre-mRNA comprising the retained intron 17. In some embodiments, the ASO targets an exon 18 sequence about 2 to about 212 nucleotides downstream (or 3') from the 3' splice site of a TCF4 RIC pre-mRNA comprising the retained intron 17.

In some embodiments, the ASO targets intron 17 in a TCF4 RIC pre-mRNA comprising a retained intron 17, wherein the intron numbering correspond to the mRNA sequence at NM_001243228. In some embodiments, the ASO targets an intron 17 sequence downstream (or 3') from the 5' splice site of a TCF4 RIC pre-mRNA comprising the retained intron 17. In some embodiments, the ASO targets an intron 17 sequence about 6 to about 496 nucleotides downstream (or 3') from the 5' splice site of a TCF4 RIC pre-mRNA comprising the retained intron 17. In some embodiments, the ASO targets an intron 17 sequence upstream (or 5') from the 3' splice site of a TCF4 RIC pre-mRNA comprising the retained intron 17. In some embodiments, the ASO targets an intron 17 sequence about 16 to about 496 nucleotides upstream (or 5') from the 3' splice site of a TCF4 RIC pre-mRNA comprising the retained intron 17.

In some embodiments, the ASO targets exon 16 or exon 17 of a TCF4 RIC pre-mRNA comprising a retained intron 16, wherein the intron numbering correspond to the mRNA sequence at NM_001243230. In some embodiments, the ASO targets an exon 16 sequence upstream (or 5') from the 5' splice site of a TCF4 RIC pre-mRNA comprising the retained intron 16. In some embodiments, the ASO targets an exon 16 sequence about 4 to about 134 nucleotides upstream (or 5') from the 5' splice site of a TCF4 RIC pre-mRNA comprising the retained intron 16. In some embodiments, the ASO targets an exon 17 sequence downstream (or 3') from the 3' splice site of a TCF4 RIC pre-mRNA comprising the retained intron 16. In some embodiments, the ASO targets an exon 17 sequence about 2 to about 212 nucleotides downstream (or 3') from the 3' splice site of a TCF4 RIC pre-mRNA comprising the retained intron 16.

In some embodiments, the ASO targets intron 16 in a TCF4 RIC pre-mRNA comprising a retained intron 16, wherein the intron numbering correspond to the mRNA sequence at NM_001243230. In some embodiments, the ASO targets an intron 16 sequence downstream (or 3') from the 5' splice site of a TCF4 RIC pre-mRNA comprising the retained intron 16. In some embodiments, the ASO targets an intron 16 sequence about 6 to about 496 nucleotides downstream (or 3') from the 5' splice site of a TCF4 RIC pre-mRNA comprising the retained intron 16. In some embodiments, the ASO targets an intron 16 sequence upstream (or 5') from the 3' splice site of a TCF4 RIC pre-mRNA comprising the retained intron 16. In some embodiments, the ASO targets an intron 16 sequence about 16 to about 496 nucleotides upstream (or 5') from the 3' splice site of a TCF4 RIC pre-mRNA comprising the retained intron 16.

In some embodiments, the ASO targets exon 18 or exon 19 of a TCF4 RIC pre-mRNA comprising a retained intron 18, wherein the intron numbering correspond to the mRNA sequence at NM_001243226. In some embodiments, the ASO targets an exon 18 sequence upstream (or 5') from the 5' splice site of a TCF4 RIC pre-mRNA comprising the retained intron 18. In some embodiments, the ASO targets an exon 18 sequence about 4 to about 144 nucleotides upstream (or 5') from the 5' splice site of a TCF4 RIC pre-mRNA comprising the retained intron 18. In some embodiments, the ASO targets an exon 19 sequence downstream (or 3') from the 3' splice site of a TCF4 RIC pre-mRNA comprising the retained intron 18. In some embodiments, the ASO targets an exon 19 sequence about 2 to about 212 nucleotides downstream (or 3') from the 3' splice site of a TCF4 RIC pre-mRNA comprising the retained intron 18.

In some embodiments, the ASO targets intron 18 in a TCF4 RIC pre-mRNA comprising a retained intron 18, wherein the intron numbering correspond to the mRNA sequence at NM_001243226. In some embodiments, the ASO targets an intron 18 sequence downstream (or 3') from the 5' splice site of a TCF4 RIC pre-mRNA comprising the retained intron 18. In some embodiments, the ASO targets an intron 18 sequence about 6 to about 496 nucleotides downstream (or 3') from the 5' splice site of a TCF4 RIC pre-mRNA comprising the retained intron 18. In some embodiments, the ASO targets an intron 18 sequence upstream (or 5') from the 3' splice site of a TCF4 RIC pre-mRNA comprising the retained intron 18. In some embodiments, the ASO targets an intron 18 sequence about 16 to about 496 nucleotides upstream (or 5') from the 3' splice site of a TCF4 RIC pre-mRNA comprising the retained intron 18.

In some embodiments, the ASO targets exon 17 or exon 18 of a TCF4 RIC pre-mRNA comprising a retained intron 17, wherein the intron numbering correspond to the mRNA sequence at NM_001083962. In some embodiments, the ASO targets an exon 17 sequence upstream (or 5') from the 5' splice site of a TCF4 RIC pre-mRNA comprising the retained intron 17. In some embodiments, the ASO targets an exon 17 sequence about 4 to about 144 nucleotides upstream (or 5') from the 5' splice site of a TCF4 RIC pre-mRNA comprising the retained intron 17. In some embodiments, the ASO targets an exon 18 sequence downstream (or 3') from the 3' splice site of a TCF4 RIC pre-mRNA comprising the retained intron 17. In some embodiments, the ASO targets an exon 18 sequence about 2 to about 212 nucleotides downstream (or 3') from the 3' splice site of a TCF4 RIC pre-mRNA comprising the retained intron 17.

In some embodiments, the ASO targets intron 17 in a TCF4 RIC pre-mRNA comprising a retained intron 17, wherein the intron numbering correspond to the mRNA sequence at NM_001083962. In some embodiments, the ASO targets an intron 17 sequence downstream (or 3') from the 5' splice site of a TCF4 RIC pre-mRNA comprising the retained intron 17. In some embodiments, the ASO targets an intron 17 sequence about 6 to about 496 nucleotides downstream (or 3') from the 5' splice site of a TCF4 RIC pre-mRNA comprising the retained intron 17. In some embodiments, the ASO targets an intron 17 sequence upstream (or 5') from the 3' splice site of a TCF4 RIC pre-mRNA comprising the retained intron 17. In some embodiments, the ASO targets an intron 17 sequence about 16 to about 496 nucleotides upstream (or 5') from the 3' splice site of a TCF4 RIC pre-mRNA comprising the retained intron 17.

In some embodiments, the ASO targets exon 12 or exon 13 of a TCF4 RIC pre-mRNA comprising a retained intron 12, wherein the intron numbering correspond to the mRNA sequence at NM_001330605. In some embodiments, the ASO targets an exon 12 sequence upstream (or 5') from the 5' splice site of a TCF4 RIC pre-mRNA comprising the retained intron 12. In some embodiments, the ASO targets an exon 12 sequence about 4 to about 144 nucleotides upstream (or 5') from the 5' splice site of a TCF4 RIC pre-mRNA comprising the retained intron 12. In some embodiments, the ASO targets an exon 13 sequence downstream (or 3') from the 3' splice site of a TCF4 RIC pre-mRNA comprising the retained intron 12. In some embodiments, the ASO targets an exon 13 sequence about 2 to about 212 nucleotides downstream (or 3') from the 3' splice site of a TCF4 RIC pre-mRNA comprising the retained intron 12.

In some embodiments, the ASO targets intron 12 in a TCF4 RIC pre-mRNA comprising a retained intron 12, wherein the intron numbering correspond to the mRNA sequence at NM_001330605. In some embodiments, the ASO targets an intron 12 sequence downstream (or 3') from the 5' splice site of a TCF4 RIC pre-mRNA comprising the retained intron 12. In some embodiments, the ASO targets an intron 12 sequence about 6 to about 496 nucleotides downstream (or 3') from the 5' splice site of a TCF4 RIC pre-mRNA comprising the retained intron 12. In some embodiments, the ASO targets an intron 12 sequence upstream (or 5') from the 3' splice site of a TCF4 RIC pre-mRNA comprising the retained intron 12. In some embodiments, the ASO targets an intron 12 sequence about 16 to about 496 nucleotides upstream (or 5') from the 3' splice site of a TCF4 RIC pre-mRNA comprising the retained intron 12.

In some embodiments, the ASO targets exon 17 or exon 18 of a TCF4 RIC pre-mRNA comprising a retained intron 17, wherein the intron numbering correspond to the mRNA sequence at NM_001330604. In some embodiments, the ASO targets an exon 17 sequence upstream (or 5') from the 5' splice site of a TCF4 RIC pre-mRNA comprising the retained intron 17. In some embodiments, the ASO targets an exon 17 sequence about 4 to about 144 nucleotides upstream (or 5') from the 5' splice site of a TCF4 RIC pre-mRNA comprising the retained intron 17. In some embodiments, the ASO targets an exon 18 sequence downstream (or 3') from the 3' splice site of a TCF4 RIC pre-mRNA comprising the retained intron 17. In some embodiments, the ASO targets an exon 18 sequence about 2 to about 212 nucleotides downstream (or 3') from the 3' splice site of a TCF4 RIC pre-mRNA comprising the retained intron 17.

In some embodiments, the ASO targets intron 17 in a TCF4 RIC pre-mRNA comprising a retained intron 17, wherein the intron numbering correspond to the mRNA sequence at NM_001330604. In some embodiments, the ASO targets an intron 17 sequence downstream (or 3') from the 5' splice site of a TCF4 RIC pre-mRNA comprising the retained intron 17. In some embodiments, the ASO targets an intron 17 sequence about 6 to about 496 nucleotides downstream (or 3') from the 5' splice site of a TCF4 RIC pre-mRNA comprising the retained intron 17. In some embodiments, the ASO targets an intron 17 sequence upstream (or 5') from the 3' splice site of a TCF4 RIC pre-mRNA comprising the retained intron 17. In some embodiments, the ASO targets an intron 17 sequence about 16 to about 496 nucleotides upstream (or 5') from the 3' splice site of a TCF4 RIC pre-mRNA comprising the retained intron 17.

In some embodiments, the ASOs disclosed herein target a RIC pre-mRNA transcribed from a NPC1 genomic sequence. In some embodiments, the ASO targets a RIC pre-mRNA transcript from a NPC1 genomic sequence comprising a retained intron. In some embodiments, the ASO targets a RIC pre-mRNA transcript of SEQ ID NO: 6287. In some embodiments, the ASO targets a RIC pre-mRNA transcript of SEQ ID NO: 6287 comprising a retained intron. In some embodiments, the ASOs disclosed herein target aNPC1 RIC pre-mRNA sequence. In some embodiments, the ASO targets aNPC1 RIC pre-mRNA transcript comprising a retained intron at 15, wherein the intron numbering correspond to the mRNA sequence at NM_000271.

In some embodiments, the ASO targets aNPC1 RIC pre-mRNA sequence according to SEQ ID NO: 6331. In some embodiments, the ASO targets aNPC1 RIC pre-mRNA sequence according to SEQ ID NO: 6331 comprising a retained intron 15. In some embodiments, the ASOs disclosed herein target SEQ ID NO: 30655. In some embodiments, the ASO has a sequence according to any one of SEQ ID NOs: 19965-20033.

In some embodiments, the ASO targets exon 15 or exon 16 of aNPC1 RIC pre-mRNA comprising a retained intron 15, wherein the intron numbering correspond to the mRNA sequence at NM_000271. In some embodiments, the ASO targets an exon 15 sequence upstream (or 5') from the 5' splice site of a NPC1 RIC pre-mRNA comprising the retained intron 15. In some embodiments, the ASO targets an exon 15 sequence about 4 to about 109 nucleotides upstream (or 5') from the 5' splice site of a NPC1 RIC pre-mRNA comprising the retained intron 15. In some embodiments, the ASO targets an exon 16 sequence downstream (or 3') from the 3' splice site of a NPC1 RIC pre-mRNA comprising the retained intron 15. In some embodiments, the ASO targets an exon 16 sequence about 2 to about 122 nucleotides downstream (or 3') from the 3' splice site of a NPC1 RIC pre-mRNA comprising the retained intron 15.

In some embodiments, the ASO targets intron 15 in a NPC1 RIC pre-mRNA comprising a retained intron 15, wherein the intron numbering correspond to the mRNA sequence at NM_000271. In some embodiments, the ASO targets an intron 15 sequence downstream (or 3') from the 5' splice site of a NPC1 RIC pre-mRNA comprising the retained intron 15. In some embodiments, the ASO targets an intron 15 sequence about 6 to about 61 nucleotides downstream (or 3') from the 5' splice site of a NPC1 RIC pre-mRNA comprising the retained intron 15. In some embodiments, the ASO targets an intron 15 sequence upstream (or 5') from the 3' splice site of a NPC1 RIC pre-mRNA comprising the retained intron 15. In some embodiments, the ASO targets an intron 15 sequence about 16 to about 61 nucleotides upstream (or 5') from the 3' splice site of a NPC1 RIC pre-mRNA comprising the retained intron 15.

In some embodiments, the ASOs disclosed herein target a RIC pre-mRNA transcribed from a CACNA1A genomic sequence. In some embodiments, the ASO targets a RIC pre-mRNA transcript from a CACNA1A genomic sequence comprising a retained intron. In some embodiments, the ASO targets a RIC pre-mRNA transcript of SEQ ID NO: 6288. In some embodiments, the ASO targets a RIC pre-mRNA transcript of SEQ ID NO: 6288 comprising a retained intron. In some embodiments, the ASOs disclosed herein target a CACNA1A RIC pre-mRNA sequence. In some embodiments, the ASO targets a CACNA1A RIC pre-mRNA transcript comprising a retained intron at 36, 37 or a combination thereof, wherein the intron numbering correspond to the mRNA sequence at NM_000068. In some embodiments, the ASO targets a CACNA1A RIC pre-mRNA transcript comprising a retained intron at 36, 37 or a combination thereof, wherein the intron numbering correspond to the mRNA sequence at NM_023035. In some embodiments, the ASO targets a CACNA1A RIC pre-mRNA transcript comprising a retained intron at 36, 37 or a combination thereof, wherein the intron numbering correspond to the mRNA sequence at NM_001174080. In some embodiments, the ASO targets a CACNA1A RIC pre-mRNA transcript comprising a retained intron at 36, 37 or a combination thereof, wherein the intron numbering correspond to the mRNA sequence at NM_001127222. In some embodiments, the ASO targets a CACNA1A RIC pre-mRNA transcript comprising a retained intron at 36, 37 or a combination thereof, wherein the intron numbering correspond to the mRNA sequence at NM_001127221.

In some embodiments, the ASO targets a CACNA1A RIC pre-mRNA sequence according to SEQ ID NO: 6332. In some embodiments, the ASO targets a CACNA1A RIC pre-mRNA sequence according to SEQ ID NO: 6332 comprising a retained intron 36, a retained intron 37, or a combination thereof. In some embodiments, the ASO targets a CACNA1A RIC pre-mRNA sequence according to SEQ ID NO: 6333. In some embodiments, the ASO targets a CACNA1A RIC pre-mRNA sequence according to SEQ ID NO: 6333 comprising a retained intron 36, a retained intron 37, or a combination thereof. In some embodiments, the ASO targets a CACNA1A RIC pre-mRNA sequence according to SEQ ID NO: 6334. In some embodiments, the ASO targets a CACNA1A RIC pre-mRNA sequence according to SEQ ID NO: 6334 comprising a retained intron 36, a retained intron 37, or a combination thereof. In some embodiments, the ASO targets a CACNA1A RIC pre-mRNA sequence according to SEQ ID NO: 6335. In some embodiments, the ASO targets a CACNA1A RIC pre-mRNA sequence according to SEQ ID NO: 6335 comprising a retained intron 36, a retained intron 37, or a combination thereof. In some embodiments, the ASO targets a CACNA1A RIC pre-mRNA sequence according to SEQ ID NO: 6336. In some embodiments, the ASO targets a CACNA1A RIC pre-mRNA sequence according to SEQ ID NO: 6336 comprising a retained intron 36, a retained intron 37, or a combination thereof. In some embodiments, the ASOs disclosed herein target SEQ ID NOs: 30639, 30647, 30650, or 30657. In some embodiments, the ASO has a sequence according to any one of SEQ ID NOs: 20034-22187.

In some embodiments, the ASO targets exon 36 or exon 37 of a CACNA1A RIC pre-mRNA comprising a retained intron 36, wherein the intron numbering correspond to the mRNA sequence at NM_000068. In some embodiments, the ASO targets an exon 36 sequence upstream (or 5') from the 5' splice site of a CACNA1A RIC pre-mRNA comprising the retained intron 36. In some embodiments, the ASO targets an exon 36 sequence about 4 to about 110 nucleotides upstream (or 5') from the 5' splice site of a CACNA1A RIC pre-mRNA comprising the retained intron 36. In some embodiments, the ASO targets an exon 37 sequence downstream (or 3') from the 3' splice site of a CACNA1A RIC pre-mRNA comprising the retained intron 36. In some embodiments, the ASO targets an exon 37 sequence about 2 to about 79 nucleotides downstream (or 3') from the 3' splice site of a CACNA1A RIC pre-mRNA comprising the retained intron 36.

In some embodiments, the ASO targets intron 36 in a CACNA1A RIC pre-mRNA comprising a retained intron 36, wherein the intron numbering correspond to the mRNA sequence at NM_000068. In some embodiments, the ASO targets an intron 36 sequence downstream (or 3') from the 5' splice site of a CACNA1A RIC pre-mRNA comprising the retained intron 36. In some embodiments, the ASO targets an intron 36 sequence about 6 to about 499 nucleotides downstream (or 3') from the 5' splice site of a CACNA1A RIC pre-mRNA comprising the retained intron 36. In some embodiments, the ASO targets an intron 36 sequence upstream (or 5') from the 3' splice site of a CACNA1A RIC pre-mRNA comprising the retained intron 36. In some embodiments, the ASO targets an intron 36 sequence about 16 to about 498 nucleotides upstream (or 5') from the 3' splice site of a CACNA1A RIC pre-mRNA comprising the retained intron 36.

In some embodiments, the ASO targets exon 37 or exon 38 of a CACNA1A RIC pre-mRNA comprising a retained intron 37, wherein the intron numbering correspond to the mRNA sequence at NM_000068. In some embodiments, the ASO targets an exon 37 sequence upstream (or 5') from the 5' splice site of a CACNA1A RIC pre-mRNA comprising the retained intron 37. In some embodiments, the ASO targets an exon 37 sequence about 4 to about 78 nucleotides upstream (or 5') from the 5' splice site of a CACNA1A RIC pre-mRNA comprising the retained intron 37. In some embodiments, the ASO targets an exon 38 sequence downstream (or 3') from the 3' splice site of a CACNA1A RIC pre-mRNA comprising the retained intron 37. In some embodiments, the ASO targets an exon 38 sequence about 2 to about 87 nucleotides downstream (or 3') from the 3' splice site of a CACNA1A RIC pre-mRNA comprising the retained intron 37.

In some embodiments, the ASO targets intron 37 in a CACNA1A RIC pre-mRNA comprising a retained intron 37, wherein the intron numbering correspond to the mRNA sequence at NM_000068. In some embodiments, the ASO targets an intron 37 sequence downstream (or 3') from the 5' splice site of a CACNA1A RIC pre-mRNA comprising the retained intron 37. In some embodiments, the ASO targets an intron 37 sequence about 6 to about 500 nucleotides downstream (or 3') from the 5' splice site of a CACNA1A RIC pre-mRNA comprising the retained intron 37. In some embodiments, the ASO targets an intron 37 sequence upstream (or 5') from the 3' splice site of a CACNA1A RIC pre-mRNA comprising the retained intron 37. In some embodiments, the ASO targets an intron 37 sequence about 16 to about 498 nucleotides upstream (or 5') from the 3' splice site of a CACNA1A RIC pre-mRNA comprising the retained intron 37.

In some embodiments, the ASO targets exon 36 or exon 37 of a CACNA1A RIC pre-mRNA comprising a retained intron 36, wherein the intron numbering correspond to the mRNA sequence at NM_023035. In some embodiments, the ASO targets an exon 36 sequence upstream (or 5') from the 5' splice site of a CACNA1A RIC pre-mRNA comprising the retained intron 36. In some embodiments, the ASO targets an exon 36 sequence about 4 to about 110 nucleotides upstream (or 5') from the 5' splice site of a CACNA1A RIC pre-mRNA comprising the retained intron 36. In some embodiments, the ASO targets an exon 37 sequence downstream (or 3') from the 3' splice site of a CACNA1A RIC pre-mRNA comprising the retained intron 36. In some embodiments, the ASO targets an exon 37 sequence about 2 to about 79 nucleotides downstream (or 3') from the 3' splice site of a CACNA1A RIC pre-mRNA comprising the retained intron 36.

In some embodiments, the ASO targets intron 36 in a CACNA1A RIC pre-mRNA comprising a retained intron 36, wherein the intron numbering correspond to the mRNA sequence at NM_023035. In some embodiments, the ASO targets an intron 36 sequence downstream (or 3') from the 5' splice site of a CACNA1A RIC pre-mRNA comprising the retained intron 36. In some embodiments, the ASO targets an intron 36 sequence about 6 to about 499 nucleotides downstream (or 3') from the 5' splice site of a CACNA1A RIC pre-mRNA comprising the retained intron 36. In some embodiments, the ASO targets an intron 36 sequence upstream (or 5') from the 3' splice site of a CACNA1A RIC pre-mRNA comprising the retained intron 36. In some embodiments, the ASO targets an intron 36 sequence about 16 to about 498 nucleotides upstream (or 5') from the 3' splice site of a CACNA1A RIC pre-mRNA comprising the retained intron 36.

In some embodiments, the ASO targets exon 37 or exon 38 of a CACNA1A RIC pre-mRNA comprising a retained intron 37, wherein the intron numbering correspond to the mRNA sequence at NM_023035. In some embodiments, the ASO targets an exon 37 sequence upstream (or 5') from the 5' splice site of a CACNA1A RIC pre-mRNA comprising the retained intron 37. In some embodiments, the ASO targets an exon 37 sequence about 4 to about 78 nucleotides upstream (or 5') from the 5' splice site of a CACNA1A RIC pre-mRNA comprising the retained intron 37. In some embodiments, the ASO targets an exon 38 sequence downstream (or 3') from the 3' splice site of a CACNA1A RIC pre-mRNA comprising the retained intron 37. In some embodiments, the ASO targets an exon 38 sequence about 2 to about 87 nucleotides downstream (or 3') from the 3' splice site of a CACNA1A RIC pre-mRNA comprising the retained intron 37.

In some embodiments, the ASO targets intron 37 in a CACNA1A RIC pre-mRNA comprising a retained intron 37, wherein the intron numbering correspond to the mRNA sequence at NM_023035. In some embodiments, the ASO targets an intron 37 sequence downstream (or 3') from the 5' splice site of a CACNA1A RIC pre-mRNA comprising the retained intron 37. In some embodiments, the ASO targets an intron 37 sequence about 6 to about 500 nucleotides downstream (or 3') from the 5' splice site of a CACNA1A RIC pre-mRNA comprising the retained intron 37. In some embodiments, the ASO targets an intron 37 sequence upstream (or 5') from the 3' splice site of a CACNA1A RIC pre-mRNA comprising the retained intron 37. In some embodiments, the ASO targets an intron 37 sequence about 16 to about 498 nucleotides upstream (or 5') from the 3' splice site of a CACNA1A RIC pre-mRNA comprising the retained intron 37.

In some embodiments, the ASO targets exon 36 or exon 37 of a CACNA1A RIC pre-mRNA comprising a retained intron 36, wherein the intron numbering correspond to the mRNA sequence at NM_001174080. In some embodiments, the ASO targets an exon 36 sequence upstream (or 5') from the 5' splice site of a CACNA1A RIC pre-mRNA comprising the retained intron 36. In some embodiments, the ASO targets an exon 36 sequence about 4 to about 110 nucleotides upstream (or 5') from the 5' splice site of a CACNA1A RIC pre-mRNA comprising the retained intron 36. In some embodiments, the ASO targets an exon 37 sequence downstream (or 3') from the 3' splice site of a CACNA1A RIC pre-mRNA comprising the retained intron 36. In some embodiments, the ASO targets an exon 37 sequence about 2 to about 79 nucleotides downstream (or 3') from the 3' splice site of a CACNA1A RIC pre-mRNA comprising the retained intron 36.

In some embodiments, the ASO targets intron 36 in a CACNA1A RIC pre-mRNA comprising a retained intron 36, wherein the intron numbering correspond to the mRNA sequence at NM_001174080. In some embodiments, the ASO targets an intron 36 sequence downstream (or 3') from the 5' splice site of a CACNA1A RIC pre-mRNA comprising the retained intron 36. In some embodiments, the ASO targets an intron 36 sequence about 6 to about 499 or about 16 to about 499 nucleotides downstream (or 3') from the 5' splice site of a CACNA1A RIC pre-mRNA comprising the retained intron 36. In some embodiments, the ASO targets an intron 36 sequence upstream (or 5') from the 3' splice site of a CACNA1A RIC pre-mRNA comprising the retained intron 36. In some embodiments, the ASO targets an intron 36 sequence about 16 to about 498 nucleotides upstream (or 5') from the 3' splice site of a CACNA1A RIC pre-mRNA comprising the retained intron 36.

In some embodiments, the ASO targets exon 37 or exon 38 of a CACNA1A RIC pre-mRNA comprising a retained intron 37, wherein the intron numbering correspond to the mRNA sequence at NM_001174080. In some embodiments, the ASO targets an exon 37 sequence upstream (or 5') from the 5' splice site of a CACNA1A RIC pre-mRNA comprising the retained intron 37. In some embodiments, the ASO targets an exon 37 sequence about 4 to about 78 nucleotides upstream (or 5') from the 5' splice site of a CACNA1A RIC pre-mRNA comprising the retained intron 37. In some embodiments, the ASO targets an exon 38 sequence downstream (or 3') from the 3' splice site of a CACNA1A RIC pre-mRNA comprising the retained intron 37. In some embodiments, the ASO targets an exon 38 sequence about 2 to about 87 nucleotides downstream (or 3') from the 3' splice site of a CACNA1A RIC pre-mRNA comprising the retained intron 37.

In some embodiments, the ASO targets intron 37 in a CACNA1A RIC pre-mRNA comprising a retained intron 37, wherein the intron numbering correspond to the mRNA sequence at NM_001174080. In some embodiments, the ASO targets an intron 37 sequence downstream (or 3') from the 5' splice site of a CACNA1A RIC pre-mRNA comprising the retained intron 37. In some embodiments, the ASO targets an intron 37 sequence about 6 to about 500 nucleotides downstream (or 3') from the 5' splice site of a CACNA1A RIC pre-mRNA comprising the retained intron 37. In some embodiments, the ASO targets an intron 37 sequence upstream (or 5') from the 3' splice site of a CACNA1A RIC pre-mRNA comprising the retained intron 37. In some embodiments, the ASO targets an intron 37 sequence about 16 to about 498 nucleotides upstream (or 5') from the 3' splice site of a CACNA1A RIC pre-mRNA comprising the retained intron 37.

In some embodiments, the ASO targets exon 36 or exon 37 of a CACNA1A RIC pre-mRNA comprising a retained intron 36, wherein the intron numbering correspond to the mRNA sequence at NM_001127222. In some embodiments, the ASO targets an exon 36 sequence upstream (or 5') from the 5' splice site of a CACNA1A RIC pre-mRNA comprising the retained intron 36. In some embodiments, the ASO targets an exon 36 sequence about 4 to about 110 or about 14 to about 110 nucleotides upstream (or 5') from the 5' splice site of a CACNA1A RIC pre-mRNA comprising the retained intron 36. In some embodiments, the ASO targets an exon 37 sequence downstream (or 3') from the 3' splice site of a CACNA1A RIC pre-mRNA comprising the retained intron 36. In some embodiments, the ASO targets an exon 37 sequence about 2 to about 79 nucleotides downstream (or 3') from the 3' splice site of a CACNA1A RIC pre-mRNA comprising the retained intron 36.

In some embodiments, the ASO targets intron 36 in a CACNA1A RIC pre-mRNA comprising a retained intron 36, wherein the intron numbering correspond to the mRNA sequence at NM_001127222. In some embodiments, the ASO targets an intron 36 sequence downstream (or 3') from the 5' splice site of a CACNA1A RIC pre-mRNA comprising the retained intron 36. In some embodiments, the ASO targets an intron 36 sequence about 6 to about 499 or about 16 to about 499 nucleotides downstream (or 3') from the 5' splice site of a CACNA1A RIC pre-mRNA comprising the retained intron 36. In some embodiments, the ASO targets an intron 36 sequence upstream (or 5') from the 3' splice site of a CACNA1A RIC pre-mRNA comprising the retained intron 36. In some embodiments, the ASO targets an intron 36 sequence about 16 to about 498 nucleotides upstream (or 5') from the 3' splice site of a CACNA1A RIC pre-mRNA comprising the retained intron 36.

In some embodiments, the ASO targets exon 37 or exon 38 of a CACNA1A RIC pre-mRNA comprising a retained intron 37, wherein the intron numbering correspond to the mRNA sequence at NM_001127222. In some embodiments, the ASO targets an exon 37 sequence upstream (or 5') from the 5' splice site of a CACNA1A RIC pre-mRNA comprising the retained intron 37. In some embodiments, the ASO targets an exon 37 sequence about 4 to about 78 nucleotides upstream (or 5') from the 5' splice site of a CACNA1A RIC pre-mRNA comprising the retained intron 37. In some embodiments, the ASO targets an exon 38 sequence downstream (or 3') from the 3' splice site of a CACNA1A RIC pre-mRNA comprising the retained intron 37. In some embodiments, the ASO targets an exon 38 sequence about 2 to about 87 nucleotides downstream (or 3') from the 3' splice site of a CACNA1A RIC pre-mRNA comprising the retained intron 37.

In some embodiments, the ASO targets intron 37 in a CACNA1A RIC pre-mRNA comprising a retained intron 37, wherein the intron numbering correspond to the mRNA sequence at NM_001127222. In some embodiments, the ASO targets an intron 37 sequence downstream (or 3') from the 5' splice site of a CACNA1A RIC pre-mRNA comprising the retained intron 37. In some embodiments, the ASO targets an intron 37 sequence about 6 to about 500 nucleotides downstream (or 3') from the 5' splice site of a CACNA1A RIC pre-mRNA comprising the retained intron 37. In some embodiments, the ASO targets an intron 37 sequence upstream (or 5') from the 3' splice site of a CACNA1A RIC pre-mRNA comprising the retained intron 37. In some embodiments, the ASO targets an intron 37 sequence about 16 to about 498 nucleotides upstream (or 5') from the 3' splice site of a CACNA1A RIC pre-mRNA comprising the retained intron 37.

In some embodiments, the ASO targets exon 36 or exon 37 of a CACNA1A RIC pre-mRNA comprising a retained intron 36, wherein the intron numbering correspond to the mRNA sequence at NM_001127221. In some embodiments, the ASO targets an exon 36 sequence upstream (or 5') from the 5' splice site of a CACNA1A RIC pre-mRNA comprising the retained intron 36. In some embodiments, the ASO targets an exon 36 sequence about 14 to about 110 nucleotides upstream (or 5') from the 5' splice site of a CACNA1A RIC pre-mRNA comprising the retained intron 36. In some embodiments, the ASO targets an exon 37 sequence downstream (or 3') from the 3' splice site of a CACNA1A RIC pre-mRNA comprising the retained intron 36. In some embodiments, the ASO targets an exon 37 sequence about 2 to about 77 nucleotides downstream (or 3') from the 3' splice site of a CACNA1A RIC pre-mRNA comprising the retained intron 36.

In some embodiments, the ASO targets intron 36 in a CACNA1A RIC pre-mRNA comprising a retained intron 36, wherein the intron numbering correspond to the mRNA sequence at NM_001127221. In some embodiments, the ASO targets an intron 36 sequence downstream (or 3') from the 5' splice site of a CACNA1A RIC pre-mRNA comprising the retained intron 36. In some embodiments, the ASO targets an intron 36 sequence about 6 to about 499 or about 16 to about 499 nucleotides downstream (or 3') from the 5' splice site of a CACNA1A RIC pre-mRNA comprising the retained intron 36. In some embodiments, the ASO targets an intron 36 sequence upstream (or 5') from the 3' splice site of a CACNA1A RIC pre-mRNA comprising the retained intron 36. In some embodiments, the ASO targets an intron 36 sequence about 16 to about 499 or about 21 to about 499 nucleotides upstream (or 5') from the 3' splice site of a CACNA1A RIC pre-mRNA comprising the retained intron 36.

In some embodiments, the ASO targets exon 37 or exon 38 of a CACNA1A RIC pre-mRNA comprising a retained intron 37, wherein the intron numbering correspond to the mRNA sequence at NM_001127221. In some embodiments, the ASO targets an exon 37 sequence upstream (or 5') from the 5' splice site of a CACNA1A RIC pre-mRNA comprising the retained intron 37. In some embodiments, the ASO targets an exon 37 sequence about 4 to about 79 nucleotides upstream (or 5') from the 5' splice site of a CACNA1A RIC pre-mRNA comprising the retained intron 37. In some embodiments, the ASO targets an exon 38 sequence downstream (or 3') from the 3' splice site of a CACNA1A RIC pre-mRNA comprising the retained intron 37. In some embodiments, the ASO targets an exon 38 sequence about 2 to about 87 nucleotides downstream (or 3') from the 3' splice site of a CACNA1A RIC pre-mRNA comprising the retained intron 37.

In some embodiments, the ASO targets intron 37 in a CACNA1A RIC pre-mRNA comprising a retained intron 37, wherein the intron numbering correspond to the mRNA sequence at NM_001127221. In some embodiments, the ASO targets an intron 37 sequence downstream (or 3') from the 5' splice site of a CACNA1A RIC pre-mRNA comprising the retained intron 37. In some embodiments, the ASO targets an intron 37 sequence about 6 to about 500 nucleotides downstream (or 3') from the 5' splice site of a CACNA1A RIC pre-mRNA comprising the retained intron 37. In some embodiments, the ASO targets an intron 37 sequence upstream (or 5') from the 3' splice site of a CACNA1A RIC pre-mRNA comprising the retained intron 37. In some embodiments, the ASO targets an intron 37 sequence about 16 to about 498 nucleotides upstream (or 5') from the 3' splice site of a CACNA1A RIC pre-mRNA comprising the retained intron 37.

In some embodiments, the ASOs disclosed herein target a RIC pre-mRNA transcribed from a DNMT1 genomic sequence. In some embodiments, the ASO targets a RIC pre-mRNA transcript from a DNMT1 genomic sequence comprising a retained intron. In some embodiments, the ASO targets a RIC pre-mRNA transcript of SEQ ID NO: 6289. In some embodiments, the ASO targets a RIC pre-mRNA transcript of SEQ ID NO: 6289 comprising a retained intron. In some embodiments, the ASOs disclosed herein target a DNMT1 RIC pre-mRNA sequence. In some embodiments, the ASO targets a DNMT1 RIC pre-mRNA transcript comprising a retained intron at 14, 29 or a combination thereof, wherein the intron numbering correspond to the mRNA sequence at NM_001379. In some embodiments, the ASO targets a DNMT1 RIC pre-mRNA transcript comprising a retained intron at 15, 30 or a combination thereof, wherein the intron numbering correspond to the mRNA sequence at NM_001130823. In some embodiments, the ASO targets a DNMT1 RIC pre-mRNA transcript comprising a retained intron at 14, 29 or a combination thereof, wherein the intron numbering correspond to the mRNA sequence at NM_001318730. In some embodiments, the ASO targets a DNMT1 RIC pre-mRNA transcript comprising a retained intron at 15, 30 or a combination thereof, wherein the intron numbering correspond to the mRNA sequence at NM_001318731.

In some embodiments, the ASO targets a DNMT1 RIC pre-mRNA sequence according to SEQ ID NO: 6337. In some embodiments, the ASO targets a DNMT1 RIC pre-mRNA sequence according to SEQ ID NO: 6337 comprising a retained intron 14, a retained intron 29, or a combination thereof. In some embodiments, the ASO targets a DNMT1 RIC pre-mRNA sequence according to SEQ ID NO: 6338. In some embodiments, the ASO targets a DNMT1 RIC pre-mRNA sequence according to SEQ ID NO: 6338 comprising a retained intron 15, a retained intron 30, or a combination thereof. In some embodiments, the ASO targets a DNMT1 RIC pre-mRNA sequence according to SEQ ID NO: 6339. In some embodiments, the ASO targets a DNMT1 RIC pre-mRNA sequence according to SEQ ID NO: 6339 comprising a retained intron 14, a retained intron 29, or a combination thereof. In some embodiments, the ASO targets a DNMT1 RIC pre-mRNA sequence according to SEQ ID NO: 6340. In some embodiments, the ASO targets a DNMT1 RIC pre-mRNA sequence according to SEQ ID NO: 6340 comprising a retained intron 15, a retained intron 30, or a combination thereof. In some embodiments, the ASOs disclosed herein target SEQ ID NOs: 30635 or 30644. In some embodiments, the ASO has a sequence according to any one of SEQ ID NOs: 22188-23203.

In some embodiments, the ASO targets exon 29 or exon 30 of a DNMT1 RIC pre-mRNA comprising a retained intron 29, wherein the intron numbering correspond to the mRNA sequence at NM_001379. In some embodiments, the ASO targets an exon 29 sequence upstream (or 5') from the 5' splice site of a DNMT1 RIC pre-mRNA comprising the retained intron 29. In some embodiments, the ASO targets an exon 29 sequence about 4 to about 173 nucleotides upstream (or 5') from the 5' splice site of a DNMT1 RIC pre-mRNA comprising the retained intron 29. In some embodiments, the ASO targets an exon 30 sequence downstream (or 3') from the 3' splice site of a DNMT1 RIC pre-mRNA comprising the retained intron 29. In some embodiments, the ASO targets an exon 30 sequence about 2 to about 67 nucleotides downstream (or 3') from the 3' splice site of a DNMT1 RIC pre-mRNA comprising the retained intron 29.

In some embodiments, the ASO targets intron 29 in a DNMT1 RIC pre-mRNA comprising a retained intron 29, wherein the intron numbering correspond to the mRNA sequence at NM_001379. In some embodiments, the ASO targets an intron 29 sequence downstream (or 3') from the 5' splice site of a DNMT1 RIC pre-mRNA comprising the retained intron 29. In some embodiments, the ASO targets an intron 29 sequence about 6 to about 429 nucleotides downstream (or 3') from the 5' splice site of a DNMT1 RIC pre-mRNA comprising the retained intron 29. In some embodiments, the ASO targets an intron 29 sequence upstream (or 5') from the 3' splice site of a DNMT1 RIC pre-mRNA comprising the retained intron 29. In some embodiments, the ASO targets an intron 29 sequence about 16 to about 433 nucleotides upstream (or 5') from the 3' splice site of a DNMT1 RIC pre-mRNA comprising the retained intron 29.

In some embodiments, the ASO targets exon 14 or exon 15 of a DNMT1 RIC pre-mRNA comprising a retained intron 14, wherein the intron numbering correspond to the mRNA sequence at NM_001379. In some embodiments, the ASO targets an exon 14 sequence upstream (or 5') from the 5' splice site of a DNMT1 RIC pre-mRNA comprising the retained intron 14. In some embodiments, the ASO targets an exon 14 sequence about 4 to about 29 nucleotides upstream (or 5') from the 5' splice site of a DNMT1 RIC pre-mRNA comprising the retained intron 14. In some embodiments, the ASO targets an exon 15 sequence downstream (or 3') from the 3' splice site of a DNMT1 RIC pre-mRNA comprising the retained intron 14. In some embodiments, the ASO targets an exon 15 sequence about 2 to about 62 nucleotides downstream (or 3') from the 3' splice site of a DNMT1 RIC pre-mRNA comprising the retained intron 14.

In some embodiments, the ASO targets intron 14 in a DNMT1 RIC pre-mRNA comprising a retained intron 14, wherein the intron numbering correspond to the mRNA sequence at NM_001379. In some embodiments, the ASO targets an intron 14 sequence downstream (or 3') from the 5' splice site of a DNMT1 RIC pre-mRNA comprising the retained intron 14. In some embodiments, the ASO targets an intron 14 sequence about 6 to about 61 nucleotides downstream (or 3') from the 5' splice site of a DNMT1 RIC pre-mRNA comprising the retained intron 14. In some embodiments, the ASO targets an intron 14 sequence upstream (or 5') from the 3' splice site of a DNMT1 RIC pre-mRNA comprising the retained intron 14. In some embodiments, the ASO targets an intron 14 sequence about 16 to about 61 nucleotides upstream (or 5') from the 3' splice site of a DNMT1 RIC pre-mRNA comprising the retained intron 14.

In some embodiments, the ASO targets exon 30 or exon 31 of a DNMT1 RIC pre-mRNA comprising a retained intron 30, wherein the intron numbering correspond to the mRNA sequence at NM_001130823. In some embodiments, the ASO targets an exon 30 sequence upstream (or 5') from the 5' splice site of a DNMT1 RIC pre-mRNA comprising the retained intron 30. In some embodiments, the ASO targets an exon 30 sequence about 4 to about 173 nucleotides upstream (or 5') from the 5' splice site of a DNMT1 RIC pre-mRNA comprising the retained intron 30. In some embodiments, the ASO targets an exon 31 sequence downstream (or 3') from the 3' splice site of a DNMT1 RIC pre-mRNA comprising the retained intron 30. In some embodiments, the ASO targets an exon 31 sequence about 2 to about 67 nucleotides downstream (or 3') from the 3' splice site of a DNMT1 RIC pre-mRNA comprising the retained intron 30.

In some embodiments, the ASO targets intron 30 in a DNMT1 RIC pre-mRNA comprising a retained intron 30, wherein the intron numbering correspond to the mRNA sequence at NM_001130823. In some embodiments, the ASO targets an intron 30 sequence downstream (or 3') from the 5' splice site of a DNMT1 RIC pre-mRNA comprising the retained intron 30. In some embodiments, the ASO targets an intron 30 sequence about 6 to about 429 or about 11 to about 429 nucleotides downstream (or 3') from the 5' splice site of a DNMT1 RIC pre-mRNA comprising the retained intron 30. In some embodiments, the ASO targets an intron 30 sequence upstream (or 5') from the 3' splice site of a DNMT1 RIC pre-mRNA comprising the retained intron 30. In some embodiments, the ASO targets an intron 30 sequence about 16 to about 433 nucleotides upstream (or 5') from the 3' splice site of a DNMT1 RIC pre-mRNA comprising the retained intron 30.

In some embodiments, the ASO targets exon 15 or exon 16 of a DNMT1 RIC pre-mRNA comprising a retained intron 15, wherein the intron numbering correspond to the mRNA sequence at NM_001130823. In some embodiments, the ASO targets an exon 15 sequence upstream (or 5') from the 5' splice site of a DNMT1 RIC pre-mRNA comprising the retained intron 15. In some embodiments, the ASO targets an exon 15 sequence about 4 to about 29 nucleotides upstream (or 5') from the 5' splice site of a DNMT1 RIC pre-mRNA comprising the retained intron 15. In some embodiments, the ASO targets an exon 16 sequence downstream (or 3') from the 3' splice site of a DNMT1 RIC pre-mRNA comprising the retained intron 15. In some embodiments, the ASO targets an exon 16 sequence about 2 to about 62 nucleotides downstream (or 3') from the 3' splice site of a DNMT1 RIC pre-mRNA comprising the retained intron 15.

In some embodiments, the ASO targets intron 15 in a DNMT1 RIC pre-mRNA comprising a retained intron 15, wherein the intron numbering correspond to the mRNA sequence at NM_001130823. In some embodiments, the ASO targets an intron 15 sequence downstream (or 3') from the 5' splice site of a DNMT1 RIC pre-mRNA comprising the retained intron 15. In some embodiments, the ASO targets an intron 15 sequence about 6 to about 61 nucleotides downstream (or 3') from the 5' splice site of a DNMT1 RIC pre-mRNA comprising the retained intron 15. In some embodiments, the ASO targets an intron 15 sequence upstream (or 5') from the 3' splice site of a DNMT1 RIC pre-mRNA comprising the retained intron 15. In some embodiments, the ASO targets an intron 15 sequence about 16 to about 61 nucleotides upstream (or 5') from the 3' splice site of a DNMT1 RIC pre-mRNA comprising the retained intron 15.

In some embodiments, the ASO targets exon 29 or exon 30 of a DNMT1 RIC pre-mRNA comprising a retained intron 29, wherein the intron numbering correspond to the mRNA sequence at NM_001318730. In some embodiments, the ASO targets an exon 29 sequence upstream (or 5') from the 5' splice site of a DNMT1 RIC pre-mRNA comprising the retained intron 29. In some embodiments, the ASO targets an exon 29 sequence about 4 to about 173 nucleotides upstream (or 5') from the 5' splice site of a DNMT1 RIC pre-mRNA comprising the retained intron 29. In some embodiments, the ASO targets an exon 30 sequence downstream (or 3') from the 3' splice site of a DNMT1 RIC pre-mRNA comprising the retained intron 29. In some embodiments, the ASO targets an exon 30 sequence about 2 to about 67 nucleotides downstream (or 3') from the 3' splice site of a DNMT1 RIC pre-mRNA comprising the retained intron 29.

In some embodiments, the ASO targets intron 29 in a DNMT1 RIC pre-mRNA comprising a retained intron 29, wherein the intron numbering correspond to the mRNA sequence at NM_001318730. In some embodiments, the ASO targets an intron 29 sequence downstream (or 3') from the 5' splice site of a DNMT1 RIC pre-mRNA comprising the retained intron 29. In some embodiments, the ASO targets an intron 29 sequence about 6 to about 429 or about 11 to about 429 nucleotides downstream (or 3') from the 5' splice site of a DNMT1 RIC pre-mRNA comprising the retained intron 29. In some embodiments, the ASO targets an intron 29 sequence upstream (or 5') from the 3' splice site of a DNMT1 RIC pre-mRNA comprising the retained intron 29. In some embodiments, the ASO targets an intron 29 sequence about 16 to about 433 nucleotides upstream (or 5') from the 3' splice site of a DNMT1 RIC pre-mRNA comprising the retained intron 29.

In some embodiments, the ASO targets exon 14 or exon 15 of a DNMT1 RIC pre-mRNA comprising a retained intron 14, wherein the intron numbering correspond to the mRNA sequence at NM_001318730. In some embodiments, the ASO targets an exon 14 sequence upstream (or 5') from the 5' splice site of a DNMT1 RIC pre-mRNA comprising the retained intron 14. In some embodiments, the ASO targets an exon 14 sequence about 4 to about 29 nucleotides upstream (or 5') from the 5' splice site of a DNMT1 RIC pre-mRNA comprising the retained intron 14. In some embodiments, the ASO targets an exon 15 sequence downstream (or 3') from the 3' splice site of a DNMT1 RIC pre-mRNA comprising the retained intron 14. In some embodiments, the ASO targets an exon 15 sequence about 2 to about 62 nucleotides downstream (or 3') from the 3' splice site of a DNMT1 RIC pre-mRNA comprising the retained intron 14.

In some embodiments, the ASO targets intron 14 in a DNMT1 RIC pre-mRNA comprising a retained intron 14, wherein the intron numbering correspond to the mRNA sequence at NM_001318730. In some embodiments, the ASO targets an intron 14 sequence downstream (or 3') from the 5' splice site of a DNMT1 RIC pre-mRNA comprising the retained intron 14. In some embodiments, the ASO targets an intron 14 sequence about 6 to about 61 nucleotides downstream (or 3') from the 5' splice site of a DNMT1 RIC pre-mRNA comprising the retained intron 14. In some embodiments, the ASO targets an intron 14 sequence upstream (or 5') from the 3' splice site of a DNMT1 RIC pre-mRNA comprising the retained intron 14. In some embodiments, the ASO targets an intron 14 sequence about 16 to about 61 nucleotides upstream (or 5') from the 3' splice site of a DNMT1 RIC pre-mRNA comprising the retained intron 14.

In some embodiments, the ASO targets exon 30 or exon 31 of a DNMT1 RIC pre-mRNA comprising a retained intron 30, wherein the intron numbering correspond to the mRNA sequence at NM_001318731. In some embodiments, the ASO targets an exon 30 sequence upstream (or 5') from the 5' splice site of a DNMT1 RIC pre-mRNA comprising the retained intron 30. In some embodiments, the ASO targets an exon 30 sequence about 4 to about 173 nucleotides upstream (or 5') from the 5' splice site of a DNMT1 RIC pre-mRNA comprising the retained intron 30. In some embodiments, the ASO targets an exon 31 sequence downstream (or 3') from the 3' splice site of a DNMT1 RIC pre-mRNA comprising the retained intron 30. In some embodiments, the ASO targets an exon 31 sequence about 2 to about 67 nucleotides downstream (or 3') from the 3' splice site of a DNMT1 RIC pre-mRNA comprising the retained intron 30.

In some embodiments, the ASO targets intron 30 in a DNMT1 RIC pre-mRNA comprising a retained intron 30, wherein the intron numbering correspond to the mRNA sequence at NM_001318731. In some embodiments, the ASO targets an intron 30 sequence downstream (or 3') from the 5' splice site of a DNMT1 RIC pre-mRNA comprising the retained intron 30. In some embodiments, the ASO targets an intron 30 sequence about 6 to about 429 or about 11 to about 429 nucleotides downstream (or 3') from the 5' splice site of a DNMT1 RIC pre-mRNA comprising the retained intron 30. In some embodiments, the ASO targets an intron 30 sequence upstream (or 5') from the 3' splice site of a DNMT1 RIC pre-mRNA comprising the retained intron 30. In some embodiments, the ASO targets an intron 30 sequence about 16 to about 433 nucleotides upstream (or 5') from the 3' splice site of a DNMT1 RIC pre-mRNA comprising the retained intron 30.

In some embodiments, the ASO targets exon 15 or exon 16 of a DNMT1 RIC pre-mRNA comprising a retained intron 15, wherein the intron numbering correspond to the mRNA sequence at NM_001318731. In some embodiments, the ASO targets an exon 15 sequence upstream (or 5') from the 5' splice site of a DNMT1 RIC pre-mRNA comprising the retained intron 15. In some embodiments, the ASO targets an exon 15 sequence about 4 to about 29 nucleotides upstream (or 5') from the 5' splice site of a DNMT1 RIC pre-mRNA comprising the retained intron 15. In some embodiments, the ASO targets an exon 16 sequence downstream (or 3') from the 3' splice site of a DNMT1 RIC pre-mRNA comprising the retained intron 15. In some embodiments, the ASO targets an exon 16 sequence about 2 to about 62 nucleotides downstream (or 3') from the 3' splice site of a DNMT1 RIC pre-mRNA comprising the retained intron 15.

In some embodiments, the ASO targets intron 15 in a DNMT1 RIC pre-mRNA comprising a retained intron 15, wherein the intron numbering correspond to the mRNA sequence at NM_001318731. In some embodiments, the ASO targets an intron 15 sequence downstream (or 3') from the 5' splice site of a DNMT1 RIC pre-mRNA comprising the retained intron 15. In some embodiments, the ASO targets an intron 15 sequence about 6 to about 61 nucleotides downstream (or 3') from the 5' splice site of a DNMT1 RIC pre-mRNA comprising the retained intron 15. In some embodiments, the ASO targets an intron 15 sequence upstream (or 5') from the 3' splice site of a DNMT1 RIC pre-mRNA comprising the retained intron 15. In some embodiments, the ASO targets an intron 15 sequence about 16 to about 61 nucleotides upstream (or 5') from the 3' splice site of a DNMT1 RIC pre-mRNA comprising the retained intron 15.

In some embodiments, the ASOs disclosed herein target a RIC pre-mRNA transcribed from a NF2 genomic sequence. In some embodiments, the ASO targets a RIC pre-mRNA transcript from a NF2 genomic sequence comprising a retained intron. In some embodiments, the ASO targets a RIC pre-mRNA transcript of SEQ ID NO: 6290. In some embodiments, the ASO targets a RIC pre-mRNA transcript of SEQ ID NO: 6290 comprising a retained intron. In some embodiments, the ASOs disclosed herein target a NF2 RIC pre-mRNA sequence. In some embodiments, the ASO targets a NF2 RIC pre-mRNA transcript comprising a retained intron at 14, wherein the intron numbering correspond to the mRNA sequence at NM_181830. In some embodiments, the ASO targets a NF2 RIC pre-mRNA transcript comprising a retained intron at 15, wherein the intron numbering correspond to the mRNA sequence at NM_181829. In some embodiments, the ASO targets a NF2 RIC pre-mRNA transcript comprising a retained intron at 4, wherein the intron numbering correspond to the mRNA sequence at NM_181833. In some embodiments, the ASO targets a NF2 RIC pre-mRNA transcript comprising a retained intron at 16, wherein the intron numbering correspond to the mRNA sequence at NM_181832. In some embodiments, the ASO targets a NF2 RIC pre-mRNA transcript comprising a retained intron at 15, wherein the intron numbering correspond to the mRNA sequence at NM_181828. In some embodiments, the ASO targets a NF2 RIC pre-mRNA transcript comprising a retained intron at 16, wherein the intron numbering correspond to the mRNA sequence at NM_016418. In some embodiments, the ASO targets a NF2 RIC pre-mRNA transcript comprising a retained intron at 15, wherein the intron numbering correspond to the mRNA sequence at NM_000268.

In some embodiments, the ASO targets aNF2 RIC pre-mRNA sequence according to SEQ ID NO: 6341. In some embodiments, the ASO targets a NF2 RIC pre-mRNA sequence according to SEQ ID NO: 6341 comprising a retained intron 14. In some embodiments, the ASO targets aNF2 RIC pre-mRNA sequence according to SEQ ID NO: 6342. In some embodiments, the ASO targets aNF2 RIC pre-mRNA sequence according to SEQ ID NO: 6342 comprising a retained intron 15. In some embodiments, the ASO targets aNF2 RIC pre-mRNA sequence according to SEQ ID NO: 6343. In some embodiments, the ASO targets a NF2 RIC pre-mRNA sequence according to SEQ ID NO: 6343 comprising a retained intron 4. In some embodiments, the ASO targets aNF2 RIC pre-mRNA sequence according to SEQ ID NO: 6344. In some embodiments, the ASO targets aNF2 RIC pre-mRNA sequence according to SEQ ID NO: 6344 comprising a retained intron 16. In some embodiments, the ASO targets aNF2 RIC pre-mRNA sequence according to SEQ ID NO: 6345. In some embodiments, the ASO targets a NF2 RIC pre-mRNA sequence according to SEQ ID NO: 6345 comprising a retained intron 15. In some embodiments, the ASO targets aNF2 RIC pre-mRNA sequence according to SEQ ID NO: 6346. In some embodiments, the ASO targets aNF2 RIC pre-mRNA sequence according to SEQ ID NO: 6346 comprising a retained intron 16. In some embodiments, the ASO targets a NF2 RIC pre-mRNA sequence according to SEQ ID NO: 6347. In some embodiments, the ASO targets a NF2 RIC pre-mRNA sequence according to SEQ ID NO: 6347 comprising a retained intron 15. In some embodiments, the ASOs disclosed herein target SEQ ID NOs: 30646, 30640, 30625, or 30641. In some embodiments, the ASO has a sequence according to any one of SEQ ID NOs: 23204-29620.

In some embodiments, the ASO targets exon 14 or exon 15 of aNF2 RIC pre-mRNA comprising a retained intron 14, wherein the intron numbering correspond to the mRNA sequence at NM_181830. In some embodiments, the ASO targets an exon 14 sequence upstream (or 5') from the 5' splice site of a NF2 RIC pre-mRNA comprising the retained intron 14. In some embodiments, the ASO targets an exon 14 sequence about 4 to about 24 nucleotides upstream (or 5') from the 5' splice site of a NF2 RIC pre-mRNA comprising the retained intron 14. In some embodiments, the ASO targets an exon 15 sequence downstream (or 3') from the 3' splice site of a NF2 RIC pre-mRNA comprising the retained intron 14. In some embodiments, the ASO targets an exon 15 sequence about 2 to about 3828 nucleotides downstream (or 3') from the 3' splice site of a NF2 RIC pre-mRNA comprising the retained intron 14.

In some embodiments, the ASO targets intron 14 in a NF2 RIC pre-mRNA comprising a retained intron 14, wherein the intron numbering correspond to the mRNA sequence at NM_181830. In some embodiments, the ASO targets an intron 14 sequence downstream (or 3') from the 5' splice site of a NF2 RIC pre-mRNA comprising the retained intron 14. In some embodiments, the ASO targets an intron 14 sequence about 6 to about 499 nucleotides downstream (or 3') from the 5' splice site of a NF2 RIC pre-mRNA comprising the retained intron 14. In some embodiments, the ASO targets an intron 14 sequence upstream (or 5') from the 3' splice site of a NF2 RIC pre-mRNA comprising the retained intron 14. In some embodiments, the ASO targets an intron 14 sequence about 16 to about 500 nucleotides upstream (or 5') from the 3' splice site of a NF2 RIC pre-mRNA comprising the retained intron 14.

In some embodiments, the ASO targets exon 15 or exon 16 of aNF2 RIC pre-mRNA comprising a retained intron 15, wherein the intron numbering correspond to the mRNA sequence at NM_181829. In some embodiments, the ASO targets an exon 15 sequence upstream (or 5') from the 5' splice site of a NF2 RIC pre-mRNA comprising the retained intron 15. In some embodiments, the ASO targets an exon 15 sequence about 4 to about 24 nucleotides upstream (or 5') from the 5' splice site of a NF2 RIC pre-mRNA comprising the retained intron 15. In some embodiments, the ASO targets an exon 16 sequence downstream (or 3') from the 3' splice site of a NF2 RIC pre-mRNA comprising the retained intron 15. In some embodiments, the ASO targets an exon 16 sequence about 2 to about 3828 nucleotides downstream (or 3') from the 3' splice site of a NF2 RIC pre-mRNA comprising the retained intron 15.

In some embodiments, the ASO targets intron 15 in a NF2 RIC pre-mRNA comprising a retained intron 15, wherein the intron numbering correspond to the mRNA sequence at NM_181829. In some embodiments, the ASO targets an intron 15 sequence downstream (or 3') from the 5' splice site of a NF2 RIC pre-mRNA comprising the retained intron 15. In some embodiments, the ASO targets an intron 15 sequence about 6 to about 499 nucleotides downstream (or 3') from the 5' splice site of a NF2 RIC pre-mRNA comprising the retained intron 15. In some embodiments, the ASO targets an intron 15 sequence upstream (or 5') from the 3' splice site of a NF2 RIC pre-mRNA comprising the retained intron 15. In some embodiments, the ASO targets an intron 15 sequence about 16 to about 500 nucleotides upstream (or 5') from the 3' splice site of a NF2 RIC pre-mRNA comprising the retained intron 15.

In some embodiments, the ASO targets exon 4 or exon 5 of a NF2 RIC pre-mRNA comprising a retained intron 4, wherein the intron numbering correspond to the mRNA sequence at NM_181833. In some embodiments, the ASO targets an exon 4 sequence upstream (or 5') from the 5' splice site of a NF2 RIC pre-mRNA comprising the retained intron 4. In some embodiments, the ASO targets an exon 4 sequence about 4 to about 64 nucleotides upstream (or 5') from the 5' splice site of a NF2 RIC pre-mRNA comprising the retained intron 4. In some embodiments, the ASO targets an exon 5 sequence downstream (or 3') from the 3' splice site of a NF2 RIC pre-mRNA comprising the retained intron 4. In some embodiments, the ASO targets an exon 5 sequence about 2 to about 3828 nucleotides downstream (or 3') from the 3' splice site of a NF2 RIC pre-mRNA comprising the retained intron 4.

In some embodiments, the ASO targets intron 4 in a NF2 RIC pre-mRNA comprising a retained intron 4, wherein the intron numbering correspond to the mRNA sequence at NM_181833. In some embodiments, the ASO targets an intron 4 sequence downstream (or 3') from the 5' splice site of a NF2 RIC pre-mRNA comprising the retained intron 4. In some embodiments, the ASO targets an intron 4 sequence about 6 to about 496 nucleotides downstream (or 3') from the 5' splice site of a NF2 RIC pre-mRNA comprising the retained intron 4. In some embodiments, the ASO targets an intron 4 sequence upstream (or 5') from the 3' splice site of a NF2 RIC pre-mRNA comprising the retained intron 4. In some embodiments, the ASO targets an intron 4 sequence about 16 to about 500 nucleotides upstream (or 5') from the 3' splice site of a NF2 RIC pre-mRNA comprising the retained intron 4.

In some embodiments, the ASO targets exon 16 or exon 17 of aNF2 RIC pre-mRNA comprising a retained intron 16, wherein the intron numbering correspond to the mRNA sequence at NM_181832. In some embodiments, the ASO targets an exon 16 sequence upstream (or 5') from the 5' splice site of a NF2 RIC pre-mRNA comprising the retained intron 16. In some embodiments, the ASO targets an exon 16 sequence about 4 to about 39 nucleotides upstream (or 5') from the 5' splice site of a NF2 RIC pre-mRNA comprising the retained intron 16. In some embodiments, the ASO targets an exon 17 sequence downstream (or 3') from the 3' splice site of a NF2 RIC pre-mRNA comprising the retained intron 16. In some embodiments, the ASO targets an exon 17 sequence about 2 to about 3828 nucleotides downstream (or 3') from the 3' splice site of a NF2 RIC pre-mRNA comprising the retained intron 16.

In some embodiments, the ASO targets intron 16 in a NF2 RIC pre-mRNA comprising a retained intron 16, wherein the intron numbering correspond to the mRNA sequence at NM_181832. In some embodiments, the ASO targets an intron 16 sequence downstream (or 3') from the 5' splice site of a NF2 RIC pre-mRNA comprising the retained intron 16. In some embodiments, the ASO targets an intron 16 sequence about 6 to about 499 nucleotides downstream (or 3') from the 5' splice site of a NF2 RIC pre-mRNA comprising the retained intron 16. In some embodiments, the ASO targets an intron 16 sequence upstream (or 5') from the 3' splice site of a NF2 RIC pre-mRNA comprising the retained intron 16. In some embodiments, the ASO targets an intron 16 sequence about 16 to about 500 nucleotides upstream (or 5') from the 3' splice site of a NF2 RIC pre-mRNA comprising the retained intron 16.

In some embodiments, the ASO targets exon 15 or exon 16 of a NF2 RIC pre-mRNA comprising a retained intron 15, wherein the intron numbering correspond to the mRNA sequence at NM_181828. In some embodiments, the ASO targets an exon 15 sequence upstream (or 5') from the 5' splice site of a NF2 RIC pre-mRNA comprising the retained intron 15. In some embodiments, the ASO targets an exon 15 sequence about 4 to about 24 nucleotides upstream (or 5') from the 5' splice site of a NF2 RIC pre-mRNA comprising the retained intron 15. In some embodiments, the ASO targets an exon 16 sequence downstream (or 3') from the 3' splice site of a NF2 RIC pre-mRNA comprising the retained intron 15. In some embodiments, the ASO targets an exon 16 sequence about 2 to about 3828 nucleotides downstream (or 3') from the 3' splice site of a NF2 RIC pre-mRNA comprising the retained intron 15.

In some embodiments, the ASO targets intron 15 in a NF2 RIC pre-mRNA comprising a retained intron 15, wherein the intron numbering correspond to the mRNA sequence at NM_181828. In some embodiments, the ASO targets an intron 15 sequence downstream (or 3') from the 5' splice site of a NF2 RIC pre-mRNA comprising the retained intron 15. In some embodiments, the ASO targets an intron 15 sequence about 6 to about 499 nucleotides downstream (or 3') from the 5' splice site of a NF2 RIC pre-mRNA comprising the retained intron 15. In some embodiments, the ASO targets an intron 15 sequence upstream (or 5') from the 3' splice site of a NF2 RIC pre-mRNA comprising the retained intron 15. In some embodiments, the ASO targets an intron 15 sequence about 16 to about 500 nucleotides upstream (or 5') from the 3' splice site of a NF2 RIC pre-mRNA comprising the retained intron 15.

In some embodiments, the ASO targets exon 16 or exon 17 of a NF2 RIC pre-mRNA comprising a retained intron 16, wherein the intron numbering correspond to the mRNA sequence at NM_016418. In some embodiments, the ASO targets an exon 16 sequence upstream (or 5') from the 5' splice site of a NF2 RIC pre-mRNA comprising the retained intron 16. In some embodiments, the ASO targets an exon 16 sequence about 4 to about 24 nucleotides upstream (or 5') from the 5' splice site of a NF2 RIC pre-mRNA comprising the retained intron 16. In some embodiments, the ASO targets an exon 17 sequence downstream (or 3') from the 3' splice site of a NF2 RIC pre-mRNA comprising the retained intron 16. In some embodiments, the ASO targets an exon 17 sequence about 2 to about 3828 nucleotides downstream (or 3') from the 3' splice site of a NF2 RIC pre-mRNA comprising the retained intron 16.

In some embodiments, the ASO targets intron 16 in a NF2 RIC pre-mRNA comprising a retained intron 16, wherein the intron numbering correspond to the mRNA sequence at NM_016418. In some embodiments, the ASO targets an intron 16 sequence downstream (or 3') from the 5' splice site of a NF2 RIC pre-mRNA comprising the retained intron 16. In some embodiments, the ASO targets an intron 16 sequence about 6 to about 499 nucleotides downstream (or 3') from the 5' splice site of a NF2 RIC pre-mRNA comprising the retained intron 16. In some embodiments, the ASO targets an intron 16 sequence upstream (or 5') from the 3' splice site of a NF2 RIC pre-mRNA comprising the retained intron 16. In some embodiments, the ASO targets an intron 16 sequence about 16 to about 500 nucleotides upstream (or 5') from the 3' splice site of a NF2 RIC pre-mRNA comprising the retained intron 16.

In some embodiments, the ASO targets exon 15 or exon 16 of a NF2 RIC pre-mRNA comprising a retained intron 15, wherein the intron numbering correspond to the mRNA sequence at NM_000268. In some embodiments, the ASO targets an exon 15 sequence upstream (or 5') from the 5' splice site of a NF2 RIC pre-mRNA comprising the retained intron 15. In some embodiments, the ASO targets an exon 15 sequence about 4 to about 144 nucleotides upstream (or 5') from the 5' splice site of a NF2 RIC pre-mRNA comprising the retained intron 15. In some embodiments, the ASO targets an exon 16 sequence downstream (or 3') from the 3' splice site of a NF2 RIC pre-mRNA comprising the retained intron 15. In some embodiments, the ASO targets an exon 16 sequence about 2 to about 3828 nucleotides downstream (or 3') from the 3' splice site of a NF2 RIC pre-mRNA comprising the retained intron 15.

In some embodiments, the ASO targets intron 15 in a NF2 RIC pre-mRNA comprising a retained intron 15, wherein the intron numbering correspond to the mRNA sequence at NM_000268. In some embodiments, the ASO targets an intron 15 sequence downstream (or 3') from the 5' splice site of a NF2 RIC pre-mRNA comprising the retained intron 15. In some embodiments, the ASO targets an intron 15 sequence about 6 to about 500 nucleotides downstream (or 3') from the 5' splice site of a NF2 RIC pre-mRNA comprising the retained intron 15. In some embodiments, the ASO targets an intron 15 sequence upstream (or 5') from the 3' splice site of a NF2 RIC pre-mRNA comprising the retained intron 15. In some embodiments, the ASO targets an intron 15 sequence about 16 to about 500 nucleotides upstream (or 5') from the 3' splice site of a NF2 RIC pre-mRNA comprising the retained intron 15.

In some embodiments, the ASOs disclosed herein target a RIC pre-mRNA transcribed from a SHANK3 genomic sequence. In some embodiments, the ASO targets a RIC pre-mRNA transcript from a SHANK3 genomic sequence comprising a retained intron. In some embodiments, the ASO targets a RIC pre-mRNA transcript of SEQ ID NO: 6291. In some embodiments, the ASO targets a RIC pre-mRNA transcript of SEQ ID NO: 6291 comprising a retained intron. In some embodiments, the ASOs disclosed herein target a SHANK3 RIC pre-mRNA sequence. In some embodiments, the ASO targets a SHANK3 RIC pre-mRNA transcript comprising a retained intron at 16, wherein the intron numbering correspond to the mRNA sequence at NM_033517.

In some embodiments, the ASO targets a SHANK3 RIC pre-mRNA sequence according to SEQ ID NO: 6348. In some embodiments, the ASO targets a SHANK3 RIC premRNA sequence according to SEQ ID NO: 6348 comprising a retained intron 16. In some embodiments, the ASOs disclosed herein target SEQ ID NO: 30630. In some embodiments, the ASO has a sequence according to any one of SEQ ID NOs: 29621-29808.

In some embodiments, the ASO targets exon 16 or exon 17 of a SHANK3 RIC pre-mRNA comprising a retained intron 16, wherein the intron numbering correspond to the mRNA sequence at NM_000214. In some embodiments, the ASO targets an exon 16 sequence upstream (or 5') from the 5' splice site of a SHANK3 RIC pre-mRNA comprising the retained intron 16. In some embodiments, the ASO targets an exon 16 sequence about 4 to about 114 nucleotides upstream (or 5') from the 5' splice site of a SHANK3 RIC pre-mRNA comprising the retained intron 16. In some embodiments, the ASO targets an exon 17 sequence downstream (or 3') from the 3' splice site of a SHANK3 RIC pre-mRNA comprising the retained intron 16. In some embodiments, the ASO targets an exon 17 sequence about 2 to about 62 or about 7 to about 62 nucleotides downstream (or 3') from the 3' splice site of a SHANK3 RIC pre-mRNA comprising the retained intron 16.

In some embodiments, the ASO targets intron 16 in a SHANK3 RIC pre-mRNA comprising a retained intron 16, wherein the intron numbering correspond to the mRNA sequence at NM_000214. In some embodiments, the ASO targets an intron 16 sequence downstream (or 3') from the 5' splice site of a SHANK3 RIC pre-mRNA comprising the retained intron 16. In some embodiments, the ASO targets an intron 16 sequence about 6 to about 499 nucleotides downstream (or 3') from the 5' splice site of a SHANK3 RIC pre-mRNA comprising the retained intron 16. In some embodiments, the ASO targets an intron 16 sequence upstream (or 5') from the 3' splice site of a SHANK3 RIC pre-mRNA comprising the retained intron 16. In some embodiments, the ASO targets an intron 16 sequence about 16 to about 498 nucleotides upstream (or 5') from the 3' splice site of a SHANK3 RIC pre-mRNA comprising the retained intron 16.

In some embodiments, the ASOs disclosed herein target a RIC pre-mRNA transcribed from a ARSA genomic sequence. In some embodiments, the ASO targets a RIC pre-mRNA transcript from a ARSA genomic sequence comprising a retained intron. In some embodiments, the ASO targets a RIC pre-mRNA transcript of SEQ ID NO: 6292. In some embodiments, the ASO targets a RIC pre-mRNA transcript of SEQ ID NO: 6292 comprising a retained intron. In some embodiments, the ASOs disclosed herein target a ARSA RIC pre-mRNA sequence. In some embodiments, the ASO targets a ARSA RIC pre-mRNA transcript comprising a retained intron at 2, 3 or a combination thereof, wherein the intron numbering correspond to the mRNA sequence at NM_000487. In some embodiments, the ASO targets a ARSA RIC pre-mRNA transcript comprising a retained intron at 3, 4 or a combination thereof, wherein the intron numbering correspond to the mRNA sequence at NM_001085425. In some embodiments, the ASO targets a ARSA RIC pre-mRNA transcript comprising a retained intron at 3, 4 or a combination thereof, wherein the intron numbering correspond to the mRNA sequence at NM_001085426. In some embodiments, the ASO targets a ARSA RIC pre-mRNA transcript comprising a retained intron at 3, 4 or a combination thereof, wherein the intron numbering correspond to the mRNA sequence at NM_001085427. In some embodiments, the ASO targets a ARSA RIC pre-mRNA transcript comprising a retained intron at 2, 3 or a combination thereof, wherein the intron numbering correspond to the mRNA sequence at NM_001085428.

In some embodiments, the ASO targets a ARSA RIC pre-mRNA sequence according to SEQ ID NO: 6349. In some embodiments, the ASO targets a ARSA RIC pre-mRNA sequence according to SEQ ID NO: 6349 comprising a retained intron 2, a retained intron 3, or a combination thereof. In some embodiments, the ASO targets a ARSA RIC pre-mRNA sequence according to SEQ ID NO: 6350. In some embodiments, the ASO targets a ARSA RIC pre-mRNA sequence according to SEQ ID NO: 6350 comprising a retained intron 3, a retained intron 4, or a combination thereof. In some embodiments, the ASO targets a ARSA RIC pre-mRNA sequence according to SEQ ID NO: 6351. In some embodiments, the ASO targets a ARSA RIC pre-mRNA sequence according to SEQ ID NO: 6351 comprising a retained intron 3, a retained intron 4, or a combination thereof. In some embodiments, the ASO targets a ARSA RIC pre-mRNA sequence according to SEQ ID NO: 6352. In some embodiments, the ASO targets a ARSA RIC pre-mRNA sequence according to SEQ ID NO: 6352 comprising a retained intron 3, a retained intron 4, or a combination thereof. In some embodiments, the ASO targets a ARSA RIC pre-mRNA sequence according to SEQ ID NO: 6353. In some embodiments, the ASO targets a ARSA RIC pre-mRNA sequence according to SEQ ID NO: 6353 comprising a retained intron 2, a retained intron 3, or a combination thereof. In some embodiments, the ASOs disclosed herein target SEQ ID NOs: 30651 or 30651. In some embodiments, the ASO has a sequence according to any one of SEQ ID NOs: 29809-30623.

In some embodiments, the ASO targets exon 2 or exon 3 of a ARSA RIC pre-mRNA comprising a retained intron 2, wherein the intron numbering correspond to the mRNA sequence at NM_000487. In some embodiments, the ASO targets an exon 2 sequence upstream (or 5') from the 5' splice site of a ARSA RIC pre-mRNA comprising the retained intron 2. In some embodiments, the ASO targets an exon 2 sequence about 4 to about 222 nucleotides upstream (or 5') from the 5' splice site of a ARSA RIC pre-mRNA comprising the retained intron 2. In some embodiments, the ASO targets an exon 3 sequence downstream (or 3') from the 3' splice site of a ARSA RIC pre-mRNA comprising the retained intron 2. In some embodiments, the ASO targets an exon 3 sequence about 2 to about 202 or about 7 to about 202 nucleotides downstream (or 3') from the 3' splice site of a ARSA RIC pre-mRNA comprising the retained intron 2.

In some embodiments, the ASO targets intron 2 in a ARSA RIC pre-mRNA comprising a retained intron 2, wherein the intron numbering correspond to the mRNA sequence at NM_000487. In some embodiments, the ASO targets an intron 2 sequence downstream (or 3') from the 5' splice site of a ARSA RIC pre-mRNA comprising the retained intron 2. In some embodiments, the ASO targets an intron 2 sequence about 6 to about 56 nucleotides downstream (or 3') from the 5' splice site of a ARSA RIC pre-mRNA comprising the retained intron 2. In some embodiments, the ASO targets an intron 2 sequence upstream (or 5') from the 3' splice site of a ARSA RIC pre-mRNA comprising the retained intron 2. In some embodiments, the ASO targets an intron 2 sequence about 16 to about 71 nucleotides upstream (or 5') from the 3' splice site of a ARSA RIC pre-mRNA comprising the retained intron 2.

In some embodiments, the ASO targets exon 3 or exon 4 of a ARSA RIC pre-mRNA comprising a retained intron 3, wherein the intron numbering correspond to the mRNA sequence at NM_000487. In some embodiments, the ASO targets an exon 3 sequence upstream (or 5') from the 5' splice site of a ARSA RIC pre-mRNA comprising the retained intron 3. In some embodiments, the ASO targets an exon 3 sequence about 4 to about 199 nucleotides upstream (or 5') from the 5' splice site of a ARSA RIC pre-mRNA comprising the retained intron 3. In some embodiments, the ASO targets an exon 4 sequence downstream (or 3') from the 3' splice site of a ARSA RIC pre-mRNA comprising the retained intron 3. In some embodiments, the ASO targets an exon 4 sequence about 2 to about 152 nucleotides downstream (or 3') from the 3' splice site of a ARSA RIC pre-mRNA comprising the retained intron 3.

In some embodiments, the ASO targets intron 3 in a ARSA RIC pre-mRNA comprising a retained intron 3, wherein the intron numbering correspond to the mRNA sequence at NM_000487. In some embodiments, the ASO targets an intron 3 sequence downstream (or 3') from the 5' splice site of a ARSA RIC pre-mRNA comprising the retained intron 3. In some embodiments, the ASO targets an intron 3 sequence about 6 to about 49 nucleotides downstream (or 3') from the 5' splice site of a ARSA RIC pre-mRNA comprising the retained intron 3. In some embodiments, the ASO targets an intron 3 sequence upstream (or 5') from the 3' splice site of a ARSA RIC pre-mRNA comprising the retained intron 3. In some embodiments, the ASO targets an intron 3 sequence about 16 to about 35 nucleotides upstream (or 5') from the 3' splice site of a ARSA RIC pre-mRNA comprising the retained intron 3.

In some embodiments, the ASO targets exon 3 or exon 4 of a ARSA RIC pre-mRNA comprising a retained intron 3, wherein the intron numbering correspond to the mRNA sequence at NM_001085425. In some embodiments, the ASO targets an exon 3 sequence upstream (or 5') from the 5' splice site of a ARSA RIC pre-mRNA comprising the retained intron 3. In some embodiments, the ASO targets an exon 3 sequence about 4 to about 222 nucleotides upstream (or 5') from the 5' splice site of a ARSA RIC pre-mRNA comprising the retained intron 3. In some embodiments, the ASO targets an exon 4 sequence downstream (or 3') from the 3' splice site of a ARSA RIC pre-mRNA comprising the retained intron 3. In some embodiments, the ASO targets an exon 4 sequence about 2 to about 202 or about 7 to about 202 nucleotides downstream (or 3') from the 3' splice site of a ARSA RIC pre-mRNA comprising the retained intron 3.

In some embodiments, the ASO targets intron 3 in a ARSA RIC pre-mRNA comprising a retained intron 3, wherein the intron numbering correspond to the mRNA sequence at NM_001085425. In some embodiments, the ASO targets an intron 3 sequence downstream (or 3') from the 5' splice site of a ARSA RIC pre-mRNA comprising the retained intron 3. In some embodiments, the ASO targets an intron 3 sequence about 6 to about 56 nucleotides downstream (or 3') from the 5' splice site of a ARSA RIC pre-mRNA comprising the retained intron 3. In some embodiments, the ASO targets an intron 3 sequence upstream (or 5') from the 3' splice site of a ARSA RIC pre-mRNA comprising the retained intron 3. In some embodiments, the ASO targets an intron 3 sequence about 16 to about 71 nucleotides upstream (or 5') from the 3' splice site of a ARSA RIC pre-mRNA comprising the retained intron 3.

In some embodiments, the ASO targets exon 4 or exon 5 of a ARSA RIC pre-mRNA comprising a retained intron 4, wherein the intron numbering correspond to the mRNA sequence at NM_001085425. In some embodiments, the ASO targets an exon 4 sequence upstream (or 5') from the 5' splice site of a ARSA RIC pre-mRNA comprising the retained intron 4. In some embodiments, the ASO targets an exon 4 sequence about 4 to about 199 nucleotides upstream (or 5') from the 5' splice site of a ARSA RIC pre-mRNA comprising the retained intron 4. In some embodiments, the ASO targets an exon 5 sequence downstream (or 3') from the 3' splice site of a ARSA RIC pre-mRNA comprising the retained intron 4. In some embodiments, the ASO targets an exon 5 sequence about 2 to about 152 nucleotides downstream (or 3') from the 3' splice site of a ARSA RIC pre-mRNA comprising the retained intron 4.

In some embodiments, the ASO targets intron 4 in a ARSA RIC pre-mRNA comprising a retained intron 4, wherein the intron numbering correspond to the mRNA sequence at NM_001085425. In some embodiments, the ASO targets an intron 4 sequence downstream (or 3') from the 5' splice site of a ARSA RIC pre-mRNA comprising the retained intron 4. In some embodiments, the ASO targets an intron 4 sequence about 5 to about 49 or about 6 to about 49 nucleotides downstream (or 3') from the 5' splice site of a ARSA RIC pre-mRNA comprising the retained intron 4. In some embodiments, the ASO targets an intron 4 sequence upstream (or 5') from the 3' splice site of a ARSA RIC pre-mRNA comprising the retained intron 4. In some embodiments, the ASO targets an intron 4 sequence about 16 to about 35 nucleotides upstream (or 5') from the 3' splice site of a ARSA RIC pre-mRNA comprising the retained intron 4.

In some embodiments, the ASO targets exon 3 or exon 4 of a ARSA RIC pre-mRNA comprising a retained intron 3, wherein the intron numbering correspond to the mRNA sequence at NM_001085426. In some embodiments, the ASO targets an exon 3 sequence upstream (or 5') from the 5' splice site of a ARSA RIC pre-mRNA comprising the retained intron 3. In some embodiments, the ASO targets an exon 3 sequence about 4 to about 222 nucleotides upstream (or 5') from the 5' splice site of a ARSA RIC pre-mRNA comprising the retained intron 3. In some embodiments, the ASO targets an exon 4 sequence downstream (or 3') from the 3' splice site of a ARSA RIC pre-mRNA comprising the retained intron 3. In some embodiments, the ASO targets an exon 4 sequence about 2 to about 202 or about 7 to about 202 nucleotides downstream (or 3') from the 3' splice site of a ARSA RIC pre-mRNA comprising the retained intron 3.

In some embodiments, the ASO targets intron 3 in a ARSA RIC pre-mRNA comprising a retained intron 3, wherein the intron numbering correspond to the mRNA sequence at NM_001085426. In some embodiments, the ASO targets an intron 3 sequence downstream (or 3') from the 5' splice site of a ARSA RIC pre-mRNA comprising the retained intron 3. In some embodiments, the ASO targets an intron 3 sequence about 6 to about 56 nucleotides downstream (or 3') from the 5' splice site of a ARSA RIC pre-mRNA comprising the retained intron 3. In some embodiments, the ASO targets an intron 3 sequence upstream (or 5') from the 3' splice site of a ARSA RIC pre-mRNA comprising the retained intron 3. In some embodiments, the ASO targets an intron 3 sequence about 16 to about 71 nucleotides upstream (or 5') from the 3' splice site of a ARSA RIC pre-mRNA comprising the retained intron 3.

In some embodiments, the ASO targets exon 4 or exon 5 of a ARSA RIC pre-mRNA comprising a retained intron 4, wherein the intron numbering correspond to the mRNA sequence at NM_001085426. In some embodiments, the ASO targets an exon 4 sequence upstream (or 5') from the 5' splice site of a ARSA RIC pre-mRNA comprising the retained intron 4. In some embodiments, the ASO targets an exon 4 sequence about 4 to about 199 nucleotides upstream (or 5') from the 5' splice site of a ARSA RIC pre-mRNA comprising the retained intron 4. In some embodiments, the ASO targets an exon 5 sequence downstream (or 3') from the 3' splice site of a ARSA RIC pre-mRNA comprising the retained intron 4. In some embodiments, the ASO targets an exon 5 sequence about 2 to about 152 nucleotides downstream (or 3') from the 3' splice site of a ARSA RIC pre-mRNA comprising the retained intron 4.

In some embodiments, the ASO targets intron 4 in a ARSA RIC pre-mRNA comprising a retained intron 4, wherein the intron numbering correspond to the mRNA sequence at NM_001085426. In some embodiments, the ASO targets an intron 4 sequence downstream (or 3') from the 5' splice site of a ARSA RIC pre-mRNA comprising the retained intron 4. In some embodiments, the ASO targets an intron 4 sequence about 5 to about 49 or about 6 to about 49 nucleotides downstream (or 3') from the 5' splice site of a ARSA RIC pre-mRNA comprising the retained intron 4. In some embodiments, the ASO targets an intron 4 sequence upstream (or 5') from the 3' splice site of a ARSA RIC pre-mRNA comprising the retained intron 4. In some embodiments, the ASO targets an intron 4 sequence about 16 to about 35 nucleotides upstream (or 5') from the 3' splice site of a ARSA RIC pre-mRNA comprising the retained intron 4.

In some embodiments, the ASO targets exon 3 or exon 4 of a ARSA RIC pre-mRNA comprising a retained intron 3, wherein the intron numbering correspond to the mRNA sequence at NM_001085427. In some embodiments, the ASO targets an exon 3 sequence upstream (or 5') from the 5' splice site of a ARSA RIC pre-mRNA comprising the retained intron 3. In some embodiments, the ASO targets an exon 3 sequence about 4 to about 222 nucleotides upstream (or 5') from the 5' splice site of a ARSA RIC pre-mRNA comprising the retained intron 3. In some embodiments, the ASO targets an exon 4 sequence downstream (or 3') from the 3' splice site of a ARSA RIC pre-mRNA comprising the retained intron 3. In some embodiments, the ASO targets an exon 4 sequence about 2 to about 202 or about 7 to about 202 nucleotides downstream (or 3') from the 3' splice site of a ARSA RIC pre-mRNA comprising the retained intron 3.

In some embodiments, the ASO targets intron 3 in a ARSA RIC pre-mRNA comprising a retained intron 3, wherein the intron numbering correspond to the mRNA sequence at NM_001085427. In some embodiments, the ASO targets an intron 3 sequence downstream (or 3') from the 5' splice site of a ARSA RIC pre-mRNA comprising the retained intron 3. In some embodiments, the ASO targets an intron 3 sequence about 6 to about 56 nucleotides downstream (or 3') from the 5' splice site of a ARSA RIC pre-mRNA comprising the retained intron 3. In some embodiments, the ASO targets an intron 3 sequence upstream (or 5') from the 3' splice site of a ARSA RIC pre-mRNA comprising the retained intron 3. In some embodiments, the ASO targets an intron 3 sequence about 16 to about 71 nucleotides upstream (or 5') from the 3' splice site of a ARSA RIC pre-mRNA comprising the retained intron 3.

In some embodiments, the ASO targets exon 4 or exon 5 of a ARSA RIC pre-mRNA comprising a retained intron 4, wherein the intron numbering correspond to the mRNA sequence at NM_001085427. In some embodiments, the ASO targets an exon 4 sequence upstream (or 5') from the 5' splice site of a ARSA RIC pre-mRNA comprising the retained intron 4. In some embodiments, the ASO targets an exon 4 sequence about 4 to about 199 nucleotides upstream (or 5') from the 5' splice site of a ARSA RIC pre-mRNA comprising the retained intron 4. In some embodiments, the ASO targets an exon 5 sequence downstream (or 3') from the 3' splice site of a ARSA RIC pre-mRNA comprising the retained intron 4. In some embodiments, the ASO targets an exon 5 sequence about 2 to about 152 nucleotides downstream (or 3') from the 3' splice site of a ARSA RIC pre-mRNA comprising the retained intron 4.

In some embodiments, the ASO targets intron 4 in a ARSA RIC pre-mRNA comprising a retained intron 4, wherein the intron numbering correspond to the mRNA sequence at NM_001085427. In some embodiments, the ASO targets an intron 4 sequence downstream (or 3') from the 5' splice site of a ARSA RIC pre-mRNA comprising the retained intron 4. In some embodiments, the ASO targets an intron 4 sequence about 5 to about 49 or about 6 to about 49 nucleotides downstream (or 3') from the 5' splice site of a ARSA RIC pre-mRNA comprising the retained intron 4. In some embodiments, the ASO targets an intron 4 sequence upstream (or 5') from the 3' splice site of a ARSA RIC pre-mRNA comprising the retained intron 4. In some embodiments, the ASO targets an intron 4 sequence about 16 to about 35 nucleotides upstream (or 5') from the 3' splice site of a ARSA RIC pre-mRNA comprising the retained intron 4.

In some embodiments, the ASO targets exon 2 or exon 3 of a ARSA RIC pre-mRNA comprising a retained intron 2, wherein the intron numbering correspond to the mRNA sequence at NM_001085428. In some embodiments, the ASO targets an exon 2 sequence upstream (or 5') from the 5' splice site of a ARSA RIC pre-mRNA comprising the retained intron 2. In some embodiments, the ASO targets an exon 2 sequence about 4 to about 222 nucleotides upstream (or 5') from the 5' splice site of a ARSA RIC pre-mRNA comprising the retained intron 2. In some embodiments, the ASO targets an exon 3 sequence downstream (or 3') from the 3' splice site of a ARSA RIC pre-mRNA comprising the retained intron 2. In some embodiments, the ASO targets an exon 3 sequence about 2 to about 202 or about 7 to about 202 nucleotides downstream (or 3') from the 3' splice site of a ARSA RIC pre-mRNA comprising the retained intron 2.

In some embodiments, the ASO targets intron 2 in a ARSA RIC pre-mRNA comprising a retained intron 2, wherein the intron numbering correspond to the mRNA sequence at NM_001085428. In some embodiments, the ASO targets an intron 2 sequence downstream (or 3') from the 5' splice site of a ARSA RIC pre-mRNA comprising the retained intron 2. In some embodiments, the ASO targets an intron 2 sequence about 6 to about 56 nucleotides downstream (or 3') from the 5' splice site of a ARSA RIC pre-mRNA comprising the retained intron 2. In some embodiments, the ASO targets an intron 2 sequence upstream (or 5') from the 3' splice site of a ARSA RIC pre-mRNA comprising the retained intron 2. In some embodiments, the ASO targets an intron 2 sequence about 16 to about 71 nucleotides upstream (or 5') from the 3' splice site of a ARSA RIC pre-mRNA comprising the retained intron 2.

In some embodiments, the ASO targets exon 3 or exon 4 of a ARSA RIC pre-mRNA comprising a retained intron 3, wherein the intron numbering correspond to the mRNA sequence at NM_001085428. In some embodiments, the ASO targets an exon 3 sequence upstream (or 5') from the 5' splice site of a ARSA RIC pre-mRNA comprising the retained intron 3. In some embodiments, the ASO targets an exon 3 sequence about 4 to about 199 nucleotides upstream (or 5') from the 5' splice site of a ARSA RIC pre-mRNA comprising the retained intron 3. In some embodiments, the ASO targets an exon 4 sequence downstream (or 3') from the 3' splice site of a ARSA RIC pre-mRNA comprising the retained intron 3. In some embodiments, the ASO targets an exon 4 sequence about 2 to about 152 nucleotides downstream (or 3') from the 3' splice site of a ARSA RIC pre-mRNA comprising the retained intron 3.

In some embodiments, the ASO targets intron 3 in a ARSA RIC pre-mRNA comprising a retained intron 3, wherein the intron numbering correspond to the mRNA sequence at NM_001085428. In some embodiments, the ASO targets an intron 3 sequence downstream (or 3') from the 5' splice site of a ARSA RIC pre-mRNA comprising the retained intron 3. In some embodiments, the ASO targets an intron 3 sequence about 5 to about 49 or about 6 to about 49 nucleotides downstream (or 3') from the 5' splice site of a ARSA RIC pre-mRNA comprising the retained intron 3. In some embodiments, the ASO targets an intron 3 sequence upstream (or 5') from the 3' splice site of a ARSA RIC pre-mRNA comprising the retained intron 3. In some embodiments, the ASO targets an intron 3 sequence about 16 to about 35 nucleotides upstream (or 5') from the 3' splice site of a ARSA RIC pre-mRNA comprising the retained intron 3.

In embodiments, the targeted portion of the MFSD8 RIC pre-mRNA is in intron 12. The MFSD8 intron numbering used herein corresponds to the mRNA sequence at NM_152778. In embodiments, the percent retained intron can be 42. In embodiments, hybridization of an ASO to the targeted portion of the RIC pre-mRNA results in enhanced splicing at the splice site (5' splice site or 3' splice site) of retained intron 12 and subsequently increases MFSD8 protein production. It is understood that the intron numbering may change in reference to a different MFSD8 isoform sequence. One of skill in the art can determine the corresponding intron number in any isoform based on an intron sequence provided herein or using the number provided in reference to the mRNA sequence at NM_152778. One of skill in the art also can determine the sequences of flanking exons in any MFSD8 isoform for targeting using the methods of the invention, based on an intron sequence provided herein or using the intron number provided in reference to the mRNA sequence at NM_152778.

In embodiments, the targeted portion of the IDUA RIC pre-mRNA is in intron 3, 4, 5, 6 or 7. The IDUA intron numbering used herein corresponds to the mRNA sequence at NM_000203. In embodiments, the percent retained intron can be 25, 63 or 16. In embodiments, hybridization of an ASO to the targeted portion of the RIC pre-mRNA results in enhanced splicing at the splice site (5' splice site or 3' splice site) of retained intron 3, 4, 5, 6 or 7 and subsequently increases IDUA protein production. It is understood that the intron numbering may change in reference to a different IDUA isoform sequence. One of skill in the art can determine the corresponding intron number in any isoform based on an intron sequence provided herein or using the number provided in reference to the mRNA sequence at NM_000203. One of skill in the art also can determine the sequences of flanking exons in any IDUA isoform for targeting using the methods of the invention, based on an intron sequence provided herein or using the intron number provided in reference to the mRNA sequence at NM_000203.

In embodiments, the targeted portion of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B pre-mRNA is in intron 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37 or 38. In embodiments, hybridization of an ASO to the targeted portion of the RIC pre-mRNA results in enhanced splicing at the splice site (5' splice site or 3' splice site) of at least one of retained introns 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37 or 38, and subsequently increases ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein production.

In embodiments, the targeted portion of the ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B pre-mRNA is in intron 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37 or 38. In embodiments, hybridization of an ASO to the targeted portion of the RIC pre-mRNA results in enhanced splicing at the splice site (5' splice site or 3' splice site) of at least one of retained introns 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37 or 38, and subsequently increases ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein production.

In some cases, the targeted portion of the ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B pre-mRNA is in intron 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37 or 38. In embodiments, hybridization of an ASO to the targeted portion of the RIC pre-mRNA results in enhanced splicing at the splice site (5' splice site or 3' splice site) of at least one of retained introns 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37 or 38, and subsequently increases ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B protein production.

The degree of intron retention can be expressed as percent intron retention (PIR), the percentage of transcripts in which a given intron is retained. In brief, PIR can be calculated as the percentage of the average number of reads mapping to the exon-intron junctions, over the sum of the average of the exon-intron junction reads plus the exon-exon junction reads. PIR values for SCN1A have been reported, e.g., by Braunschweig, et al., 2014, (see, e.g., Supplemental Table S9), incorporated by reference herein in its entirety.

In embodiments, the methods described herein are used to increase the production of a functional ATP1A2, CACNA1A, SETD5, SHANK3, NF2, DNMT1, TCF4, RAI1, PEX1, ARSA, EIF2B5, EIF2B2, NPC1, ADAR, MFSD8, STXBP1, PRICKLE2, PRRT2, IDUA, STX1B protein, or any combinations thereof. As used herein, the term "functional" refers to the amount of activity or function of a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, STX1B protein or any combination thereof that is necessary to eliminate any one or more symptoms of a treated condition. In embodiments, the methods are used to increase the production of a partially functional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, STX1B protein or any combination thereof. As used herein, the term "partially functional" refers to any amount of activity or function of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein that is less than the amount of activity or function that is necessary to eliminate or prevent any one or more symptoms of a disease or condition. In some embodiments, a partially functional protein or RNA will have at least 10%, at least 20%, at least 30%, at least 40%, at least 50%, at least 60%, at least 70%, at least 75%, at least 80%, 85%, at least 90%, or at least 95% less activity relative to the fully functional protein or RNA.

In embodiments, the method is a method of increasing the expression of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, STX1B protein or any combination thereof by cells of a subject having a RIC pre-mRNA encoding the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, wherein the subject has a deficient amount of activity of ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, and wherein the deficient amount of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein is caused by haploinsufficiency of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein. In such an embodiment, the subject has a first allele encoding a functional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, and a second allele from which the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein is not produced. In another such embodiment, the subject has a first allele encoding a functional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, and a second allele encoding a nonfunctional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein. In another such embodiment, the subject has a first allele encoding a functional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, and a second allele encoding a partially functional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein. In any of these embodiments, the antisense oligomer binds to a targeted portion of the RIC pre-mRNA transcribed from the first allele (encoding functional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein), thereby inducing constitutive splicing of the retained intron from the RIC pre-mRNA, and causing an increase in the level of mature mRNA encoding functional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, and an increase in the expression of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein in the cells of the subject.

In embodiments, the subject has a first allele encoding a functional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, and a second allele encoding a partially functional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, and the antisense oligomer binds to a targeted portion of the RIC pre-mRNA transcribed from the first allele (encoding functional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein) or a targeted portion of the RIC pre-mRNA transcribed from the second allele (encoding partially functional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein), thereby inducing constitutive splicing of the retained intron from the RIC pre-mRNA, and causing an increase in the level of mature mRNA encoding the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, and an increase in the expression of functional or partially functional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein in the cells of the subject.

In some instances, the subject has a first allele encoding a functional ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein, and a second allele encoding a partially functional ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein, and the antisense oligomer binds to a targeted portion of the RIC pre-mRNA transcribed from the first allele (encoding functional ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein) or a targeted portion of the RIC pre-mRNA transcribed from the second allele (encoding partially functional ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein), thereby inducing constitutive splicing of the retained intron from the RIC pre-mRNA, and causing an increase in the level of mature mRNA encoding the ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein, and an increase in the expression of functional or partially functional ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein in the cells of the subject.

In related embodiments, the method is a method of using an ASO to increase the expression of a protein or functional RNA. In embodiments, an ASO is used to increase the expression of ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein in cells of a subject having a RIC pre-mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, wherein the subject has a deficiency in the amount or function of a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein.

In related embodiments, the method is a method of using an ASO to increase the expression of a protein or functional RNA. In embodiments, an ASO is used to increase the expression of ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein in cells of a subject having a RIC pre-mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein, wherein the subject has a deficiency in the amount or function of a ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein.

In embodiments, the RIC pre-mRNA transcript that encodes the protein that is causative of the disease or condition is targeted by the ASOs described herein. In some embodiments, a RIC pre-mRNA transcript that encodes a protein that is not causative of the disease is targeted by the ASOs. For example, a disease that is the result of a mutation or deficiency of a first protein in a particular pathway may be ameliorated by targeting a RIC pre-mRNA that encodes a second protein, thereby increasing production of the second protein. In some embodiments, the function of the second protein is able to compensate for the mutation or deficiency of the first protein (which is causative of the disease or condition).

In embodiments, the subject has:
a. a first mutant allele from which
  i) the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein is produced at a reduced level compared to production from a wild-type allele,
  ii) the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein is produced in a form having reduced function compared to an equivalent wild-type protein, or
  iii) the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein or functional RNA is not produced; and
b. a second mutant allele from which
  i) the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein is produced at a reduced level compared to production from a wild-type allele,
  ii) the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein is produced in a form having reduced function compared to an equivalent wild-type protein, or
  iii) the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein is not produced, and wherein the RIC pre-mRNA is transcribed from the first allele and/or the second allele. In these embodiments, the ASO binds to a targeted portion of the RIC pre-mRNA transcribed from the first allele or the second allele, thereby inducing constitutive splicing of the retained intron from the RIC pre-mRNA, and causing an increase in the level of mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein and an increase in the expression of the target protein or functional RNA in the cells of the subject. In these embodiments, the target protein or functional RNA having an increase in expression level resulting from the constitutive splicing of the retained intron from the RIC pre-mRNA is either in a form having reduced function compared to the equivalent wild-type protein (partially-functional), or having full function compared to the equivalent wild-type protein (fully-functional).

In embodiments, the level of mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, STX1B protein or any combination thereof is increased 1.1 to 10-fold, when compared to the amount of mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B that is produced in a control cell, e.g., one that is not treated with the antisense oligomer or one that is treated with an antisense oligomer that does not bind to the targeted portion of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA.

In embodiments, the condition caused by a deficient amount or activity of ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein is not a condition caused by alternative or aberrant splicing of the retained intron to which the ASO is targeted. In embodiments, the condition caused by a deficient amount or activity of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein is not a condition caused by alternative or aberrant splicing of any retained intron in a RIC pre-mRNA encoding the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein. In embodiments, alternative or aberrant splicing may occur in a pre-mRNA transcribed from the gene, however the compositions and methods of the invention do not prevent or correct this alternative or aberrant splicing.

In some cases, the condition caused by a deficient amount or activity of ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein is not a condition caused by alternative or aberrant splicing of the retained intron to which the ASO is targeted. In embodiments, the condition caused by a deficient amount or activity of the ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein is not a condition caused by alternative or aberrant splicing of any retained intron in a RIC pre-mRNA encoding the ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein. In embodiments, alternative or aberrant splicing may occur in a pre-mRNA transcribed from the gene, however the compositions and methods of the invention do not prevent or correct this alternative or aberrant splicing.

In some instances, the condition caused by a deficient amount or activity of ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B protein is not a condition caused by alternative or aberrant splicing of the retained intron to which the ASO is targeted. In embodiments, the condition caused by a deficient amount or activity of the ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B protein is not a condition caused by alternative or aberrant splicing of any retained intron in a RIC pre-mRNA encoding the ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B protein. In embodiments, alternative or aberrant splicing may occur in a pre-mRNA transcribed from the gene, however the compositions and methods of the invention do not prevent or correct this alternative or aberrant splicing.

In embodiments, a subject treated using the methods of the invention expresses a partially functional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein from one allele, wherein the partially functional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein is caused by a frameshift mutation, a nonsense mutation, a missense mutation, or a partial gene deletion. In embodiments, a subject treated using the methods of the invention expresses a nonfunctional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein from one allele, wherein the nonfunctional ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein is caused by a frameshift mutation, a nonsense mutation, a missense mutation, a partial gene deletion, in one allele. In embodiments, a subject treated using the methods of the invention has a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B whole gene deletion, in one allele.

In some cases, a subject treated using the methods of the invention expresses a partially functional ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein from one allele, wherein the partially functional ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein is caused by a frameshift mutation, a nonsense mutation, a missense mutation, or a partial gene deletion. In embodiments, a subject treated using the methods of the invention expresses a nonfunctional ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein from one allele, wherein the nonfunctional ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B protein is caused by a frameshift mutation, a nonsense mutation, a missense mutation, a partial gene deletion, in one allele. In embodiments, a subject treated using the methods of the invention has a ATP1A2, CACNA1A, SETD5, SHANK3, NF2, DNMT1, TCF4, RAI1, PEX1, ARSA, EIF2B5, EIF2B1, EIF2B2, NPC1, ADAR, STXBP1, PRICKLE2, PRRT2, or STX1B whole gene deletion, in one allele.

In some instances, a subject treated using the methods of the invention expresses a partially functional ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B protein from one allele, wherein the partially functional ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B protein is caused by a frameshift mutation, a nonsense mutation, a missense mutation, or a partial gene deletion. In embodiments, a subject treated using the methods of the invention expresses a nonfunctional ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B protein from one allele, wherein the nonfunctional ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B protein is caused by a frameshift mutation, a nonsense mutation, a missense mutation, a partial gene deletion, in one allele. In embodiments, a subject treated using the methods of the invention has a ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B whole gene deletion, in one allele.

Use of TANGO for Increasing Protein Expression

As described above, in embodiments, Targeted Augmentation of Nuclear Gene Output (TANGO) can be used in the methods of the invention to increase expression of a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, STX1B protein or any combinations thereof. In these embodiments, a retained-intron-containing pre-mRNA (RIC pre-mRNA) encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, STX1B protein or any combination thereof is present in the nucleus of a cell. Cells having a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA that comprises a retained intron, an exon flanking the 5' splice site, and an exon flanking the 3' splice site, encoding the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, can be contacted with antisense oligomers (ASOs) that are complementary to a targeted portion of the RIC pre-mRNA. Hybridization of the ASOs to the targeted portion of the RIC pre-mRNA can result in enhanced splicing at the splice site (5' splice site or 3' splice site) of the retained intron and subsequently increases target protein production.

The terms "pre-mRNA," and "pre-mRNA transcript" may be used interchangeably and refer to any pre-mRNA species that contains at least one intron. In embodiments, pre-mRNA or pre-mRNA transcripts comprise a 5'-7-methylguanosine cap and/or a poly-A tail. In embodiments, pre-mRNA or pre-mRNA transcripts comprise both a 5'-7-methylguanosine cap and a poly-A tail. In some embodiments, the pre-mRNA transcript does not comprise a 5'-7-methylguanosine cap and/or a poly-A tail. A pre-mRNA transcript is a non-productive messenger RNA (mRNA) molecule if it is not translated into a protein (or transported into the cytoplasm from the nucleus).

As used herein, a "retained-intron-containing pre-mRNA" ("RIC pre-mRNA") is a pre-mRNA transcript that contains at least one retained intron. The RIC pre-mRNA contains a retained intron, an exon flanking the 5' splice site of the retained intron, an exon flanking the 3' splice site of the retained intron, and encodes the target protein. An "RIC pre-mRNA encoding a target protein" is understood to encode the target protein when fully spliced. A "retained intron" is any intron that is present in a pre-mRNA transcript when one or more other introns, such as an adjacent intron, encoded by the same gene have been spliced out of the same pre-mRNA transcript. In some embodiments, the retained intron is the most abundant intron in RIC pre-mRNA encoding the target protein. In embodiments, the retained intron is the most abundant intron in a population of RIC pre-mRNAs transcribed from the gene encoding the target protein in a cell, wherein the population of RIC pre-mRNAs comprises two or more retained introns. In embodiments, an antisense oligomer targeted to the most abundant intron in the population of RIC pre-mRNAs encoding the target protein induces splicing out of two or more retained introns in the population, including the retained intron to which the antisense oligomer is targeted or binds. In embodiments, a mature mRNA encoding the target protein is thereby produced. The terms "mature mRNA," and "fully-spliced mRNA," are used interchangeably herein to describe a fully processed mRNA encoding a target protein (e.g., mRNA that is exported from the nucleus into the cytoplasm and translated into target protein) or a fully processed functional RNA. The term "productive mRNA," also can be used to describe a fully processed mRNA encoding a target protein. In embodiments, the targeted region is in a retained intron that is the most abundant intron in a RIC pre-mRNA encoding the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein.

As used herein, the term "comprise" or variations thereof such as "comprises" or "comprising" are to be read to indicate the inclusion of any recited feature (e.g. in the case of an antisense oligomer, a defined nucleobase sequence) but not the exclusion of any other features. Thus, as used herein, the term "comprising" is inclusive and does not exclude additional, unrecited features (e.g. in the case of an antisense oligomer, the presence of additional, unrecited nucleobases).

In embodiments of any of the compositions and methods provided herein, "comprising" may be replaced with "consisting essentially of" or "consisting of" The phrase "consisting essentially of" is used herein to require the specified feature(s) (e.g. nucleobase sequence) as well as those which do not materially affect the character or function of the claimed invention. As used herein, the term "consisting" is used to indicate the presence of the recited feature (e.g. nucleobase sequence) alone (so that in the case of an antisense oligomer consisting of a specified nucleobase sequence, the presence of additional, unrecited nucleobases is excluded).

In embodiments, the targeted region is in a retained intron that is the second most abundant intron in a RIC pre-mRNA encoding the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein. For example, the second most abundant retained intron may be targeted rather than the most abundant retained intron due to the uniqueness of the nucleotide sequence of the second most abundant retained intron, ease of ASO design to target a particular nucleotide sequence, and/or amount of increase in protein production resulting from targeting the intron with an ASO. In embodiments, the retained intron is the second most abundant intron in a population of RIC pre-mRNAs transcribed from the gene encoding the target protein in a cell, wherein the population of RIC pre-mRNAs comprises two or more retained introns. In embodiments, an antisense oligomer targeted to the second most abundant intron in the population of RIC pre-mRNAs encoding the target protein induces splicing out of two or more retained introns in the population, including the retained intron to which the antisense oligomer is targeted or binds. In embodiments, fully-spliced (mature) RNA encoding the target protein is thereby produced.

In embodiments, an ASO is complementary to a targeted region that is within a non-retained intron in a RIC pre-mRNA. In embodiments, the targeted portion of the RIC pre-mRNA is within: the region +6 to +100 relative to the 5' splice site of the non-retained intron; or the region −16 to −100 relative to the 3' splice site of the non-retained intron. In embodiments, the targeted portion of the RIC pre-mRNA is within the region +100 relative to the 5' splice site of the non-retained intron to −100 relative to the 3' splice site of the non-retained intron. As used to identify the location of a region or sequence, "within" is understood to include the residues at the positions recited. For example, a region +6 to +100 includes the residues at positions +6 and +100. In embodiments, fully-spliced (mature) RNA encoding the target protein is thereby produced.

In embodiments, the retained intron of the RIC pre-mRNA is an inefficiently spliced intron. As used herein, "inefficiently spliced" may refer to a relatively low frequency of splicing at a splice site adjacent to the retained intron (5' splice site or 3' splice site) as compared to the frequency of splicing at another splice site in the RIC pre-mRNA. The term "inefficiently spliced" may also refer to the relative rate or kinetics of splicing at a splice site, in which an "inefficiently spliced" intron may be spliced or removed at a slower rate as compared to another intron in a RIC pre-mRNA.

In embodiments, the 9-nucleotide sequence at −3e to −1e of the exon flanking the 5' splice site and +1 to +6 of the retained intron is identical to the corresponding wild-type sequence. In embodiments, the 16 nucleotide sequence at −15 to −1 of the retained intron and +1e of the exon flanking the 3' splice site is identical to the corresponding wild-type sequence. As used herein, the "wild-type sequence" refers to the nucleotide sequence for the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B gene in the published reference genome deposited in the NCBI repository of biological and scientific information (operated by National Center for Biotechnology Information, National Library of Medicine, 8600 Rockville Pike, Bethesda, Md. USA 20894). As used herein, the "wild-type sequence" refers to NCBI Gene ID: (ATP1A2:477; CACNA1A:773; SETD5:55209; SHANK3:85358; NF2:4771; DNMT1:1786; TCF4:6925; RAI1:10743; PEX1:5189; ARSA:410; EIF2B5:8893; EIF2B1:1967; EIF2B2:8892; NPC1:4864; ADAR:103; MFSD8:256471; STXBP1:6812; PRICKLE2:166336; PRRT2:112476; STX1B:112755; IDUA: IDUA). Also used herein, a nucleotide position denoted with an "e" indicates the nucleotide is present in the sequence of an exon (e.g., the exon flanking the 5' splice site or the exon flanking the 3' splice site).

The methods involve contacting cells with an ASO that is complementary to a portion of a pre-mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, resulting in increased expression of ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B. As used herein, "contacting" or administering to cells refers to any method of providing an ASO in immediate proximity with the cells such that the ASO and the cells interact. A cell that is contacted with an ASO will take up or transport the ASO into the cell. The method involves contacting a condition or disease-associated or condition or disease-relevant cell with any of the ASOs described herein. In some embodiments, the ASO may be further modified or attached (e.g., covalently attached) to another molecule to target the ASO to a cell type, enhance contact between the ASO and the condition or disease-associated or condition or disease-relevant cell, or enhance uptake of the ASO.

As used herein, the term "increasing protein production" or "increasing expression of a target protein" means enhancing the amount of protein that is translated from an mRNA in a cell. A "target protein" may be any protein for which increased expression/production is desired.

In embodiments, contacting a cell that expresses a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA with an ASO that is complementary to a targeted portion of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA transcript results in a measurable increase in the amount of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein (e.g., a target protein) encoded by the pre-mRNA. Methods of measuring or detecting production of a protein will be evident to one of skill in the art and include any known method, for example, Western blotting, flow cytometry, immunofluorescence microscopy, and ELISA.

In embodiments, contacting cells with an ASO that is complementary to a targeted portion of a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA transcript results in an increase in the amount of ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein produced by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein produced by the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the amount of target protein produced by an control compound. A control compound can be, for example, an oligonucleotide that is not complementary to the targeted portion of the RIC pre-mRNA.

In some embodiments, contacting cells with an ASO that is complementary to a targeted portion of a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA transcript results in an increase in the amount of mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B respectively, including the mature mRNA encoding the target protein. In some embodiments, the amount of mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, or the mature mRNA encoding the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, is increased by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of the mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, or the mature mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein produced in the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold compared to the amount of mature RNA produced in an untreated cell, e.g., an untreated cell or a cell treated with a control compound. A control compound can be, for example, an oligonucleotide that is not complementary to the targeted portion of the ATP1A2, CACNA1A, SETD5, SHANK3, NF2, DNMT1, TCF4, RAI1, PEX1, ARSA, EIF2B5, EIF2B2, NPC1, ADAR, MFSD8, STXBP1, PRICKLE2, PRRT2, or STX1B RIC pre-mRNA.

Constitutive Splicing of a Retained Intron from a RIC pre-mRNA

The methods and antisense oligonucleotide compositions provided herein are useful for increasing the expression of ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein in cells, for example, in a subject having a deficiency in the amount or activity of ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, by increasing the level of mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, or the mature mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein. In particular, the methods and compositions as described herein can induce the constitutive splicing of a retained intron from a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA transcript encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, thereby increasing the level of mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, or the mature mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein and increasing the expression of ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein.

Constitutive splicing of a retained intron from a RIC pre-mRNA correctly removes the retained intron from the RIC pre-mRNA, wherein the retained intron has wild-type splice sequences. Constitutive splicing, as used herein, does not encompass splicing of a retained intron from a RIC pre-mRNA transcribed from a gene or allele having a mutation that causes alternative splicing or aberrant splicing of a pre-mRNA transcribed from the gene or allele. For example, constitutive splicing of a retained intron, as induced using the methods and antisense oligonucleotides provided herein, does not correct aberrant splicing in or influence alternative splicing of a pre-mRNA to result in an increased expression of a target protein or functional RNA.

In embodiments, constitutive splicing can correctly remove a retained intron from a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA, wherein the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA is transcribed from a wild-type gene or allele, or a polymorphic gene or allele, that encodes a fully-functional target protein or functional RNA, and wherein the gene or allele does not have a mutation that causes alternative splicing or aberrant splicing of the retained intron.

In some embodiments, constitutive splicing of a retained intron from a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein correctly removes a retained intron from a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein, wherein the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA is transcribed from a gene or allele from which the target gene or functional RNA is produced at a reduced level compared to production from a wild-type allele, and wherein the gene or allele does not have a mutation that causes alternative splicing or aberrant splicing of the retained intron. In these embodiments, the correct removal of the constitutively spliced retained intron results in production of target protein or functional RNA that is functional when compared to an equivalent wild-type protein or functional RNA.

In other embodiments, constitutive splicing can correctly remove a retained intron from a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA, wherein the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA is transcribed from a gene or allele that encodes a target protein or functional RNA produced in a form having reduced function compared to an equivalent wild-type protein or functional RNA, and wherein the gene or allele does not have a mutation that causes alternative splicing or aberrant splicing of the retained intron. In these embodiments, the correct removal of the constitutively spliced retained intron results in production of partially functional target protein, or functional RNA that is partially functional when compared to an equivalent wild-type protein or functional RNA.

"Correct removal" of the retained intron by constitutive splicing refers to removal of the entire intron, without removal of any part of an exon.

In embodiments, an antisense oligomer as described herein or used in any method described herein does not increase the amount of mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein or the amount of ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein by modulating alternative splicing or aberrant splicing of a pre-mRNA transcribed from the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B gene. Modulation of alternative splicing or aberrant splicing can be measured using any known method for analyzing the sequence and length of RNA species, e.g., by RT-PCR and using methods described elsewhere herein and in the literature. In embodiments, modulation of alternative or aberrant splicing is determined based on an increase or decrease in the amount of the spliced species of interest of at least 10% or 1.1-fold. In embodiments, modulation is determined based on an increase or decrease at a level that is at least 10% to 100% or 1.1 to 10-fold, as described herein regarding determining an increase in mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein in the methods of the invention.

In embodiments, the method is a method wherein the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA can be produce by partial splicing of a wild-type ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B pre-mRNA. In embodiments, the method is a method wherein the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA can be produce by partial splicing of a full-length wild-type ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B pre-mRNA. In embodiments, the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA can be produce by partial splicing of a full-length ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B pre-mRNA. In these embodiments, a full-length ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B pre-mRNA may have a polymorphism in a splice site of the retained intron that does not impair correct splicing of the retained intron as compared to splicing of the retained intron having the wild-type splice site sequence.

In embodiments, the mRNA encoding ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein is a full-length mature mRNA, or a wild-type mature mRNA. In these embodiments, a full-length mature mRNA may have a polymorphism that does not affect the activity of the target protein or the functional RNA encoded by the mature mRNA, as compared to the activity of ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B protein encoded by the wild-type mature mRNA.

Antisense Oligomers

One aspect of the present disclosure is a composition comprising antisense oligomers that enhances splicing by binding to a targeted portion of a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA. As used herein, the terms "ASO" and "antisense oligomer" are used interchangeably and refer to an oligomer such as a polynucleotide, comprising nucleobases, that hybridizes to a target nucleic acid (e.g., a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA) sequence by Watson-Crick base pairing or wobble base pairing (G-U). The ASO may have exact sequence complementary to the target sequence or near complementarity (e.g., sufficient complementarity to bind the target sequence and enhancing splicing at a splice site). ASOs are designed so that they bind (hybridize) to a target nucleic acid (e.g., a targeted portion of a pre-mRNA transcript) and remain hybridized under physiological conditions. Typically, if they hybridize to a site other than the intended (targeted) nucleic acid sequence, they hybridize to a limited number of sequences that are not a target nucleic acid (to a few sites other than a target nucleic acid). Design of an ASO can take into consideration the occurrence of the nucleic acid sequence of the targeted portion of the pre-mRNA transcript or a sufficiently similar nucleic acid sequence in other locations in the genome or cellular pre-mRNA or transcriptome, such that the likelihood the ASO will bind other sites and cause "off-target" effects is limited. Any antisense oligomers known in the art, for example in PCT Application No. PCT/US2014/054151, published as WO 2015/035091, titled "Reducing Nonsense-Mediated mRNA Decay," can be used to practice the methods described herein.

In some embodiments, ASOs "specifically hybridize" to or are "specific" to a target nucleic acid or a targeted portion of a RIC pre-mRNA. Typically such hybridization occurs with a Tm substantially greater than 37° C., preferably at least 50° C., and typically between 60° C. to approximately 90° C. Such hybridization preferably corresponds to stringent hybridization conditions. At a given ionic strength and pH, the Tm is the temperature at which 50% of a target sequence hybridizes to a complementary oligonucleotide.

Oligomers, such as oligonucleotides, are "complementary" to one another when hybridization occurs in an anti-parallel configuration between two single-stranded polynucleotides. A double-stranded polynucleotide can be "complementary" to another polynucleotide, if hybridization can occur between one of the strands of the first polynucleotide and the second. Complementarity (the degree to which one polynucleotide is complementary with another) is quantifiable in terms of the proportion (e.g., the percentage) of bases in opposing strands that are expected to form hydrogen bonds with each other, according to generally accepted base-pairing rules. The sequence of an antisense oligomer (ASO) need not be 100% complementary to that of its target nucleic acid to hybridize. In certain embodiments, ASOs can comprise at least 70%, at least 75%, at least 80%, at least 85%, at least 90%, at least 95%, at least 96%, at least 97%, at least 98%, or at least 99% sequence complementarity to a target region within the target nucleic acid sequence to which they are targeted. For example, an ASO in which 18 of 20 nucleobases of the oligomeric compound are complementary to a target region, and would therefore specifically hybridize, would represent 90 percent complementarity. In this example, the remaining non-complementary nucleobases may be clustered together or interspersed with complementary nucleobases and need not be contiguous to each other or to complementary nucleobases. Percent complementarity of an ASO with a region of a target nucleic acid can be determined routinely using BLAST programs (basic local alignment search tools) and PowerBLAST programs known in the art (Altschul et al., J. Mol. Biol., 1990, 215, 403-410; Zhang and Madden, Genome Res., 1997, 7, 649-656).

An ASO need not hybridize to all nucleobases in a target sequence and the nucleobases to which it does hybridize may be contiguous or noncontiguous. ASOs may hybridize over one or more segments of a pre-mRNA transcript, such that intervening or adjacent segments are not involved in the hybridization event (e.g., a loop structure or hairpin structure may be formed). In certain embodiments, an ASO hybridizes to noncontiguous nucleobases in a target pre-mRNA transcript. For example, an ASO can hybridize to nucleobases in a pre-mRNA transcript that are separated by one or more nucleobase(s) to which the ASO does not hybridize.

The ASOs described herein comprise nucleobases that are complementary to nucleobases present in a target portion of a RIC pre-mRNA. The term ASO embodies oligonucleotides and any other oligomeric molecule that comprises nucleobases capable of hybridizing to a complementary nucleobase on a target mRNA but does not comprise a sugar moiety, such as a peptide nucleic acid (PNA). The ASOs may comprise naturally-occurring nucleotides, nucleotide analogs, modified nucleotides, or any combination of two or three of the preceding. The term "naturally occurring nucleotides" includes deoxyribonucleotides and ribonucleotides. The term "modified nucleotides" includes nucleotides with modified or substituted sugar groups and/or having a modified backbone. In some embodiments, all of the nucleotides of the ASO are modified nucleotides. Chemical modifications of ASOs or components of ASOs that are compatible with the methods and compositions described herein will be evident to one of skill in the art and can be found, for example, in U.S. Pat. No. 8,258,109 B2, U.S. Pat. No. 5,656,612, U.S. Patent Publication No. 2012/0190728, and Dias and Stein, Mol. Cancer Ther. 2002, 1, 347-355, herein incorporated by reference in their entirety.

The nucleobase of an ASO may be any naturally occurring, unmodified nucleobase such as adenine, guanine, cytosine, thymine and uracil, or any synthetic or modified nucleobase that is sufficiently similar to an unmodified nucleobase such that it is capable of hydrogen bonding with a nucleobase present on a target pre-mRNA. Examples of modified nucleobases include, without limitation, hypoxanthine, xanthine, 7-methylguanine, 5,6-dihydrouracil, 5-methylcytosine, and 5-hydroxymethoylcytosine.

The ASOs described herein also comprise a backbone structure that connects the components of an oligomer. The term "backbone structure" and "oligomer linkages" may be used interchangeably and refer to the connection between monomers of the ASO. In naturally occurring oligonucleotides, the backbone comprises a 3'-5' phosphodiester linkage connecting sugar moieties of the oligomer. The backbone structure or oligomer linkages of the ASOs described herein may include (but are not limited to) phosphorothioate, phosphorodithioate, phosphoroselenoate, phosphorodiselenoate, phosphoroanilothioate, phosphoraniladate, phosphoramidate, and the like. See e.g., LaPlanche et al., Nucleic Acids Res. 14:9081 (1986); Stec et al., J. Am. Chem. Soc. 106:6077 (1984), Stein et al., Nucleic Acids Res. 16:3209 (1988), Zon et al., Anti Cancer Drug Design 6:539 (1991); Zon et al., Oligonucleotides and Analogues: A Practical Approach, pp. 87-108 (F. Eckstein, Ed., Oxford University Press, Oxford England (1991)); Stec et al., U.S. Pat. No. 5,151,510; Uhlmann and Peyman, Chemical Reviews 90:543 (1990). In some embodiments, the backbone structure of the ASO does not contain phosphorous but rather contains peptide bonds, for example in a peptide nucleic acid (PNA), or linking groups including carbamate, amides, and linear and cyclic hydrocarbon groups. In some embodiments, the backbone modification is a phosphorothioate linkage. In some embodiments, the backbone modification is a phosphoramidate linkage.

In embodiments, the stereochemistry at each of the phosphorus internucleotide linkages of the ASO backbone is random. In embodiments, the stereochemistry at each of the phosphorus internucleotide linkages of the ASO backbone is controlled and is not random. For example, U.S. Pat. App. Pub. No. 2014/0194610, "Methods for the Synthesis of Functionalized Nucleic Acids," incorporated herein by reference, describes methods for independently selecting the handedness of chirality at each phosphorous atom in a nucleic acid oligomer. In embodiments, an ASO used in the methods of the invention comprises an ASO having phosphorus internucleotide linkages that are not random. In embodiments, a composition used in the methods of the invention comprises a pure diastereomeric ASO. In embodiments, a composition used in the methods of the invention comprises an ASO that has diastereomeric purity of at least about 90%, at least about 91%, at least about 92%, at least about 93%, at least about 94%, at least about 95%, at least about 96%, at least about 97%, at least about 98%, at least about 99%, about 100%, about 90% to about 100%, about 91% to about 100%, about 92% to about 100%, about 93% to about 100%, about 94% to about 100%, about 95% to about 100%, about 96% to about 100%, about 97% to about 100%, about 98% to about 100%, or about 99% to about 100%.

In embodiments, the ASO has a nonrandom mixture of Rp and Sp configurations at its phosphorus internucleotide linkages. For example, it has been suggested that a mix of Rp and Sp is required in antisense oligonucleotides to achieve a balance between good activity and nuclease stability (Wan, et al., 2014, "Synthesis, biophysical properties and biological activity of second generation antisense oligonucleotides containing chiral phosphorothioate linkages," Nucleic Acids Research 42(22): 13456-13468, incorporated herein by reference). In embodiments, an ASO used in the methods of the invention comprises about 5-100% Rp, at least about 5% Rp, at least about 10% Rp, at least about 15% Rp, at least about 20% Rp, at least about 25% Rp, at least about 30% Rp, at least about 35% Rp, at least about 40% Rp, at least about 45% Rp, at least about 50% Rp, at least about 55% Rp, at least about 60% Rp, at least about 65% Rp, at least about 70% Rp, at least about 75% Rp, at least about 80% Rp, at least about 85% Rp, at least about 90% Rp, or at least about 95% Rp, with the remainder Sp, or about 100% Rp. In embodiments, an ASO used in the methods of the invention comprises about 10% to about 100% Rp, about 15% to about 100% Rp, about 20% to about 100% Rp, about 25% to about 100% Rp, about 30% to about 100% Rp, about 35% to about 100% Rp, about 40% to about 100% Rp, about 45% to about 100% Rp, about 50% to about 100% Rp, about 55% to about 100% Rp, about 60% to about 100% Rp, about 65% to about 100% Rp, about 70% to about 100% Rp, about 75% to about 100% Rp, about 80% to about 100% Rp, about 85% to about 100% Rp, about 90% to about 100% Rp, or about 95% to about 100% Rp, about 20% to about 80% Rp, about 25% to about 75% Rp, about 30% to about 70% Rp, about 40% to about 60% Rp, or about 45% to about 55% Rp, with the remainder Sp.

In embodiments, an ASO used in the methods of the invention comprises about 5-100% Sp, at least about 5% Sp, at least about 10% Sp, at least about 15% Sp, at least about 20% Sp, at least about 25% Sp, at least about 30% Sp, at least about 35% Sp, at least about 40% Sp, at least about 45% Sp, at least about 50% Sp, at least about 55% Sp, at least about 60% Sp, at least about 65% Sp, at least about 70% Sp, at least about 75% Sp, at least about 80% Sp, at least about 85% Sp, at least about 90% Sp, or at least about 95% Sp, with the remainder Rp, or about 100% Sp. In embodiments, an ASO used in the methods of the invention comprises about 10% to about 100% Sp, about 15% to about 100% Sp, about 20% to about 100% Sp, about 25% to about 100% Sp, about 30% to about 100% Sp, about 35% to about 100% Sp, about 40% to about 100% Sp, about 45% to about 100% Sp, about 50% to about 100% Sp, about 55% to about 100% Sp, about 60% to about 100% Sp, about 65% to about 100% Sp, about 70% to about 100% Sp, about 75% to about 100% Sp, about 80% to about 100% Sp, about 85% to about 100% Sp, about 90% to about 100% Sp, or about 95% to about 100% Sp, about 20% to about 80% Sp, about 25% to about 75% Sp, about 30% to about 70% Sp, about 40% to about 60% Sp, or about 45% to about 55% Sp, with the remainder Rp.

Any of the ASOs described herein may contain a sugar moiety that comprises ribose or deoxyribose, as present in naturally occurring nucleotides, or a modified sugar moiety or sugar analog, including a morpholine ring. Non-limiting examples of modified sugar moieties include 2' substitutions such as 2'-O-methyl (2'-O-Me), 2'-O-methoxyethyl (2'MOE), 2'-O-aminoethyl, 2'F; N3'→P5' phosphoramidate, 2'dimethylaminooxyethoxy, 2'dimethylaminoethoxyethoxy, 2'-guanidinidium, 2'-O-guanidinium ethyl, carbamate modified sugars, and bicyclic modified sugars. In some embodiments, the sugar moiety modification is selected from 2'-O-Me, 2'F, and 2'MOE. In some embodiments, the sugar moiety modification is an extra bridge bond, such as in a locked nucleic acid (LNA). In some embodiments the sugar analog contains a morpholine ring, such as phosphorodiamidate morpholino (PMO). In some embodiments, the sugar moiety comprises a ribofuransyl or 2'deoxyribofuransyl modification. In some embodiments, the sugar moiety comprises 2'4'-constrained 2'O-methyloxyethyl (cMOE) modifications. In some embodiments, the sugar moiety comprises cEt 2', 4' constrained 2'-O ethyl BNA modifications. In some embodiments, the sugar moiety comprises tricycloDNA (tcDNA) modifications. In some embodiments, the sugar moiety comprises ethylene nucleic acid (ENA) modifications. In some embodiments, the sugar moiety comprises MCE modifications. Modifications are known in the art and described in the literature, e.g., by Jarver, et al., 2014, "A Chemical View of Oligonucleotides for Exon Skipping and Related Drug Applications," Nucleic Acid Therapeutics 24(1): 37-47, incorporated by reference for this purpose herein.

In some examples, each monomer of the ASO is modified in the same way, for example each linkage of the backbone of the ASO comprises a phosphorothioate linkage or each ribose sugar moiety comprises a 2'O-methyl modification. Such modifications that are present on each of the monomer components of an ASO are referred to as "uniform modifications." In some examples, a combination of different modifications may be desired, for example, an ASO may comprise a combination of phosphorodiamidate linkages and sugar moieties comprising morpholine rings (morpholinos). Combinations of different modifications to an ASO are referred to as "mixed modifications" or "mixed chemistries."

In some embodiments, the ASO comprises one or more backbone modification. In some embodiments, the ASO comprises one or more sugar moiety modification. In some embodiments, the ASO comprises one or more backbone modification and one or more sugar moiety modification. In some embodiments, the ASO comprises 2'MOE modifications and a phosphorothioate backbone. In some embodiments, the ASO comprises a phosphorodiamidate morpholino (PMO). In some embodiments, the ASO comprises a peptide nucleic acid (PNA). Any of the ASOs or any component of an ASO (e.g., a nucleobase, sugar moiety, backbone) described herein may be modified in order to achieve desired properties or activities of the ASO or reduce undesired properties or activities of the ASO. For example, an ASO or one or more component of any ASO may be modified to enhance binding affinity to a target sequence on a pre-mRNA transcript; reduce binding to any non-target sequence; reduce degradation by cellular nucleases (i.e., RNase H); improve uptake of the ASO into a cell and/or into the nucleus of a cell; alter the pharmacokinetics or pharmacodynamics of the ASO; and modulate the half-life of the ASO.

In some embodiments, the ASOs are comprised of 2'-O-(2-methoxyethyl) (MOE) phosphorothioate-modified nucleotides. ASOs comprised of such nucleotides are especially well-suited to the methods disclosed herein; oligomers having such modifications have been shown to have significantly enhanced resistance to nuclease degradation and increased bioavailability, making them suitable, for example, for oral delivery in some embodiments described herein. See e.g., Geary et al., J Pharmacol Exp Ther. 2001; 296(3):890-7; Geary et al., J Pharmacol Exp Ther. 2001; 296(3):898-904.

Methods of synthesizing ASOs will be known to one of skill in the art. Alternatively or in addition, ASOs may be obtained from a commercial source.

Unless specified otherwise, the left-hand end of single-stranded nucleic acid (e.g., pre-mRNA transcript, oligonucleotide, ASO, etc.) sequences is the 5' end and the left-hand direction of single or double-stranded nucleic acid sequences is referred to as the 5' direction. Similarly, the right-hand end or direction of a nucleic acid sequence (single or double stranded) is the 3' end or direction. Generally, a region or sequence that is 5' to a reference point in a nucleic acid is referred to as "upstream," and a region or sequence that is 3' to a reference point in a nucleic acid is referred to as "downstream." Generally, the 5' direction or end of an mRNA is where the initiation or start codon is located, while the 3' end or direction is where the termination codon is located. In some aspects, nucleotides that are upstream of a reference point in a nucleic acid may be designated by a negative number, while nucleotides that are downstream of a reference point may be designated by a positive number. For example, a reference point (e.g., an exon-exon junction in mRNA) may be designated as the "zero" site, and a nucleotide that is directly adjacent and upstream of the reference point is designated "minus one," e.g., "−1," while a nucleotide that is directly adjacent and downstream of the reference point is designated "plus one," e.g., "+1."

In other embodiments, the ASOs are complementary to (and bind to) a targeted portion of a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA that is downstream (in the 3' direction) of the 5' splice site of the retained intron in a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA (e.g., the direction designated by positive numbers relative to the 5' splice site) (FIG. 1). In some embodiments, the ASOs are complementary to a targeted portion of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA that is within the region +6 to +4000, +6 to +3500, +6 to +3000, +6 to +2500, +6 to +2000, +6 to +1500, +6 to +1000, +6 to +500, +6 to +400, +6 to +300, +6 to +200, or +6 to +100 relative to the 5' splice site of the retained intron. In some embodiments, the ASO is not complementary to nucleotides +1 to +5 relative to the 5' splice site (the first five nucleotides located downstream of the 5' splice site). In some embodiments, the ASOs may be complementary to a targeted portion of a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA that is within the region between nucleotides +6 and +50 relative to the 5' splice site of the retained intron. In some aspects, the ASOs are complementary to a targeted portion that is within the region +6 to +90, +6 to +80, +6 to +70, +6 to +60, +6 to +50, +6 to +40, +6 to +30, or +6 to +20 relative to 5' splice site of the retained intron.

In some embodiments, the ASOs are complementary to a targeted region of a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA that is upstream (5' relative) of the 3' splice site of the retained intron in a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA (e.g., in the direction designated by negative numbers) (FIG. 1). In some embodiments, the ASOs are complementary to a targeted portion of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA that is within the region −16 to −4000, −16 to −3000, −16 to −2000, −16 to −1000, −16 to −500, −16 to −400, −16 to −300, −6 to −200, or −16 to −100 relative to the 3' splice site of the retained intron. In some embodiments, the ASO is not complementary to nucleotides −1 to −15 relative to the 3' splice site (the first 15 nucleotides located upstream of the 3' splice site). In some embodiments, the ASOs are complementary to a targeted portion of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA that is within the region −16 to −50 relative to the 3' splice site of the retained intron. In some aspects, the ASOs are complementary to a targeted portion that is within the region −16 to −90, −16 to −80, −16 to −70, −16 to −60, −16 to −50, −16 to −40, or −16 to −30 relative to 3' splice site of the retained intron.

In embodiments, the targeted portion of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA is within the region +100 relative to the 5' splice site of the retained intron to −100 relative to the 3' splice site of the retained intron.

In some embodiments, the ASOs are complementary to a targeted portion of a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA that is within the exon flanking the 5' splice site (upstream) of the retained intron (FIG. 1). In some embodiments, the ASOs are complementary to a targeted portion of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA that is within the region +2e to −4e in the exon flanking the 5' splice site of the retained intron. In some embodiments, the ASOs are not complementary to nucleotides −1e to −3e relative to the 5' splice site of the retained intron. In some embodiments, the ASOs are complementary to a targeted portion of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA that is within the region −4e to −100e, −4e to −90e, −4e to −80e, −4e to −70e, −4e to −60e, −4e to −50e, −4 to −40e, −4e to −30e, or −4e to −20e relative to the 5' splice site of the retained intron.

In some embodiments, the ASOs are complementary to a targeted portion of a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA that is within the exon flanking the 3' splice site (downstream) of the retained intron (FIG. 1). In some embodiments, the ASOs are complementary to a targeted portion to the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA that is within the region +2e to −4e in the exon flanking the 3' splice site of the retained intron. In some embodiments, the ASOs are not complementary to nucleotide +1e relative to the 3' splice site of the retained intron. In some embodiments, the ASOs are complementary to a targeted portion of the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA that is within the region +2e to +100e, +2e to +90e, +2e to +80e, +2e to +70e, +2e to +60e, +2e to +50e, +2e to +40e, +2e to +30e, or +2 to +20e relative to the 3' splice site of the retained intron. The ASOs may be of any length suitable for specific binding and effective enhancement of splicing. In some embodiments, the ASOs consist of 8 to 50 nucleobases. For example, the ASO may be 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, or 50 nucleobases in length. In some embodiments, the ASOs consist of more than 50 nucleobases. In some embodiments, the ASO is from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, 12 to 15 nucleobases, 13 to 50 nucleobases, 13 to 40 nucleobases, 13 to 35 nucleobases, 13 to 30 nucleobases, 13 to 25 nucleobases, 13 to 20 nucleobases, 14 to 50 nucleobases, 14 to 40 nucleobases, 14 to 35 nucleobases, 14 to 30 nucleobases, 14 to 25 nucleobases, 14 to 20 nucleobases, 15 to 50 nucleobases, 15 to 40 nucleobases, 15 to 35 nucleobases, 15 to 30 nucleobases, 15 to 25 nucleobases, 15 to 20 nucleobases, 20 to 50 nucleobases, 20 to 40 nucleobases, 20 to 35 nucleobases, 20 to 30 nucleobases, 20 to 25 nucleobases, 25 to 50 nucleobases, 25 to 40 nucleobases, 25 to 35 nucleobases, or 25 to 30 nucleobases in length. In some embodiments, the ASOs are 30 nucleotides in length. In some embodiments, the ASOs are 29 nucleotides in length. In some embodiments, the ASOs are 28 nucleotides in length. In some embodiments, the ASOs are 27 nucleotides in length. In some embodiments, the ASOs are 26 nucleotides in length. In some embodiments, the ASOs are 25 nucleotides in length. In some embodiments, the ASOs are 24 nucleotides in length. In some embodiments, the ASOs are 23 nucleotides in length. In some embodiments, the ASOs are 22 nucleotides in length. In some embodiments, the ASOs are 21 nucleotides in length. In some embodiments, the ASOs are 20 nucleotides in length. In some embodiments, the ASOs are 19 nucleotides in length. In some embodiments, the ASOs are 18 nucleotides in length. In some embodiments, the ASOs are 17 nucleotides in length. In some embodiments, the ASOs are 16 nucleotides in length. In some embodiments, the ASOs are 15 nucleotides in length. In some embodiments, the ASOs are 14 nucleotides in length. In some embodiments, the ASOs are 13 nucleotides in length. In some embodiments, the ASOs are 12 nucleotides in length. In some embodiments, the ASOs are 11 nucleotides in length. In some embodiments, the ASOs are 10 nucleotides in length.

In some embodiments, two or more ASOs with different chemistries but complementary to the same targeted portion of the RIC pre-mRNA are used. In some embodiments, two or more ASOs that are complementary to different targeted portions of the RIC pre-mRNA are used.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties, and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

In some embodiments, the nucleic acid to be targeted by an ASO is a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA expressed in a cell, such as a eukaryotic cell. In some embodiments, the term "cell" may refer to a population of cells. In some embodiments, the cell is in a subject. In some embodiments, the cell is isolated from a subject. In some embodiments, the cell is ex vivo. In some embodiments, the cell is a condition or disease-relevant cell or a cell line. In some embodiments, the cell is in vitro (e.g., in cell culture).

Pharmaceutical Compositions

Pharmaceutical compositions or formulations comprising the antisense oligonucleotide of the described compositions and for use in any of the described methods can be prepared according to conventional techniques well known in the pharmaceutical industry and described in the published literature. In embodiments, a pharmaceutical composition or formulation for treating a subject comprises an effective amount of any antisense oligomer as described above, or a pharmaceutically acceptable salt, solvate, hydrate or ester thereof, and a pharmaceutically acceptable diluent. The antisense oligomer of a pharmaceutical formulation may further comprise a pharmaceutically acceptable excipient, diluent or carrier.

Pharmaceutically acceptable salts are suitable for use in contact with the tissues of humans and lower animals without undue toxicity, irritation, allergic response, etc., and are commensurate with a reasonable benefit/risk ratio. (See, e.g., S. M. Berge, et al., J. Pharmaceutical Sciences, 66: 1-19 (1977), incorporated herein by reference for this purpose. The salts can be prepared in situ during the final isolation and purification of the compounds, or separately by reacting the free base function with a suitable organic acid. Examples of pharmaceutically acceptable, nontoxic acid addition salts are salts of an amino group formed with inorganic acids such as hydrochloric acid, hydrobromic acid, phosphoric acid, sulfuric acid and perchloric acid or with organic acids such as acetic acid, oxalic acid, maleic acid, tartaric acid, citric acid, succinic acid or malonic acid or by using other documented methodologies such as ion exchange. Other pharmaceutically acceptable salts include adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, lower alkyl sulfonate and aryl sulfonate.

In embodiments, the compositions are formulated into any of many possible dosage forms such as, but not limited to, tablets, capsules, gel capsules, liquid syrups, soft gels, suppositories, and enemas. In embodiments, the compositions are formulated as suspensions in aqueous, non-aqueous or mixed media. Aqueous suspensions may further contain substances that increase the viscosity of the suspension including, for example, sodium carboxymethylcellulose, sorbitol and/or dextran. The suspension may also contain stabilizers. In embodiments, a pharmaceutical formulation or composition of the present invention includes, but is not limited to, a solution, emulsion, microemulsion, foam or liposome-containing formulation (e.g., cationic or noncationic liposomes).

The pharmaceutical composition or formulation of the present invention may comprise one or more penetration enhancer, carrier, excipients or other active or inactive ingredients as appropriate and well known to those of skill in the art or described in the published literature. In embodiments, liposomes also include sterically stabilized liposomes, e.g., liposomes comprising one or more specialized lipids. These specialized lipids result in liposomes with enhanced circulation lifetimes. In embodiments, a sterically stabilized liposome comprises one or more glycolipids or is derivatized with one or more hydrophilic polymers, such as a polyethylene glycol (PEG) moiety. In embodiments, a surfactant is included in the pharmaceutical formulation or compositions. The use of surfactants in drug products, formulations and emulsions is well known in the art. In embodiments, the present invention employs a penetration enhancer to effect the efficient delivery of the antisense oligonucleotide, e.g., to aid diffusion across cell membranes and/or enhance the permeability of a lipophilic drug. In embodiments, the penetration enhancers is a surfactant, fatty acid, bile salt, chelating agent, or non-chelating nonsurfactant.

In embodiments, the pharmaceutical formulation comprises multiple antisense oligonucleotides. In embodiments, the antisense oligonucleotide is administered in combination with another drug or therapeutic agent. In embodiments, the antisense oligonucleotide is administered with one or more agents capable of promoting penetration of the subject antisense oligonucleotide across the blood-brain barrier by any method known in the art. For example, delivery of agents by administration of an adenovirus vector to motor neurons in muscle tissue is described in U.S. Pat. No. 6,632,427, "Adenoviral-vector-mediated gene transfer into medullary motor neurons," incorporated herein by reference. Delivery of vectors directly to the brain, e.g., the striatum, the thalamus, the hippocampus, or the substantia nigra, is described, e.g., in U.S. Pat. No. 6,756,523, "Adenovirus vectors for the transfer of foreign genes into cells of the central nervous system particularly in brain," incorporated herein by reference.

In embodiments, the antisense oligonucleotides are linked or conjugated with agents that provide desirable pharmaceutical or pharmacodynamic properties. In embodiments, the antisense oligonucleotide is coupled to a substance, known in the art to promote penetration or transport across the blood-brain barrier, e.g., an antibody to the transferrin receptor. In embodiments, the antisense oligonucleotide is linked with a viral vector, e.g., to render the antisense compound more effective or increase transport across the blood-brain barrier. In embodiments, osmotic blood brain barrier disruption is assisted by infusion of sugars, e.g., meso erythritol, xylitol, D(+) galactose, D(+) lactose, D(+) xylose, dulcitol, myo-inositol, L(−) fructose, D(−) mannitol, D(+) glucose, D(+) arabinose, D(−) arabinose, cellobiose, D(+) maltose, D(+) raffinose, L(+) rhamnose, D(+) melibiose, D(−) ribose, adonitol, D(+) arabitol, L(−) arabitol, D(+) fucose, L(−) fucose, D(−) lyxose, L(+) lyxose, and L(−) lyxose, or amino acids, e.g., glutamine, lysine, arginine, asparagine, aspartic acid, cysteine, glutamic acid, glycine, histidine, leucine, methionine, phenylalanine, proline, serine, threonine, tyrosine, valine, and taurine. Methods and materials for enhancing blood brain barrier penetration are described, e.g., in U.S. Pat. No. 4,866,042, "Method for the delivery of genetic material across the blood brain barrier," U.S. Pat. No. 6,294,520, "Material for passage through the blood-brain barrier," and U.S. Pat. No. 6,936,589, "Parenteral delivery systems," each incorporated herein by reference.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties, and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

Treatment of Subjects

Any of the compositions provided herein may be administered to an individual. "Individual" may be used interchangeably with "subject" or "patient." An individual may be a mammal, for example a human or animal such as a non-human primate, a rodent, a rabbit, a rat, a mouse, a horse, a donkey, a goat, a cat, a dog, a cow, a pig, or a sheep. In embodiments, the individual is a human. In embodiments, the individual is a fetus, an embryo, or a child. In other embodiments, the individual may be another eukaryotic organism, such as a plant. In some embodiments, the compositions provided herein are administered to a cell ex vivo.

In some embodiments, the compositions provided herein are administered to an individual as a method of treating a disease or disorder. In some embodiments, the individual has a genetic disease, such as any of the diseases described herein. In some embodiments, the individual is at risk of having the disease, such as any of the diseases described herein. In some embodiments, the individual is at increased risk of having a disease or disorder caused by insufficient amount of a protein or insufficient activity of a protein. If an individual is "at an increased risk" of having a disease or disorder caused insufficient amount of a protein or insufficient activity of a protein, the method involves preventative or prophylactic treatment. For example, an individual may be at an increased risk of having such a disease or disorder because of family history of the disease. Typically, individuals at an increased risk of having such a disease or disorder benefit from prophylactic treatment (e.g., by preventing or delaying the onset or progression of the disease or disorder).

Suitable routes for administration of ASOs of the present invention may vary depending on cell type to which delivery of the ASOs is desired. The ASOs of the present invention may be administered to patients parenterally, for example, by intraperitoneal injection, intramuscular injection, subcutaneous injection, intrathecal injection, intracerebroventricular injection, intraperitoneal injection, or intravenous injection. In embodiments, delivery is to the CNS. In embodiments, a fetus is treated in utero, e.g., by administering the ASO composition to the fetus directly or indirectly (e.g., via the mother).

The compositions of the present invention may be provided to muscle cells by any suitable means, including direct administration (e.g., locally by injection or topical administration at a treatment site) or systemically (e.g., parenterally or orally), intranasally, orally, or by intrathecal, intracerebroventricular, inhalational, enteral, topical, intrauterine, vaginal, sublingual, rectal, intramuscular, intrapleural, intraventricular, intraperitoneal, ophthalmic, intravenous, or subcutaneous means.

Methods of Identifying Additional ASOs that Enhance Splicing

Also within the scope of the present invention are methods for identifying (determining) additional ASOs that enhance splicing of a ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, or STX1B RIC pre-mRNA, specifically at the target intron. ASOs that specifically hybridize to different nucleotides within the target region of the pre-mRNA may be screened to identify (determine) ASOs that improve the rate and/or extent of splicing of the target intron. In some embodiments, the ASO may block or interfere with the binding site(s) of a splicing repressor(s)/silencer. Any method known in the art may be used to identify (determine) an ASO that when hybridized to the target region of the intron results in the desired effect (e.g., enhanced splicing, protein or functional RNA production). These methods also can be used for identifying ASOs that enhance splicing of the retained intron by binding to a targeted region in an exon flanking the retained intron, or in a non-retained intron. An example of a method that may be used is provided below.

A round of screening, referred to as an ASO "walk" may be performed using ASOs that have been designed to hybridize to a target region of a pre-mRNA. For example, the ASOs used in the ASO walk can be tiled every 5 nucleotides from approximately 100 nucleotides upstream of the 5' splice site of the retained intron (e.g., a portion of sequence of the exon located upstream of the target/retained intron) to approximately 100 nucleotides downstream of the 5' splice site of the target/retained intron and/or from approximately 100 nucleotides upstream of the 3' splice site of the retained intron to approximately 100 nucleotides downstream of the 3' splice site of the target/retained intron (e.g., a portion of sequence of the exon located downstream of the target/retained intron). For example, a first ASO of 15 nucleotides in length may be designed to specifically hybridize to nucleotides +6 to +20 relative to the 5' splice site of the target/retained intron. A second ASO is designed to specifically hybridize to nucleotides +11 to +25 relative to the 5' splice site of the target/retained intron. ASOs are designed as such spanning the target region of the pre-mRNA. In embodiments, the ASOs can be tiled more closely, e.g., every 1, 2, 3, or 4 nucleotides. Further, the ASOs can be tiled from 100 nucleotides downstream of the 5' splice site, to 100 nucleotides upstream of the 3' splice site.

One or more ASOs, or a control ASO (an ASO with a scrambled sequence, sequence that is not expected to hybridize to the target region) are delivered, for example by transfection, into a disease-relevant cell line that expresses the target pre-mRNA (e.g., the RIC pre-mRNA described elsewhere herein). The splicing-inducing effects of each of the ASOs may be assessed by any method known in the art, for example by reverse transcriptase (RT)-PCR using primers that span the splice junction, as described herein (see "Identification of intron-retention events"). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

A second round of screening, referred to as an ASO "micro-walk" may be performed using ASOs that have been designed to hybridize to a target region of a pre-mRNA. The ASOs used in the ASO micro-walk are tiled every 1 nucleotide to further refine the nucleotide acid sequence of the pre-mRNA that when hybridized with an ASO results in enhanced splicing.

Regions defined by ASOs that promote splicing of the target intron are explored in greater detail by means of an ASO "micro-walk", involving ASOs spaced in 1-nt steps, as well as longer ASOs, typically 18-25 nt.

As described for the ASO walk above, the ASO micro-walk can be perform by delivering one or more ASOs, or a control ASO (an ASO with a scrambled sequence, sequence that is not expected to hybridize to the target region), for example by transfection, into a disease-relevant cell line that expresses the target pre-mRNA. The splicing-inducing effects of each of the ASOs may be assessed by any method known in the art, for example by reverse transcriptase (RT)-PCR using primers that span the splice junction, as described herein (see "Identification of intron-retention events"). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

ASOs that when hybridized to a region of a pre-mRNA result in enhanced splicing and increased protein production may be tested in vivo using animal models, for example transgenic mouse models in which the full-length human gene has been knocked-in or in humanized mouse models of disease. Suitable routes for administration of ASOs may vary depending on the disease and/or the cell types to which delivery of the ASOs is desired. ASOs may be administered, for example, by intraperitoneal injection, intramuscular injection, subcutaneous injection, or intravenous injection. Following administration, the cells, tissues, and/or organs of the model animals may be assessed to determine the effect of the ASO treatment by for example evaluating splicing (efficiency, rate, extent) and protein production by methods known in the art and described herein. The animal models may also be any phenotypic or behavioral indication of the disease or disease severity.

Compositions and Methods for Treatment of Eye Diseases

Individual introns in primary transcripts of protein-coding genes having more than one intron are spliced from the primary transcript with different efficiencies. In most cases only the fully spliced mRNA is exported through nuclear pores for subsequent translation in the cytoplasm. Unspliced and partially spliced transcripts are detectable in the nucleus. It is generally thought that nuclear accumulation of transcripts that are not fully spliced is a mechanism to prevent the accumulation of potentially deleterious mRNAs in the cytoplasm that may be translated to protein. For some genes, splicing of the least efficient intron is a rate-limiting post-transcriptional step in gene expression, prior to translation in the cytoplasm.

Substantial levels of partially-spliced transcripts encoding the: ROM1 protein, deficient in Retinitis pigmentosa-7; TEAD1 protein, deficient in Sveinsson chorioretinal atrophy; RDH5 protein, deficient in Fundus Albipunctatus; NR2E3 protein, deficient in Retinitis pigmentosa 37; PAX6 protein, deficient in Aniridia, Coloboma of the optic nerve, Ocular coloboma, Foveal hypoplasia-1, Bilateral optic nerve hypoplasia; CRX protein, deficient in Cone-rod dystrophy-2, Leber congenital amaurosis-7; FSCN2 protein, deficient in Retinitis Pigmentosa 30; ABCA4 protein, deficient in Stargardt disease-1, Retinitis pigmentosa-19, Age-related macular degeneration-2, Cone-rod dystrophy-3; MYOC protein, deficient in Primary open angle glaucoma; TCF4 protein, deficient in Fuchs endothelial corneal dystrophy-3; MFSD8 protein, deficient Macular dystrophy with central cone involvement; CTNS protein, deficient in Ocular non-nephropathic cystinosis; NXNL1 protein, in Leber congenital amaurosis and Bardet-biedl syndrome; OPTN protein deficient in primary open angle glaucoma and amyotrophic lateral sclerosis 12; RLBP1 protein deficient in bothnia retinal dystrophy, fundus albipunctatus and retinitis punctata albescens; RPE65 protein deficient in leber congenital amaurosis 2 and retinitis pigmentosa 20; LRAT protein deficient in leber congenital amaurosis 14 and retinitis pigmentosa; RDH8 protein in eye diseases with slow clearance or accumulation of all trans retinal; RDH12 protein deficient in leber congenital amaurosis 13 and retinitis pigmentosa; RGR protein deficient in retinitis pigmentosa 44; CNGA3 protein deficient in achromatopsia 2; PER1 protein in jet lag, ALMS1 protein deficient in Alstrom syndrome and IDUA protein deficient in attenuated MPS 1 (hurler-scheie syndrome and scheie syndrome) have been discovered in the nucleus of human cells. These ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 and IDUA pre-mRNA species comprise at least one retained intron. The present invention provides compositions and methods for upregulating splicing of one or more retained ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA introns that are rate-limiting for the nuclear stages of gene expression to increase steady-state production of fully-spliced, mature mRNA, and thus, translated ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein levels. These compositions and methods can utilize antisense oligomers (ASOs) that promote constitutive splicing at intron splice sites of a retained-intron-containing ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA pre-mRNA (RIC pre-mRNA) that accumulates in the nucleus. Thus, in embodiments, ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein can be increased using the methods of the invention to treat a condition caused by ROM1, TEAD1, RDH5, NR2E3, PAX6, CRX, FSCN2, ABCA4, MYOC, TCF4, MFSD8, CTNS, OPTN, RLBP1, RPE65, LRAT, RDH12, RGR, CNGA3, ALMS1 or IDUA deficiency. In embodiments, the condition is not caused by a deficiency of the target protein but is nonetheless treated by increasing production of the target protein using the present methods. In certain embodiments, wherein the condition that is not caused by a deficiency of the target protein but is nonetheless treated by increasing production of the target protein using the present methods, the target protein is RDH8, NXNL1, or PER1. In related embodiments, the condition treated is an in eye diseases with slow clearance or accumulation of all trans retinal and the target protein is RDH8, or the condition is jet lag, and the target protein is PER1.

In other embodiments, the methods of the invention can be used to increase ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA production to treat a condition in a subject in need thereof. In embodiments, the subject has a condition in which ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA is not necessarily deficient relative to wild-type, but where an increase in ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA mitigates the condition nonetheless. In embodiments, the condition can be caused by a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA haploinsufficiency.

ROM1

ROM1 (retinal outer segment membrane protein 1) encodes Rod outer segment membrane protein 1. This gene is a member of a photoreceptor-specific gene family and encodes an integral membrane protein found in the photoreceptor disk rim of the eye. This protein can form homodimers or can heterodimerize with another photoreceptor, retinal degeneration slow (RDS). ROM1 is essential for disk morphogenesis, and may also function as an adhesion molecule involved in the stabilization and compaction of outer segment disks or in the maintenance of the curvature of the rim. Certain defects in this gene have been associated with the degenerative eye disease retinitis pigmentosa.

Retinitis Pigmentosa-7 (RP7)

Retinitis pigmentosa 7 (RP7) is retinal dystrophy belonging to the group of pigmentary retinopathies. Retinitis pigmentosa is characterized by retinal pigment deposits visible on fundus examination and primary loss of rod photoreceptor cells followed by secondary loss of cone photoreceptors. Patients typically have night vision blindness and loss of midperipheral visual field. As their condition progresses, affected individuals lose their far peripheral visual field and eventually central vision as well. The disease may be caused by mutations affecting distinct genetic loci, including ROM1. A digenic form of retinitis pigmentosa 7 results from a mutation in the PRPH2 gene and a null mutation of the ROM1 gene has been reported.

TEAD1

TEAD1 encodes Transcriptional enhancer factor TEF-1. Transcriptional enhancer factor TEF-1 is a transcription factor which plays a key role in the Hippo signaling pathway, a pathway involved in organ size control and tumor suppression by restricting proliferation and promoting apoptosis. The core of this pathway is composed of a kinase cascade wherein MST1/MST2, in complex with its regulatory protein SAV1, phosphorylates and activates LATS1/2 in complex with its regulatory protein MOB1, which in turn phosphorylates and inactivates YAP1 oncoprotein and WWTR1/TAZ. TEAD1 acts by mediating gene expression of YAP1 and WWTR1/TAZ, thereby regulating cell proliferation, migration and epithelial mesenchymal transition (EMT) induction. TEAD1 binds specifically and cooperatively to the SPH and GT-IIC 'enhansons' (5'-GTGGAATGT-3') and activates transcription in vivo in a cell-specific manner. The activation function appears to be mediated by a limiting cell-specific transcriptional intermediary factor (TIF). TEAD1 is also involved in cardiac development, and binds to the M-CAT motif.

Sveinsson Chorioretinal Atrophy

Sveinsson chorioretinal atrophy is caused by a mutation in the TEA domain family member-1 gene TEAD1. Sveinsson's chorioretinal atrophy (SCRA), also referred to as helicoid peripapillary chorioretinal degeneration or atrophia areata, is an autosomal dominant eye disease, characterized by symmetrical lesions radiating from the optic disc involving the retina and the choroid.

RDH5

RDH5 encodes 11-cis retinol dehydrogenase. This enzyme belongs to the short-chain dehydrogenases/reductases (SDR) family. This retinol dehydrogenase functions to catalyze the final step in the biosynthesis of 11-cis retinaldehyde, which is the universal chromophore of visual pigments. Mutations in this gene cause autosomal recessive fundus albipunctatus, a rare form of night blindness that is characterized by a delay in the regeneration of cone and rod photopigments. Alternative splicing results in multiple transcript variants. Read-through transcription also exists between this gene and the neighboring upstream BLOC1S1 (biogenesis of lysosomal organelles complex-1, subunit 1) gene.

Fundus Albipunctatus

Fundus Albipuctatus is a rare form of night blindness that is characterized by a delay in the regeneration of cone and rod photopigments. This form of fleck retina disease is characterized by discrete uniform white dots over the entire fundus with greatest density in the midperiphery and no macular involvement. Night blindness occurs. Both autosomal dominant and autosomal recessive inheritance has been suggested.

NR2E3

NR2E3 encodes photoreceptor cell-specific nuclear receptor (PNR), also known as NR2E3 (nuclear receptor subfamily 2, group E, member 3). NR2E3 is a nuclear receptor of retinal photoreceptor cells. NR2E3 is a transcriptional factor that is an activator of rod development and repressor of cone development. NR2E3 binds the promoter region of a number of rod- and cone-specific genes, including rhodopsin, M- and S-opsin and rod-specific phosphodiesterase beta subunit. NR2E3 enhances rhodopsin expression and represses M- and S-cone opsin expression.

Retinitis Pigmentosa 37

Retinitis pigmentosa 37 is caused by homozygous or heterozygous mutation in the NR2E3 gene. Retinitis pigmentosa 37 (RP37) is a retinal dystrophy belonging to the group of pigmentary retinopathies. Retinitis pigmentosa is an inherited, degenerative eye disease that causes severe vision impairment due to the progressive degeneration of the rod photoreceptor cells in the retina. This form of retinal dystrophy manifests initial symptoms independent of age; thus, Retinitis pigmentosa diagnosis occurs anywhere from early infancy to late adulthood. Patients in the early stages of Retinitis pigmentosa first notice compromised peripheral and dim light vision due to the decline of the rod photoreceptors. The progressive rod degeneration is later followed by abnormalities in the adjacent retinal pigment epithelium (RPE) and the deterioration of cone photoreceptor cells. As peripheral vision becomes increasingly compromised, patients experience progressive "tunnel vision" and eventual blindness. Affected individuals may additionally experience defective light-dark adaptations, nyctalopia (night blindness), and the accumulation of bone spicules in the fundus.

PAX6

PAX6 encodes Paired box protein Pax-6 also known as aniridia type II protein (AN2) or oculorhombin. PAX6, a member of the paired box gene family, and encodes a transcriptional regulator involved in oculogenesis and other developmental processes. Pax6 is a transcription factor present during embryonic development. The encoded protein contains two different binding sites that are known to bind DNA and function as regulators of gene transcription. PAX6 is a key regulatory gene of eye and brain development. Within the brain, the protein is involved in development of the specialized cells that process smell. As a transcription factor, Pax6 activates and/or deactivates gene expression patterns to ensure for proper development of the tissue.

Aniridia

Aniridia is caused by heterozygous mutation in the PAX6 gene on chromosome 11p13. More than 280 mutations in the PAX6 gene have been found to cause aniridia, which is an absence of the iris. Most of these mutations lead to the production of an abnormally short, nonfunctional PAX6 protein. As a result, there is less PAX6 protein to regulate the activity of other genes.

The majority of mutations that cause aniridia occur within the PAX6 gene, however, some disease-causing mutations occur in neighboring regions of DNA that normally regulate the expression of the PAX6 gene, known as regulatory regions. Mutations in PAX6 gene regulatory regions reduce the expression of the PAX6 gene. These mutations lead to a shortage of functional PAX6 protein, which disrupts the formation of the eyes during development.

Aniridia is an eye disorder characterized by a complete or partial absence of the colored part of the iris. These iris abnormalities may cause the pupils to be abnormal or misshapen. Aniridia can cause reduction in visual acuity and increased sensitivity to light (photophobia). Individuals with aniridia can also have other eye problems. Increased pressure in the eye (glaucoma) typically appears in late childhood or early adolescence. Clouding of the lens of the eye (cataracts), occur in 50 percent to 85 percent of people with aniridia. In about 10 percent of affected people, the optic nerves are underdeveloped. Individuals with aniridia may also have involuntary eye movements (nystagmus) or underdevelopment of the region at the back of the eye responsible for sharp central vision (foveal hypoplasia). Many of these eye problems contribute to progressive vision loss in affected individuals. The severity of symptoms is typically the same in both eyes. Rarely, people with aniridia have behavioral problems, developmental delay, and problems detecting odors. Aniridia can be inherited in an autosomal dominant pattern. In approximately two-thirds of cases, an affected person inherits the mutation from one affected parent. The remaining one-third of cases result from new mutations in the gene and occur in people with no history of the disorder in their family.

Coloboma of the Optic Nerve

Coloboma of the optic nerve is caused by mutation in the PAX6 gene. Coloboma of the optic nerve is a congenital anomaly of the optic disc in which there is a defect of the inferior aspect of the optic nerve. Vision in the affected eye is impaired, the degree of which depends on the size of the defect, and typically affects the visual field more than visual acuity. Additionally, there is an increased risk of serous retinal detachment, manifesting in ⅓ of patients. If retinal detachment does occur, it is usually not correctable and all sight is lost in the affected area of the eye, which may or may not involve the macula.

Ocular Coloboma

Ocular coloboma is caused by heterozygous mutation in the PAX6 gene on chromosome 11p13. Coloboma is an ocular birth defect resulting from abnormal development of the eye during embryogenesis. It is defined as a congenital defect in any ocular tissue, typically presenting as absent tissue or a gap, at a site consistent with aberrant closure of the optic fissure. Failure of fusion can lead to coloboma of one or multiple regions of the inferior portion of the eye affecting any part of the globe traversed by the fissure, from the iris to the optic nerve, including the ciliary body, retina, and choroid. Coloboma is also frequently associated with small (microphthalmic) or absent (anophthalmic) eyes as part of an interrelated spectrum of developmental eye anomalies, and can affect either one or both eyes.

Foveal Hypoplasia-1

Foveal hypoplasia-1 with or without anterior segment anomalies and/or cataract (FVH1) is caused by heterozygous mutation in the PAX6 gene on chromosome 11p13. Foveal hypoplasia is defined as the lack of foveal depression with continuity of all neurosensory retinal layers in the presumed foveal area. Foveal hypoplasia as an isolated entity is a rare phenomenon; it is usually described in association with other ocular disorders, such as aniridia, microphthalmia, albinism, or achromatopsia. All reported cases of foveal hypoplasia have been accompanied by decreased visual acuity and nystagmus.

Bilateral Optic Nerve Hypoplasia

Bilateral optic nerve hypoplasia can be caused by mutations in the PAX6 gene. Optic nerve hypoplasia is a medical condition arising from the underdevelopment of the optic nerve(s). This condition is the most common congenital optic nerve anomaly. The optic disc appears abnormally small, because not all the optic nerve axons have developed properly. It is often associated with endocrinopathies (hormone deficiencies), developmental delay, and brain malformations. The optic nerve, which is responsible for transmitting visual signals from the retina to the brain, has approximately 1.2 million nerve fibers in the average person. In those diagnosed with Optic nerve hypoplasia, however, there are noticeably fewer nerves. Optic nerve hypoplasia can be unilateral (in one eye) or bilateral (in both eyes), although it presents most often bilaterally (80%). Because the unilateral cases tend to have better vision, they are typically diagnosed at a later age than those with bilateral Optic nerve hypoplasia. Visual acuity can range from no light perception to near-normal vision.

CRX

CRX encodes Cone-rod homeobox protein. Cone-rod homeobox protein is a photoreceptor-specific transcription factor which plays a role in the differentiation of photoreceptor cells. This homeodomain protein is necessary for the maintenance of normal cone and rod function. Cone-rod homeobox protein is a transcription factor that binds and transactivates the sequence 5'-TAATC[CA]-3' which is found upstream of several photoreceptor-specific genes, including the opsin genes. CRX acts synergistically with other transcription factors, such as NRL, RORB and RAX, to regulate photoreceptor cell-specific gene transcription and is essential for the maintenance of mammalian photoreceptors.

Cone-Rod Dystrophy-2 (CORD2)

Cone-rod dystrophy-2 (CORD2) is caused by heterozygous mutation in the CRX gene on chromosome 19q13. Cone-rod dystrophy 2 (CORD2) is an inherited retinal dystrophy characterized by retinal pigment deposits visible on fundus examination, predominantly in the macular region, and initial loss of cone photoreceptors followed by rod degeneration. This leads to decreased visual acuity and sensitivity in the central visual field, followed by loss of peripheral vision. Severe loss of vision occurs earlier than in retinitis pigmentosa.

Leber Congenital Amaurosis-7

Leber congenital amaurosis-7 can be caused by heterozygous or homozygous mutation in the CRX gene on chromosome 19q13. Leber congenital amaurosis comprises a group of early-onset childhood retinal dystrophies characterized by vision loss, nystagmus, and severe retinal dysfunction. Patients usually present at birth with profound vision loss and pendular nystagmus. Electroretinogram (ERG) responses are usually nonrecordable. Other clinical findings may include high hypermetropia, photodysphoria, oculodigital sign, keratoconus, cataracts, and a variable appearance to the fundus

FSCN2

FSCN2 encodes Fascin-2. This gene encodes a member of the fascin protein family. Fascins crosslink actin into filamentous bundles within dynamic cell extensions. This family member is proposed to play a role in photoreceptor disk morphogenesis. A mutation in this gene results in one form of autosomal dominant retinitis pigmentosa and macular degeneration. Multiple transcript variants encoding different isoforms have also been found.

Retinitis Pigmentosa 30

Petinitis pigmentosa 30 is caused by mutation in the retinal fascin gene (FSCN2) on chromosome 17q25. Retinitis pigmentosa 30 (RP30) is a retinal dystrophy belonging to the group of pigmentary retinopathies. Retinitis pigmentosa is characterized by retinal pigment deposits visible on fundus examination and primary loss of rod photoreceptor cells followed by secondary loss of cone photoreceptors. Patients typically have night vision blindness and loss of midperipheral visual field. As their condition progresses, they lose their far peripheral visual field and eventually central vision as well.

ABCA4

ABCA4 encodes ATP-binding cassette, sub-family A (ABC1), member 4, also known as ABCA4 or ABCR. ABCA4 is a member of the ATP-binding cassette transporter gene sub-family A (ABC1) found exclusively in multicellular eukaryotes. The ABCA4 protein is produced in photoreceptors. The ABCA4 protein is active following phototransduction, the process by which light entering the eye is converted into electrical signals that are transmitted to the brain. Phototransduction leads to the formation of potentially toxic substances. The ABCA4 protein removes one of these substances, called N-retinylidene-PE, from photoreceptor cells.

Stargardt Disease-1 (STGD1)

Stargardt disease-1 (STGD1) is caused by homozygous or compound heterozygous mutation in the ABCA4 gene (601691) on chromosome 1p22. Stargardt macular degeneration is a genetic eye disorder that causes progressive vision loss. This disorder affects the retina. Specifically, Stargardt macular degeneration affects a small area near the center of the retina called the macula. The macula is responsible for sharp central vision, which is needed for detailed tasks such as reading, driving, and recognizing faces. In most people with Stargardt macular degeneration, a fatty yellow pigment (lipofuscin) builds up in cells underlying the macula. Over time, the abnormal accumulation of this substance can damage cells that are critical for clear central vision. In addition to central vision loss, people with Stargardt macular degeneration have problems with night vision that can make it difficult to navigate in low light. Some affected individuals also have impaired color vision. The signs and symptoms of Stargardt macular degeneration typically appear in late childhood to early adulthood and worsen over time.

More than 500 mutations in the ABCA4 gene have been found to cause Stargardt macular degeneration. Most of these mutations change single amino acids in the ABCA4 protein. A malfunctioning ABCA4 protein cannot remove N-retinylidene-PE from photoreceptor cells. As a result, N-retinylidene-PE combines with another substance to produce a fatty yellow pigment called lipofuscin, which builds up in retinal cells. The buildup of lipofuscin is toxic to the cells of the retina and causes progressive vision loss in people with Stargardt macular degeneration. In most cases, Stargardt macular degeneration is caused by mutations in the ABCA4 gene.

Retinitis Pigmentosa-19 (RP19)

Retinitis Pigmentosa-19 (RP19) can be caused by homozygous or compound heterozygous mutation in the ABCR gene (ABCA4) on chromosome 1p22. Retinitis pigmentosa is an inherited eye disorder characterized by progressive loss of peripheral vision and night vision difficulties that can cause central vision loss. There are a large number of genes linked to retinitis pigmentosa. Type 19 is linked to a genetic defect on chromosome 1p21-p13. Retinitis Pigmentosa-19 is characterized by night-blindness, peripheral loss of vision, progressive retinal degeneration, tunnel vision, progressive vision loss, decreased vision at night or in low light, loss of central vision in advanced phases, and retinal pigment epithelium mottling.

Age-Related Macular Degeneration-2 (ARMD2)

Age-related macular degeneration-2 (ARMD2) is conferred by variation in the ABCA4 gene on chromosome 1p22. Age-related macular degeneration is an eye disease that is a leading cause of vision loss in older people in developed countries. The vision loss usually becomes noticeable in a person's sixties or seventies and tends to worsen over time. Age-related macular degeneration mainly affects central vision, which is needed for detailed tasks such as reading, driving, and recognizing faces. The vision loss in this condition results from a gradual deterioration of light-sensing cells in the tissue at the back of the eye that detects light and color (the retina). Specifically, age-related macular degeneration affects a small area near the center of the retina, called the macula, which is responsible for central vision. Side (peripheral) vision and night vision are generally not affected. Researchers have described two major types of age-related macular degeneration, known as the dry form and the wet form. The dry form is much more common, accounting for 85 to 90 percent of all cases of age-related macular degeneration. It is characterized by a buildup of yellowish deposits called drusen beneath the retina and slowly progressive vision loss. The condition typically affects vision in both eyes, although vision loss often occurs in one eye before the other. The wet form of age-related macular degeneration is associated with severe vision loss that can worsen rapidly. This form of the condition is characterized by the growth of abnormal, fragile blood vessels underneath the macula. These vessels leak blood and fluid, which damages the macula and makes central vision appear blurry and distorted.

Cone-Rod Dystrophy-3 (CORD3)

Cone-rod dystrophy-3 (CORD3) is caused by homozygous or compound heterozygous mutation in the ABCA4 on chromosome 1p22. Cone rod dystrophies are inherited retinal dystrophies that belong to the group of pigmentary retinopathies. The prevalence of Cone rod dystrophie is estimated at 1 in 40,000. Cone rod dystrophies are characterized by retinal pigment deposits, visible on fundus examination, predominantly localized to the macular region. In contrast to typical retinitis pigmentosa (RP), also called the rod cone dystrophies (RCDs), resulting from the primary loss in rod photoreceptors and later followed by the secondary loss in cone photoreceptors, Cone rod dystrophies reflect the opposite sequence of events. Cone rod dystrophy is characterized by primary cone involvement or, sometimes, by concomitant loss of both cones and rods, explaining the predominant symptoms of Cone rod dystrophies: decreased visual acuity, color vision defects, photoaversion and decreased sensitivity in the central visual field, later followed by progressive loss in peripheral vision and night blindness. The clinical course of Cone rod dystrophies is generally more severe and rapid than that of RCDs, leading to earlier legal blindness and disability. At end stage, however, Cone rod dystrophies do not differ from RCDs. Cone rod dystrophies are most frequently nonsyndromic, but they may also be part of several syndromes, such as Bardet-Biedl syndrome and Spinocerebellar Ataxia Type 7 (SCAT). Non-syndromic Cone rod dystrophies are genetically heterogeneous (ten cloned genes and three loci have been identified so far). The four major causative genes involved in the pathogenesis of Cone rod dystrophies are ABCA4 (which causes Stargardt disease and also 30 to 60% of autosomal recessive Cone rod dystrophies), CRX and GUCY2D (which are responsible for many reported cases of autosomal dominant Cone rod dystrophies), and RPGR (which causes about ⅔ of X-linked RP and also an undetermined percentage of X-linked Cone rod dystrophies). It is likely that highly deleterious mutations in genes that otherwise cause RP or macular dystrophy may also lead to Cone rod dystrophies. The diagnosis of Cone rod dystrophies is based on clinical history, fundus examination and electroretinogram. Moleculardiagnosis can be made for some genes, genetic counseling is always advised. Currently, there is no therapy that stops the evolution of the disease or restores the vision, and the visual prognosis is poor. Management aims at slowing down the degenerative process, treating the complications and helping patients to cope with the social and psychological impact of blindness.

MYOC

The MYOC gene encodes myocilin. Myocilin is found in the trabecular meshwork and the ciliary body that regulate intraocular pressure. It is also found in various types of muscle. Myocilin's function is not well understood, but it may help to control the intraocular pressure through its action in the muscle tissue of the ciliary body. Researchers believe that myocilin functions together with other proteins as part of a protein complex. Myocilin may interact with a number of other proteins including a form of the cytochrome P450 protein, the product of the CYP1B1 gene.

Primary Open Angle Glaucoma

Primary open angle glaucoma (POAG), designated GLC1A, is caused by heterozygous mutation in the MYOC gene on chromosome 1q. There are no symptoms associated with POAG. The pressure in the eye slowly rises and the cornea adapts without swelling. If the cornea were to swell, which is usually a signal that something is wrong, symptoms would be present. But as this is not the case, this disease often goes undetected. It is painless, and the patient often does not realize that he or she is slowly losing vision until the later stages of the disease. However, by the time the vision is impaired, the damage is irreversible. Glaucoma is a group of eye disorders in which the optic nerves connecting the eyes and the brain are progressively damaged. This damage can lead to reduction in side (peripheral) vision and eventual blindness. Other signs and symptoms may include bulging eyes, excessive tearing, and abnormal sensitivity to light (photophobia). The term "early-onset glaucoma" may be used when the disorder appears before the age of 40. In most people with glaucoma, the damage to the optic nerves is caused by increased pressure within the eyes (intraocular pressure). Intraocular pressure depends on a balance between fluid entering and leaving the eyes. Usually glaucoma develops in older adults, in whom the risk of developing the disorder may be affected by a variety of medical conditions including high blood pressure (hypertension) and diabetes mellitus, as well as family history. The risk of early-onset glaucoma depends mainly on heredity. Structural abnormalities that impede fluid drainage in the eye may be present at birth and usually become apparent during the first year of life. Such abnormalities may be part of a genetic disorder that affects many body systems, called a syndrome. If glaucoma appears before the age of 5 without other associated abnormalities, it is called primary congenital glaucoma. Other individuals experience early onset of primary open-angle glaucoma, the most common adult form of glaucoma. If primary open-angle glaucoma develops during childhood or early adulthood, it is called juvenile open-angle glaucoma.

TCF4

TCF4 encodes TCF4, or sometimes referred to as immunoglobulin transcription factor 2. TCF4 is a broadly expressed basic helix-loop-helix (bHLH) protein that functions as a homodimer or as a heterodimer with other bHLH proteins. These dimers bind DNA at Ephrussi (E) box sequences. Alternative splicing produces numerous N-terminally distinct TCF4 isoforms that differ in their subcellular localization and transactivational capacity. TCF4 proteins act as transcription factors which will bind to the immunoglobulin enhancer mu-E5/kappa-E2 motif. TCF4 activates transcription by binding to the E-box (5'-CANNTG-3') found usually on SSTR2-INR, or somatostatin receptor 2 initiator element. TCF4 is primarily involved in neurological development of the fetus during pregnancy by initiating neural differentiation by binding to DNA. It is found in the central nervous system, somites, and gonadal ridge during early development. Later in development it will be found in the thyroid, thymus, and kidneys while in adulthood TCF4 it will be found in lymphocytes, muscles, and gastrointestinal system.

Fuchs Endothelial Corneal Dystrophy-3 (FECD3)

Fuchs endothelial corneal dystrophy-3 (FECD3) is caused by heterozygous intronic trinucleotide repeat expansion (CTG)n in the TCF4 gene on chromosome 18q22. Late-onset Fuchs endothelial corneal dystrophy (FECD) is a degenerative disorder affecting roughly 4% of the population older than 40 years. It is distinguished from other corneal disorders by the progressive formation of guttae, which are microscopic refractile excrescences of the Descemet membrane, a collagen-rich basal lamina secreted by the corneal endothelium. From onset, it usually takes 2 decades for FECD to impair endothelial cell function seriously, leading to stromal edema and impaired vision. The first symptom of this condition is typically blurred vision in the morning that usually clears during the day. Over time, affected individuals lose visual acuity. People with Fuchs endothelial dystrophy also become sensitive to bright lights. Fuchs endothelial dystrophy specifically affects the front surface of the eye called the cornea. Deposits called guttae, which are detectable during an eye exam, form in the middle of the cornea and eventually spread. These guttae contribute to the loss of cells in the cornea, leading to vision problems. Tiny blisters may develop on the cornea, which can burst and cause eye pain. The signs and symptoms of Fuchs endothelial dystrophy usually begin in a person's forties or fifties. A very rare early-onset variant of this condition starts to affect vision in a person's twenties.

MFSD8

MFSD8 encodes Major facilitator superfamily domain containing 8 also known as MFSD8. The MFSD8 protein is found in cell lysosomes. The MFSD8 protein belongs to a large group of related proteins called the major facilitator superfamily of secondary active transporter proteins. Proteins in this family move certain molecules between structures in cells or in and out of cells. While it is likely that the MFSD8 protein transports molecules, the specific molecules it moves are unknown. The MFSD8 protein probably transports substances across the membranes of lysosomes.

Macular Dystrophy with Central Cone Involvement (CCMD)

Macular dystrophy with central cone involvement (CCMD) is caused by compound heterozygous mutation in the MFSD8 gene on chromosome 4q28. This is primarily a cone dystrophy but there is evidence of some rod damage in older patients. A mild decrease in central acuity is noted by individuals in the third to sixth decades. Slight pigmentary changes and color vision abnormalities can be documented with the onset of these symptoms and a bull's eye maculopathy and severe atrophy of the central fovea may be present. An enlarging central scotoma with normal periphery can sometimes be identified. Other patients have an atrophic appearance to the peripapillary area with a pale optic disc. Compound heterozygosity for a missense mutation and a nonsense mutation in the MFSD8 gene (4q28.2) has been found among members of a Dutch sibship suggesting autosomal recessive inheritance.

CTNS

The CTNS gene encodes called cystinosin. This protein is located in the membrane of lysosomes, which are compartments in the cell that digest and recycle materials. Proteins digested inside lysosomes are broken down into smaller amino acids. The amino acids are then moved out of lysosomes by transport proteins. Cystinosin is a transport protein that specifically moves the amino acid cystine out of the lysosome.

Ocular Nonnephropathic Cystinosis

Ocular nonnephropathic cystinosis is caused by mutation in the gene encoding cystinosin (CTNS) which maps to chromosome 17p13. Ocular nonnephropathic cystinosis, a variant of the classic nephropathic type of cystinosis, is an autosomal recessive lysosomal storage disorder characterized by photophobia due to corneal cystine crystals but absence of renal disease. More than 80 different mutations that are responsible for causing cystinosis have been identified in the CTNS gene. The most common mutation is a deletion of a large part of the CTNS gene (sometimes referred to as the 57-kb deletion), resulting in the complete loss of cystinosin. This deletion is responsible for approximately 50 percent of cystinosis cases in people of European descent. Other mutations result in the production of an abnormally short protein that cannot carry out its normal transport function. Mutations that change very small regions of the CTNS gene may allow the transporter protein to retain some of its usual activity, resulting in a milder form of cystinosis.

NXNL1

NXNL1 encodes Nucleoredoxin-Like 1 (NXNL1). NXNL1 may play a role in cone cell viability, slowing down cone degeneration. NXNL1 does not seem to play a role in degenerating rods. Diseases associated with NXNL1 include leber congenital amaurosis and bardet-biedl syndrome. Leber congenital amaurosis is an eye disorder that primarily affects the retina. Individuals with this condition typically have severe visual impairment beginning in infancy. Other features include photophobia, involuntary movements of the eyes (nystagmus), and extreme farsightedness. The pupils also do not react normally to light. Additionally, the cornea may be cone-shaped and abnormally thin (keratoconus). Franceschetti's oculo-digital sign is characteristic of leber congenital amaurosis. This sign consists of poking, pressing, and rubbing the eyes with a knuckle or finger. At least 13 types of this condition have been described, which are distinguished by their genetic cause, patterns of vision loss, and related eye abnormalities.

Bardet-biedl syndrome is an inherited condition that affects many parts of the body. Individuals with this condition have progressive visual impairment due to cone-rod dystrophy, extra fingers or toes (polydactyly), truncal obesity, decreased function of the male gonads (hypogonadism), kidney abnormalities, and learning difficulties. At least 14 genes are known to be associated with bardet-biedl syndrome. This condition is usually inherited in an autosomal recessive pattern.

OPTN\

The OPTN gene encodes the coiled-coil containing protein optineurin. Optineurin may play a role in normal-tension glaucoma and adult-onset primary open angle glaucoma. Optineurin interacts with adenovirus E3-14.7K protein and may utilize tumor necrosis factor-alpha or Fas-ligand pathways to mediate apoptosis, inflammation or vasoconstriction. Optineurin may also function in cellular morphogenesis and membrane trafficking, vesicle trafficking, and transcription activation through its interactions with the RAB8, huntingtin, and transcription factor IIIA proteins. Alternative splicing results in multiple transcript variants encoding the same protein.

Optineurin plays an important role in the maintenance of the Golgi complex, in membrane trafficking, in exocytosis, through its interaction with myosin VI and Rab8. Optineurin links myosin VI to the Golgi complex and plays an important role in Golgi ribbon formation. Optineurin negatively regulates the induction of IFNB in response to RNA virus infection. Optineurin plays a neuroprotective role in the eye and optic nerve. Optineurin is indicated as part of the TNF-alpha signaling pathway that can shift the equilibrium toward induction of cell death. Optineurin may act by regulating membrane trafficking and cellular morphogenesis via a complex that contains Rab8 and hungtingtin (HD). Optineurin mediates the interaction of Rab8 with the probable GTPase-activating protein TBC1D17 during Rab8-mediated endocytic trafficking, such as of transferrin receptor (TFRC/TfR); regulates Rab8 recruitment to tubules emanating from the endocytic recycling compartment. Autophagy receptor that interacts directly with both the cargo to become degraded and an autophagy modifier of the MAP1 LC3 family; targets ubiquitin-coated bacteria (xenophagy), such as cytoplasmic *Salmonella enterica*, and appears to function in the same pathway as SQSTM1 and CALCOCO2/NDP52. Optineurin may constitute a cellular target for adenovirus E3 14.7, an inhibitor of TNF-alpha functions, thereby affecting cell death.

Primary Open Angle Glaucoma;

Primary open angle glaucoma (POAG) is characterized by a specific pattern of optic nerve and visual field defects. The angle of the anterior chamber of the eye is open, and usually the intraocular pressure is increased. However, glaucoma can occur at any intraocular pressure. The disease is generally asymptomatic until the late stages, by which time significant and irreversible optic nerve damage has already taken place. The disease is caused by mutations affecting the OPTN gene Amyotrophic Lateral Sclerosis 12

Amyotrophic lateral sclerosis 12 (ALS12) is a neurodegenerative disorder affecting upper motor neurons in the brain and lower motor neurons in the brain stem and spinal cord, resulting in fatal paralysis. Sensory abnormalities are absent. The pathologic hallmarks of the disease include pallor of the corticospinal tract due to loss of motor neurons, presence of ubiquitin-positive inclusions within surviving motor neurons, and deposition of pathologic aggregates. The etiology of amyotrophic lateral sclerosis is likely to be multifactorial, involving both genetic and environmental factors. The disease is inherited in 5-10% of the cases.

In some cases, in a patient with amyotrophic lateral sclerosis 12, heterozygous mutations in the OPTN (G538EfsX27) and TBK1 (R117X) genes can be identified. In some cases, in a patient with amyotrophic lateral sclerosis 12, a deletion of exon 5 can be identified. In some cases, in a patient with amyotrophic lateral sclerosis 12, a nonsense mutation (Q398X) can be identified. In some cases, in a patient with amyotrophic lateral sclerosis 12, heterozygosity for a missense mutation (E478G) within the OPTN ubiquitin-binding domain can be identified.

RLBP1

The RLBP1 gene encodes is a 36-kD water-soluble protein which carries 11-cis-retinaldehyde or 11-cis-retinal as physiologic ligands. The RLBP1 protein may be a functional component of the visual cycle. Mutations of this gene have been associated with severe rod-cone dystrophy, Bothnia dystrophy (nonsyndromic autosomal recessive retinitis pigmentosa) and retinitis punctata albescens.

Bothnia Retinal Dystrophy

Bothnia retinal dystrophy (BRD) is a type of retinitis punctata albescens. Affected individuals show night blindness from early childhood with features consistent with retinitis punctata albescens and macular degeneration. The disease is caused by mutations affecting the RLBP1 gene.

Fundus Albipunctatus

Fundus albipunctatus is a retinal disorder characterized by night blindness and delayed dark adaptation after exposure to bright light, which typically presents during early childhood. The fundi of affected individuals contain multiple small, white or pale yellow dots in the retinal pigment epithelium, which may or may not involve the macula. These dots can remain unchanged, become more prominent, or can fade during aging; new dots may also appear. The dark-adaptation curve of affected individuals features prolonged recovery of cone and rod sensitivity and electroretinogram cone and rod amplitudes are markedly reduced after 30-40 minutes of dark adaptation; however, they may come to normal or near-normal levels after many hours of adaptation showed that approximately 38% of individuals with fundus albipunctatus have extensive cone dysfunction. Mutations in the RLBP1 gene have also been reported in fundus albipunctatus patients.

Retinitis Punctata Albescens

Retinitis punctata albescens (RPA) is a form of fleck retina disease characterized by aggregation of white flecks posteriorly in the retina, causing night blindness and delayed dark adaptation. It differs from fundus albipunctatus in being progressive and evolving to generalized atrophy of the retina. The disease is caused by mutations affecting the RLBP1 gene.

RPE65

The RPE65 gene alos "retinal pigment epithelium-specific protein 65 kDa." The RPE65 gene encodes the RPE65 protein that is essential for normal vision. The RPE65 protein is produced in the retinal pigment epithelium (RPE). The RPE supports and nourishes the retina, which is the light-sensitive tissue that lines the back of the eye. The RPE65 protein is involved in a multi-step process called the visual cycle, which converts light entering the eye into electrical signals that are transmitted to the brain. When light hits photosensitive pigments in the retina, it changes 11-cis retinal (a form of vitamin A) to all-trans retinal. This conversion triggers a series of chemical reactions that create electrical signals. The RPE65 protein then helps convert all-trans retinal back to 11-cis retinal so the visual cycle can begin again

Leber Congenital Aamaurosis 2

Leber congenital amaurosis is an eye disorder that primarily affects the retina, which is the specialized tissue at the back of the eye that detects light and color. People with this disorder typically have severe visual impairment beginning in infancy. The visual impairment tends to be stable, although it may worsen very slowly over time.

Leber congenital amaurosis is also associated with other vision problems, including an increased sensitivity to light (photophobia), involuntary movements of the eyes (nystagmus), and extreme farsightedness (hyperopia). The pupils, which usually expand and contract in response to the amount of light entering the eye, do not react normally to light. Instead, they expand and contract more slowly than normal, or they may not respond to light at all. Additionally, the clear front covering of the eye (the cornea) may be cone-shaped and abnormally thin, a condition known as keratoconus.

A specific behavior called Franceschetti's oculo-digital sign is characteristic of Leber congenital amaurosis. This sign consists of poking, pressing, and rubbing the eyes with a knuckle or finger. Researchers suspect that this behavior may contribute to deep-set eyes and keratoconus in affected children.

In rare cases, delayed development and intellectual disability have been reported in people with the features of Leber congenital amaurosis. However, it is uncertain whether these individuals actually have Leber congenital amaurosis or another syndrome with similar signs and symptoms. At least 13 types of Leber congenital amaurosis have been described. The types are distinguished by their genetic cause, patterns of vision loss, and related eye abnormalities. Leber Congenital Aamaurosis 2 is distinguished by moderate visual impairment at infancy that progresses to total blindness by mid to late adulthood. One of the unique qualities of Leber Congenital Aamaurosis 2 is that, even with profound early visual impairment, retinal cells are relatively preserved.

In some cases, in patients with leber congenital amaurosis 2, compound heterozygosity for mutations in the RPE65 gene, a 1-bp deletion and/or a nonsense mutation can be identified.

Retinitis Pigmentosa 20

Retinitis pigmentosa 20 is retinal dystrophy belonging to the group of pigmentary retinopathies. Retinitis pigmentosa is characterized by retinal pigment deposits visible on fundus examination and primary loss of rod photoreceptor cells followed by secondary loss of cone photoreceptors. Patients typically have night vision blindness and loss of midperipheral visual field. As their condition progresses, they lose their far peripheral visual field and eventually central vision as well.

LRAT

LRAT gene, or lecithin retinol acyltransferase (phosphatidylcholine-retinol O-acyltransferase) encodes the LRAT protein that localized to the endoplasmic reticulum, where it catalyzes the esterification of all-trans-retinol into all-transretinyl ester. This reaction is an important step in vitamin A metabolism in the visual system. Mutations in this gene have been associated with early-onset severe retinal dystrophy and Leber congenital amaurosis 14. Alternative splicing results in multiple transcript variants. The LRAT protein transfers the acyl group from the sn-1 position of phosphatidylcholine to all-trans retinol, producing all-trans retinyl esters. Retinyl esters are storage forms of vitamin A. LRAT plays a critical role in vision. It provides the all-trans retinyl ester substrates for the isomerohydrolase which processes the esters into 11-cis-retinol in the retinal pigment epithelium; due to a membrane-associated alcohol dehydrogenase, 11 cis-retinol is oxidized and converted into 11-cis-retinaldehyde which is the chromophore for rhodopsin and the cone photopigments.

Leber Congenital Amaurosis 14;

Leber congenital amaurosis 14 (LCA14) is a severe dystrophy of the retina, typically becoming evident in the first years of life. Visual function is usually poor and often accompanied by nystagmus, sluggish or near-absent pupillary responses, photophobia, high hyperopia and keratoconus. The disease is caused by mutations affecting the LRAT gene.

Retinitis Pigmentosa

Retinitis pigmentosa is a group of related eye disorders that cause progressive vision loss. These disorders affect the retina, which is the layer of light-sensitive tissue at the back of the eye. In people with retinitis pigmentosa, vision loss occurs as the light-sensing cells of the retina gradually deteriorate. The first sign of retinitis pigmentosa is usually a loss of night vision, which becomes apparent in childhood. Problems with night vision can make it difficult to navigate in low light. Later, the disease causes blind spots to develop in the side (peripheral) vision. Over time, these blind spots merge to produce tunnel vision. The disease progresses over years or decades to affect central vision, which is needed for detailed tasks such as reading, driving, and recognizing faces. In adulthood, many people with retinitis pigmentosa become legally blind.

The signs and symptoms of retinitis pigmentosa are most often limited to vision loss. When the disorder occurs by itself, it is described as nonsyndromic. Researchers have identified several major types of nonsyndromic retinitis pigmentosa, which are usually distinguished by their pattern of inheritance: autosomal dominant, autosomal recessive, or X-linked. Less commonly, retinitis pigmentosa occurs as part of syndromes that affect other organs and tissues in the body. These forms of the disease are described as syndromic. The most common form of syndromic retinitis pigmentosa is Usher syndrome, which is characterized by the combination of vision loss and hearing loss beginning early in life. Retinitis pigmentosa is also a feature of several other genetic syndromes, including Bardet-Biedl syndrome; Refsum disease; and neuropathy, ataxia, and retinitis pigmentosa (NARP).

RDH8

Retinol dehydrogenase 8 (all-trans) is an enzyme encoded by the RDH8 gene. All-trans-retinol dehydrogenase (RDH8) is a visual cycle enzyme that reduces all-trans-retinal to all-trans-retinol in the presence of NADPH. It is a member of the short chain dehydrogenase/reductase family and is located in the outer segments of photoreceptors; hence it is also known as photoreceptor retinol dehydrogenase. It is important in the visual cycle by beginning the rhodopsin regeneration pathway by reducing all-trans-retinal, the product of bleached and hydrolyzed rhodopsin.

RDH12

The RDH12 gene, Retinol dehydrogenase 12 (all-trans/9-cis/11-cis), encodes the RDH12 protein which is an NADPH-dependent retinal reductase whose highest activity is toward 9-cis and all-trans-retinol. The encoded enzyme also plays a role in the metabolism of short-chain aldehydes but does not exhibit steroid dehydrogenase activity. Defects in this gene are a cause of Leber congenital amaurosis type 13 and Retinitis Pigmentosa 53.

Leber Congenital Amaurosis13

Leber congenital amaurosis 13 (LCA13) is a severe dystrophy of the retina, typically becoming evident in the first years of life. Visual function is usually poor and often accompanied by nystagmus, sluggish or near-absent pupillary responses, photophobia, high hyperopia and keratoconus. In some cases, leber congenital amaurosis-13 can be caused by homozygous or compound heterozygous mutation in the photoreceptor-specific retinal dehydrogenase gene RDH12 on chromosome 14q23.3.

Retinitis Pigmentosa 53

Retinitis pigmentosa 53 (RP53) is a retinal dystrophy belonging to the group of pigmentary retinopathies. Retinitis pigmentosa is characterized by retinal pigment deposits visible on fundus examination and primary loss of rod photoreceptor cells followed by secondary loss of cone photoreceptors. Patients typically have night vision blindness and loss of midperipheral visual field. As their condition progresses, they lose their far peripheral visual field and eventually central vision as well.

RGR

The RGR gene encodes a putative retinal G-protein coupled receptor. The gene is a member of the opsin subfamily of the 7 transmembrane, G-protein coupled receptor 1 family. Like other opsins which bind retinaldehyde, it contains a conserved lysine residue in the seventh transmembrane domain. The protein acts as a photoisomerase to catalyze the conversion of all-trans-retinal to 11-cis-retinal. The reverse isomerization occurs with rhodopsin in retinal photoreceptor cells. The protein is exclusively expressed in tissue adjacent to retinal photoreceptor cells, the retinal pigment epithelium and Mueller cells. This gene may be associated with autosomal recessive and autosomal dominant retinitis pigmentosa (arRP and adRP, respectively). Alternative splicing results in multiple transcript variants encoding different isoforms. Retinal G protein-coupled receptor (RGR) is a rhodopsin homolog found exclusively in cells adjacent to the retinal photoreceptor cells (i.e., the retinal pigment epithelium and Muller cells). It preferentially binds all-trans retinal rather than 11-cis retinal, which is normally found in rhodopsin. In mammals, photons of light convert all-trans retinal within RGR to 11-cis retinal, whereas the reverse isomerization reaction occurs in rhodopsin in photoreceptor cells.

Retinitis Pigmentosa 44

Retinitis pigmentosa 44 (RP44) is a retinal dystrophy belonging to the group of pigmentary retinopathies. Retinitis pigmentosa is characterized by retinal pigment deposits visible on fundus examination and primary loss of rod photoreceptor cells followed by secondary loss of cone photoreceptors. Patients typically have night vision blindness and loss of midperipheral visual field. As their condition progresses, they lose their far peripheral visual field and eventually central vision as well. The disease is caused by mutations affecting the RGR gene.

CNGA3

The CNGA3 or cyclic nucleotide gated channel alpha 3 gene encodes one part (the alpha subunit) of the cone photoreceptor cyclic nucleotide-gated (CNG) channel. These channels are found exclusively in cones, which are located in the retina. Cones provide vision in bright light (daylight vision), including color vision.

CNG channels are openings in the cell membrane that transport cations into cells. In cones, CNG channels remain open under dark conditions, allowing cations to flow in. When light enters the eye, it triggers the closure of these channels, stopping the inward flow of cations. This change in cation transport alters the cone's electrical charge, which ultimately causes phototransduction. More than 100 mutations in the CNGA3 gene have been found to cause the vision disorder achromatopsia. These mutations underlie about 25 percent of cases of complete achromatopsia, a form of the disorder characterized by a total lack of color vision and other vision problems that are present from early infancy. CNGA3 gene mutations have also been identified in a few individuals with incomplete achromatopsia, a milder form of the disorder associated with limited color vision.

The CNGA3 gene mutations that underlie complete achromatopsia affect the production or function of the alpha subunit. In some cases, no protein is produced. In others, the protein is altered and does not function normally. CNG channels assembled without the alpha subunit or with an abnormal subunit are nonfunctional; they prevent cones from carrying out phototransduction. In some cases, defective channels allow a huge influx of cations into cones, which ultimately causes these cells to undergo apoptosis. A loss of cone function underlies the lack of color vision and other vision problems in people with complete achromatopsia.

A few mutations in the CNGA3 gene reduce but do not eliminate the function of CNG channels in cones. These mutations cause incomplete achromatopsia because the partially functioning cones can transmit some visual information to the brain. Because these CNG channels are specific to cones, rods are generally unaffected by this disorder.

Mutations in the CNGA3 gene have also been identified in a small percentage of cases of progressive cone dystrophy. However, unlike achromatopsia, progressive cone dystrophy is associated with cones that work normally at birth but begin to malfunction in childhood or adolescence. Over time, people with progressive cone dystrophy develop increasing blurriness and loss of color vision. It is unclear why some CNGA3 gene mutations cause achromatopsia and others result in progressive cone dystrophy Achromatopsia-2

Achromatopsia-2 is an autosomal recessive disorder and is total colorblindness, also referred to as rod monochromacy or complete achromatopsia, is a rare congenital autosomal recessive disorder characterized by photophobia, reduced visual acuity, nystagmus, and the complete inability to discriminate between colors. Electroretinographic recordings show that in achromatopsia the rod photoreceptor function is normal, whereas cone photoreceptor responses are absent.

PER1

The PER1 gene encodes the period circadian protein homolog 1 protein in humans. PER1 is a master regulator of circadian rhythm and functions in the nucleus to repress expression of the central circadian clock genes (e.g., CLOCK). The periodicity of PER1 abundance, nuclear translocation, and transcriptional repression is regulated by PER1 phosphorylation, ubiquitination, and proteasomal degradation The PER1 protein is important to the maintenance of circadian rhythms in cells, and m ay also play a role in the development of cancer. This gene is a member of the period family of genes. It is expressed with a daily oscillating circadian rhythm, or an oscillation that cycles with a period of approximately 24 hours. PER1 is most notably expressed in the region of the brain called the suprachiasmatic nucleus (SCN), which is the primary circadian pacemaker in the mammalian brain. PER1 is also expressed throughout mammalian peripheral tissues. Genes in this family encode components of the circadian rhythms of locomotor activity, metabolism, and behavior. Circadian expression of PER1 in the suprachiasmatic nucleus will free-run in constant darkness, meaning that the 24-hour period of the cycle will persist without the aid of external light cues. Subsequently, a shift in the light/dark cycle evokes a proportional shift of gene expression in the suprachiasmatic nucleus. The time of gene expression is sensitive to light, as light during a mammal's subjective night results in a sudden increase in per expression and thus a shift in phase in the suprachiasmatic nucleus. Alternative splicing has been observed in this gene. In some cases, PER1 can be involved in the effects of Jet lag.

IDUA

The IDUA gene encodes an enzyme called alpha-L-iduronidase, which is essential for the breakdown of large sugar molecules, for example glycosaminoglycans (GAGs). Through hydrolysis, alpha-L-iduronidase uses water molecules to break down unsulfated alpha-L-iduronic acid, which is present in heparan sulfate and dermatan sulfate. Alpha-L-iduronidase can be located in lysosomes. More than 100 mutations in the IDUA gene have been found to cause mucopolysaccharidosis type I (MPS I). Most mutations that cause MPS I reduce or completely eliminate the function of alpha-L-iduronidase. It usually cannot be determined whether a certain mutation will cause severe or attenuated MPS I; however, people who do not produce any alpha-L-iduronidase have the severe form of this disorder.

The lack of alpha-L-iduronidase enzyme activity leads to the accumulation of heparan sulfate and dermatan sulfate within the lysosomes. The buildup of GAGs increases the size of the lysosomes. The accumulated GAGs may also interfere with the functions of other proteins inside the lysosomes and disrupt the movement of molecules inside the cell.

Attenuated MPS-1

Mucopolysaccharidosis type I (MPS I) is a condition that affects many parts of the body. This disorder was once divided into three separate syndromes: Hurler syndrome (MPS I-H), Hurler-Scheie syndrome (MPS I-H/S), and Scheie syndrome (MPS I-S), listed from most to least severe. Because there is so much overlap between each of these three syndromes, MPS I is currently divided into the severe and attenuated types.

Children with MPS I often have no signs or symptoms of the condition at birth, although some have a soft outpouching around the belly-button (umbilical hernia) or lower abdomen (inguinal hernia). People with severe MPS I generally begin to show other signs and symptoms of the disorder within the first year of life, while those with the attenuated form have milder features that develop later in childhood.

Individuals with MPS I may have a large head (macrocephaly), a buildup of fluid in the brain (hydrocephalus), heart valve abnormalities, distinctive-looking facial features that are described as "coarse," an enlarged liver and spleen (hepatosplenomegaly), and a large tongue (macroglossia). Vocal cords can also enlarge, resulting in a deep, hoarse voice. The airway may become narrow in some people with MPS I, causing frequent upper respiratory infections and short pauses in breathing during sleep (sleep apnea).

People with MPS I often develop clouding of the clear covering of the eye (cornea), which can cause significant vision loss. Affected individuals may also have hearing loss and recurrent ear infections.

Some individuals with MPS I have short stature and joint deformities (contractures) that affect mobility. Most people with the severe form of the disorder also have dysostosis multiplex, which refers to multiple skeletal abnormalities seen on x-ray. Carpal tunnel syndrome develops in many children with this disorder and is characterized by numbness, tingling, and weakness in the hand and fingers. Narrowing of the spinal canal (spinal stenosis) in the neck can compress and damage the spinal cord.

While both forms of MPS I can affect many different organs and tissues, people with severe MPS I experience a decline in intellectual function and a more rapid disease progression. Developmental delay is usually present by age 1, and severely affected individuals eventually lose basic functional skills (developmentally regress). Children with this form of the disorder usually have a shortened lifespan, sometimes living only into late childhood. Individuals with attenuated MPS I typically live into adulthood and may or may not have a shortened lifespan. Some people with the attenuated type have learning disabilities, while others have no intellectual impairments. Heart disease and airway obstruction are major causes of death in people with both types of MPS I.

Hurler-Scheie Syndrome

Hurler-Scheie syndrome is the intermediate form of mucopolysaccharidosis type 1 (MPS1) between the two extremes Hurler syndrome and Scheie syndrome, it is a rare lysosomal storage disease, characterized by skeletal deformities and a delay in motor development. The prevalence of MPS I has been estimated at 1/100,000, with Hurler-Scheie syndrome accounting for 23% of cases or a prevalence of approximately 1/435,000. Patients with Hurler-Scheie syndrome have normal or almost normal intelligence but exhibit various degrees of physical impairment. Patients present in the first years of life with musculoskeletal alterations to different degrees including short stature, multiple dysostosis, thoracic-lumbar kyphosis, progressive coarsening of the facial features to different degrees, cardiomyopathy and valvular abnormalities, neurosensorial hearing loss, enlarged tonsils and adenoids, and nasal secretion. Hydrocephaly can occur after the age of two. Corneal opacity is seen between two and four years of age and requires keratoplasty to restore sight. Other manifestations may include organomegaly, hernias and hirsutism.

Hurler-Scheie syndrome is caused by mutations in the IDUA gene (4p16.3) leading to partial deficiency in the alpha-L-iduronidase enzyme and lysosomal accumulation of dermatan sulfate and heparan sulfate. Early diagnosis is difficult because the first clinical signs are not specific. Diagnosis can be based on detection of increased urinary secretion of heparan and dermatan sulfate through 1,9-dimethylmethylene blue (DMB) test and glycosaminoglycan (GAG) electrophoresis, and demonstration of enzymatic deficiency in leukocytes or fibroblasts. Genetic testing is available. Differential diagnoses include the milder and more severe forms of mucopolysaccharidosis type 1 (Scheie syndrome and Hurler syndrome respectively), mucopolysaccharidosis typeVI and mucopolysaccharidosis type II. Antenatal diagnosis is possible by measurement of enzymatic activity in cultivated chorionic villus or amniocytes and by genetic testing if the disease-causing mutation is known. Transmission is autosomal recessive. Bone marrow or umbilical cord blood transplant has been successful and can preserve neurocognition, improve some aspects of the somatic disease and increase survival. However it is associated with many risks and most of the positive effects occur only if the procedure is performed in the first two years of life.

The enzyme substitute (laronidase) obtained EU marketing authorization as an orphan drug in 2003. Given through weekly infusions it leads to improvement of lung function and joint mobility. Enzyme replacement therapy (ERT) can be started at diagnosis and may be beneficial in patients awaiting hematopoietic stem cell transplantation (HSCT). Early treatment can slow the progression of the disease. In individual patients with MPS1 of intermediate severity, HSCT may be considered if there is a suitable donor. There are however no data on the efficacy of HSCT in patients with this form of the disease.

Life expectancy for Hurler-Scheie syndrome may be reduced, with death occurring before adolescence due to serious cardiovascular and respiratory complications.

In some cases, in a patient with hurler scheie syndrome, homozygosity for an arg619-to-gly (R619G) mutation due to a C-to-G transversion at nucleotide 1943 can be identified. In some cases, in a patient with hurler scheie syndrome, homozygosity for a thr364-to-met (T364M) mutation in the IDUA gene can be identified.

ALMS1

The ALMS1 gene encodes the ALMS1 protein. ALMS1 gene is located on the short (p) arm of chromosome 2 at position 13. The ALMS1 protein may play a role in hearing, vision, regulation of body weight, and functions of the heart, kidney, lungs, and liver. It may also affect how the pancreas regulates insulin, a hormone that helps control blood sugar levels.

The ALMS1 protein is present in most of the body's tissues, usually at low levels. Within cells, this protein is located in centrosomes. Centrosomes play a role in cell division and the assembly of microtubules. The ALMS1 protein is also found at the base of cilia. Based on its location within cells, the ALMS1 protein may be involved in the organization of microtubules, the transport of various materials, and the normal function of cilia.

Alstrom Syndrome

Alström syndrome is a rare condition that affects many body systems. Many of the signs and symptoms of this condition begin in infancy or early childhood, although some appear later in life. Alstrom syndrome is characterized by a progressive loss of vision and hearing, a form of heart disease that enlarges and weakens the heart muscle (dilated cardiomyopathy), obesity, type 2 diabetes mellitus and short stature. This disorder can also cause serious or life-threatening medical problems involving the liver, kidneys, bladder, and lungs. Some individuals with Alstrom syndrome have a skin condition called acanthosis nigricans, which causes the skin in body folds and creases to become thick, dark, and velvety. The signs and symptoms of Alstrom syndrome vary in severity, and not all affected individuals have all of the characteristic features of the disorder.

More than 80 mutations in the ALMS1 gene have been identified in people with Alstrom syndrome. 32 mutations in exon 16, 19 mutations in exon 10, and 17 mutations in exon 8 were identified in Alstrom syndrome patients. The most common allele was a 1-bp deletion (10775delC) identified in 12% of mutated alleles. In some cases, in patients with Alstrom syndrome a homozygosity for insertion of a novel 333-bp Alu Ya5 SINE retrotransposon into exon 16 of the ALMS1 gene can be identified. In some cases, in patients with Alstrom syndrome an insertion of 19 bp in exon 16 of the ALMS1 gene, causing a frameshift resulting in early termination at codon 3530 can be identified. In some cases, in patients with Alstrom syndrome an 8383C-T transition in the ALMS1 gene in homozygous state, causing a nonsense change, glu2795 to ter (G2795X) can be identified. In some cases, in patients with Alstrom syndrome a 10775delC mutation in the ALMS1 gene can be identified. In some cases, in patients with Alstrom syndrome a deletion of 2 bp in exon 8 (2141delCT) can be identified. In some cases, in patients with Alstrom syndrome a compound heterozygosity for a 10775delC mutation and a trp3664-to-ter mutation in the ALMS1 gene can be identified. In some cases, in patients with Alstrom syndrome a homozygous 8164C-T transition in the ALMS1 gene, resulting in an arg2722-to-ter (R2722X) substitution can be identified. In some cases, in patients with Alstrom syndrome a homozygosity for insertion of a 333-bp Alu Ya5 element in exon 16 of the ALMS1 gene can be identified. In some cases, in patients with Alstrom syndrome 2 alleles carrying a 10945G-T transversion in exon 16 of the ALMS1 gene, resulting in a glu3649-to-ter (E3649X) substitution can be identified. In some cases, in patients with Alstrom syndrome a homozygosity for the E3649X mutation in the ALMS1 gene can be identified. Most of these mutations lead to the production of an abnormally small version of the ALMS1 protein that does not function properly. A lack of normally functioning ALMS1 protein in the brain can lead to overeating. A loss of this protein in the pancreas may cause insulin resistance. The combined effects of overeating and insulin resistance impair the body's ability to handle excess sugar, leading to diabetes and obesity (two common features of Alstrom syndrome).

Retained Intron Containing Pre-mRNA (RIC Pre-mRNA)

In embodiments, the methods of the present invention can exploit the presence of retained-intron-containing pre-mRNA (RIC pre-mRNA) transcribed from the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA gene and encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, in the cell nucleus. Splicing of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA species to produce mature, fully-spliced, ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA mRNA, can be induced using ASOs that stimulate splicing out of the retained introns. The resulting mature ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA mRNA can be exported to the cytoplasm and translated, thereby increasing the amount of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein in the patient's cells and alleviating symptoms of the eye disease or conditions caused by deficiency in ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA. This method, described further below, is known as Targeted Augmentation of Nuclear Gene Output (TANGO).

Nuclear Transcripts

ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA gene can be analyzed for intron-retention events. RNA sequencing (RNAseq), can be visualized in the UCSC genome browser, and can show ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA transcripts expressed in ARPE-19 and localized in either the cytoplasmic or nuclear fraction. The retained-intron containing pre-mRNA transcripts are retained in the nucleus and are not exported out to the cytoplasm.

In embodiments, a retained intron is an intron that is identified as a retained intron based on a determination of at least about 5%, at least about 10%, at least about 15%, at least about 20%, at least about 25%, at least about 30%, at least about 35%, at least about 40%, at least about 45%, or at least about 50%, retention. In embodiments, a retained intron is an intron that is identified as a retained intron based on a determination of about 5% to about 100%, about 5% to about 95%, about 5% to about 90%, about 5% to about 85%, about 5% to about 80%, about 5% to about 75%, about 5% to about 70%, about 5% to about 65%, about 5% to about 60%, about 5% to about 65%, about 5% to about 60%, about 5% to about 55%, about 5% to about 50%, about 5% to about 45%, about 5% to about 40%, about 5% to about 35%, about 5% to about 30%, about 5% to about 25%, about 5% to about 20%, about 5% to about 15%, about 10% to about 100%, about 10% to about 95%, about 10% to about 90%, about 10% to about 85%, about 10% to about 80%, about 10% to about 75%, about 10% to about 70%, about 10% to about 65%, about 10% to about 60%, about 10% to about 65%, about 10% to about 60%, about 10% to about 55%, about 10% to about 50%, about 10% to about 45%, about 10% to about 40%, about 10% to about 35%, about 10% to about 30%, about 10% to about 25%, about 10% to about 20%, about 15% to about 100%, about 15% to about 95%, about 15% to about 90%, about 15% to about 85%, about 15% to about 80%, about 15% to about 75%, about 15% to about 70%, about 15% to about 65%, about 15% to about 60%, about 15% to about 65%, about 15% to about 60%, about 15% to about 55%, about 15% to about 50%, about 15% to about 45%, about 15% to about 40%, about 15% to about 35%, about 15% to about 30%, about 15% to about 25%, about 20% to about 100%, about 20% to about 95%, about 20% to about 90%, about 20% to about 85%, about 20% to about 80%, about 20% to about 75%, about 20% to about 70%, about 20% to about 65%, about 20% to about 60%, about 20% to about 65%, about 20% to about 60%, about 20% to about 55%, about 20% to about 50%, about 20% to about 45%, about 20% to about 40%, about 20% to about 35%, about 20% to about 30%, about 25% to about 100%, about 25% to about 95%, about 25% to about 90%, about 25% to about 85%, about 25% to about 80%, about 25% to about 75%, about 25% to about 70%, about 25% to about 65%, about 25% to about 60%, about 25% to about 65%, about 25% to about 60%, about 25% to about 55%, about 25% to about 50%, about 25% to about 45%, about 25% to about 40%, or about 25% to about 35%, retention. In embodiments, other ASOs useful for this purpose are identified, using, e.g., methods described herein.

In some embodiments, the ROM1 intron numbering corresponds to the mRNA sequence at NM_00327. In embodiments, the targeted portion of the ROM1 RIC pre-mRNA is in intron 1. In embodiments, the percent retained intron can be 32. In embodiments, hybridization of an ASO to the targeted portion of the RIC pre-mRNA results in enhanced splicing at the splice site (5' splice site or 3' splice site) of retained intron 1 and subsequently increases ROM1 protein production. It is understood that the intron numbering may change in reference to a different ROM1 isoform sequence. One of skill in the art can determine the corresponding intron number in any isoform based on an intron sequence provided herein or using the number provided in reference to the mRNA sequence at NM_000327. One of skill in the art also can determine the sequences of flanking exons in any ROM1 isoform for targeting using the methods of the invention, based on an intron sequence provided herein or using the intron number provided in reference to the mRNA sequence at NM_000327.

In some embodiments, the TEAD1 intron numbering corresponds to the mRNA sequence at NM_021961. In embodiments, the targeted portion of the TEAD1 RIC pre-mRNA is in intron 4. In embodiments, hybridization of an ASO to the targeted portion of the RIC pre-mRNA results in enhanced splicing at the splice site (5' splice site or 3' splice site) of at least one of retained intron 4 and subsequently increases TEAD1 protein production. It is understood that the intron numbering may change in reference to a different TEAD1 isoform sequence. One of skill in the art can determine the corresponding intron number in any isoform based on an intron sequence provided herein or using the number provided in reference to the mRNA sequence at NM_021961. One of skill in the art also can determine the sequences of flanking exons in any TEAD1 isoform for targeting using the methods of the invention, based on an intron sequence provided herein or using the intron number provided in reference to the mRNA sequence at NM_021961.

In some embodiments, the RDH5 intron numbering corresponds to the mRNA sequence at NM_002905 or NM_001199771. In embodiments, the targeted portion of the RDH5 RIC pre-mRNA is in intron 1 and/or 2 In embodiments, the percent retained intron can be 59%. In embodiments, hybridization of an ASO to the targeted portion of the RIC pre-mRNA results in enhanced splicing at the splice site (5' splice site or 3' splice site) of retained intron 1 and/or 2 and subsequently increases RDH5 protein production. It is understood that the intron numbering may change in reference to a different RDH5 isoform sequence. One of skill in the art can determine the corresponding intron number in any isoform based on an intron sequence provided herein or using the number provided in reference to the mRNA sequence at NM_002905 or NM_001199771. One of skill in the art also can determine the sequences of flanking exons in any RDH5 isoform for targeting using the methods of the invention, based on an intron sequence provided herein or using the intron number provided in reference to the mRNA sequence at NM_002905 or NM_001199771.

In some embodiments, the PAX6 intron numbering corresponds to the mRNA sequence at NM_001310160, NM_001310161, NM_001258465, NM_000280, NM_001258464, NM_000280, NM_001258464, NM_001604, NM_001127612, NM_001258462, NM_001310159, NM_001310158, or NM_001258462. In embodiments, the targeted portion of the PAX6 RIC pre-mRNA is in intron 2 and/or 3 or 1 and/or 3 and/or 4 or 3 and/or 4 and/or 5 or 4 and/or 5 and/or 6 or 4 and/or 6 and/or 7 or 2 and/or 3 and/or 4. In some embodiments, the targeted portion of the PAX 6 RIC pre-mRNA is in intron 2 and/or 3. In some embodiments, the targeted portion of the PAX 6 RIC pre-mRNA is in intron 1 and/or 3 and/or 4. In some embodiments, the targeted portion of the PAX 6 RIC pre-mRNA is in intron 3 and/or 4 and/or 5. In some embodiments, the targeted portion of the PAX 6 RIC pre-mRNA is in intron 4 and/or 5 and/or 6. In some embodiments, the targeted portion of the PAX 6 RIC pre-mRNA is in intron 4 and/or 6 and/or 7. In some embodiments, the targeted portion of the PAX 6 RIC pre-mRNA is in intron 2 and/or 3 and/or 4. In embodiments, hybridization of an ASO to the targeted portion of the RIC pre-mRNA results in enhanced splicing at the splice site (5' splice site or 3' splice site) of a retained intron and subsequently increases PAX6 protein production. It is understood that the intron numbering may change in reference to a different PAX6 isoform sequence. One of skill in the art can determine the corresponding intron number in any isoform based on an intron sequence provided herein or using the number provided in reference to the mRNA sequence at NM_001310160, NM_001310161, NM_001258465, NM_000280, NM_001258464, NM_000280, NM_001258464, NM_001604, NM_001127612, NM_001258462, NM_001310159, NM_001310158, or NM_001258462. One of skill in the art also can determine the sequences of flanking exons in any PAX6 isoform for targeting using the methods of the invention, based on an intron sequence provided herein or using the intron number provided in reference to the mRNA sequence at NM_001310160, NM_001310161, NM_001258465, NM_000280, NM_001258464, NM_000280, NM_001258464, NM_001604, NM_001127612, NM_001258462, NM_001310159, NM_001310158, or NM_001258462.

In some embodiments, the FSCN2 intron numbering corresponds to the mRNA sequence at NM_012418 or NM_001077182. In embodiments, the targeted portion of the FSCN2 RIC pre-mRNA is in intron 1 and/or 3. In embodiments, the percent retained intron can be 12 or 17. In embodiments, hybridization of an ASO to the targeted portion of the RIC pre-mRNA results in enhanced splicing at the splice site (5' splice site or 3' splice site) of retained intron 1 and/or 3 and subsequently increases FSCN2 protein production. It is understood that the intron numbering may change in reference to a different FSCN2 isoform sequence. One of skill in the art can determine the corresponding intron number in any isoform based on an intron sequence provided herein or using the number provided in reference to the mRNA sequence at NM_012418 or NM_001077182. One of skill in the art also can determine the sequences of flanking exons in any FSCN2 isoform for targeting using the methods of the invention, based on an intron sequence provided herein or using the intron number provided in reference to the mRNA sequence at NM_012418 or NM_001077182.

In embodiments, the TCF4 intron numbering corresponds to the mRNA sequence at NM_001243236, NM_00123235, NM_001243234, NM_001243233, NM_001243232, NM_001243231, NM_003199, NM_001306207, NM_001306208, NM_001243227, NM_001243228, NM_001243230, NM_001243226, NM_001083962, NM_001330605, and NM_001330604. In embodiments, the targeted portion of the TCF4 RIC pre-mRNA is in intron 9 or 11 or 12 or 14 or 15 or 16 or 17. In embodiments, the targeted portion of the TCF4 RIC pre-mRNA is in intron 9. In embodiments, the targeted portion of the TCF4 RIC pre-mRNA is in intron 11. In embodiments, the targeted portion of the TCF4 RIC pre-mRNA is in intron 12. In embodiments, the targeted portion of the TCF4 RIC pre-mRNA is in intron 14. In embodiments, the targeted portion of the TCF4 RIC pre-mRNA is in intron 15. In embodiments, the targeted portion of the TCF4 RIC pre-mRNA is in intron 16. In embodiments, the targeted portion of the TCF4 RIC pre-mRNA is in intron 17. In embodiments, the percent retained intron can be 9. In embodiments, hybridization of an ASO to the targeted portion of the RIC pre-mRNA results in enhanced splicing at the splice site (5' splice site or 3' splice site) of a retained intron and subsequently increases TCF4 protein production. It is understood that the intron numbering may change in reference to a different TCF4 isoform sequence. One of skill in the art can determine the corresponding intron number in any isoform based on an intron sequence provided herein or using the number provided in reference to the mRNA sequence at NM_001243236, NM_00123235, NM_001243234, NM_001243233, NM_001243232, NM_001243231, NM_003199, NM_001306207, NM_001306208, NM_001243227, NM_001243228, NM_001243230, NM_001243226, NM_001083962, NM_001330605, and NM_001330604. One of skill in the art also can determine the sequences of flanking exons in any TCF4 isoform for targeting using the methods of the invention, based on an intron sequence provided herein or using the intron number provided in reference to the mRNA sequence at NM_001243236, NM_00123235, NM_001243234, NM_001243233, NM_001243232, NM_001243231, NM_003199, NM_001306207, NM_001306208, NM_001243227, NM_001243228, NM_001243230, NM_001243226, NM_001083962, NM_001330605, and NM_001330604.

In embodiments, the MFSD8 intron numbering corresponds to the mRNA sequence at NM_152778. In embodiments, the targeted portion of the MFSD8 RIC pre-mRNA is in intron 11 and/or 12. In embodiments, and the percent retained intron can be 15 or 62. In embodiments, hybridization of an ASO to the targeted portion of the RIC pre-mRNA results in enhanced splicing at the splice site (5' splice site or 3' splice site) of retained intron 11 and/or 12 and subsequently increases MFSD8 protein production. It is understood that the intron numbering may change in reference to a different MFSD8 isoform sequence. One of skill in the art can determine the corresponding intron number in any isoform based on an intron sequence provided herein or using the number provided in reference to the mRNA sequence at NM_152778. One of skill in the art also can determine the sequences of flanking exons in any MFSD8 isoform for targeting using the methods of the invention, based on an intron sequence provided herein or using the intron number provided in reference to the mRNA sequence at NM_152778.

In embodiments, the CTNS intron numbering corresponds to the mRNA sequence at NM_004937 or NM_001031681. In embodiments, the targeted portion of the CTNS RIC pre-mRNA is in intron 9 and/or 10. In embodiments, the percent retained intron can be 10 or 18. In embodiments, hybridization of an ASO to the targeted portion of the RIC pre-mRNA results in enhanced splicing at the splice site (5' splice site or 3' splice site) of retained intron 9 and/or 10 and subsequently increases CTNS protein production. It is understood that the intron numbering may change in reference to a different CTNS isoform sequence. One of skill in the art can determine the corresponding intron number in any isoform based on an intron sequence provided herein or using the number provided in reference to the mRNA sequence at NM_004937 or NM_001031681. One of skill in the art also can determine the sequences of flanking exons in any CTNS isoform for targeting using the methods of the invention, based on an intron sequence provided herein or using the intron number provided in reference to the mRNA sequence at NM_004937 or NM_001031681.

In embodiments, the OPTN intron number corresponds to the mRNA sequence at NM_001008211, NM_001008212, NM_001008213, or NM_021980. In embodiments, the targeted portion of the OPTN RIC pre-mRNA is in intron 7 or 8 or 9. In embodiments, the targeted portion of the OPTN RIC pre-mRNA is in intron 7. In embodiments, the targeted portion of the OPTN RIC pre-mRNA is in intron 8. In embodiments, the targeted portion of the OPTN RIC pre-mRNA is in intron 9. In embodiments, the percent retained intron can be 24. In embodiments, hybridization of an ASO to the targeted portion of the RIC pre-mRNA results in enhanced splicing at the splice site (5' splice site or 3' splice site) of retained intron 7 or 8 or 9 and subsequently increases OPTN protein production. It is understood that the intron numbering may change in reference to a different OPTN isoform sequence. One of skill in the art can determine the corresponding intron number in any isoform based on an intron sequence provided herein or using the number provided in reference to the mRNA sequence at NM_001008211, NM_001008212, NM_001008213, or NM_021980. One of skill in the art also can determine the sequences of flanking exons in any OPTN isoform for targeting using the methods of the invention, based on an intron sequence provided herein or using the intron number provided in reference to the mRNA sequence at NM_001008211, NM_001008212, NM_001008213, or NM_021980.

In embodiments, the RLBP1 intron numbering corresponds to the mRNA sequence at NM_000326. In embodiments, the targeted portion of the RLBP1 RIC pre-mRNA is in intron 5 and/or 2. In embodiments, the percent retained intron can be 49. In embodiments, hybridization of an ASO to the targeted portion of the RIC pre-mRNA results in enhanced splicing at the splice site (5' splice site or 3' splice site) of retained intron 5 and/or 2 and subsequently increases RLBP1 protein production. It is understood that the intron numbering may change in reference to a different RLBP1 isoform sequence. One of skill in the art can determine the corresponding intron number in any isoform based on an intron sequence provided herein or using the number provided in reference to the mRNA sequence at NM_000326. One of skill in the art also can determine the sequences of flanking exons in any RLBP1 isoform for targeting using the methods of the invention, based on an intron sequence provided herein or using the intron number provided in reference to the mRNA sequence at NM_000326.

In embodiments, the RPE65 intron numbering corresponds to the mRNA sequence at NM_000329. In embodiments, the targeted portion of the RPE65 RIC pre-mRNA is in intron 10 and/or 9. In embodiments, the percent retained intron can be 11 or 10. In embodiments, hybridization of an ASO to the targeted portion of the RIC pre-mRNA results in enhanced splicing at the splice site (5' splice site or 3' splice site) of retained intron 10 and/or 9 and subsequently increases RPE65 protein production. It is understood that the intron numbering may change in reference to a different RPE65 isoform sequence. One of skill in the art can determine the corresponding intron number in any isoform based on an intron sequence provided herein or using the number provided in reference to the mRNA sequence at NM_000329. One of skill in the art also can determine the sequences of flanking exons in any RPE65 isoform for targeting using the methods of the invention, based on an intron sequence provided herein or using the intron number provided in reference to the mRNA sequence at NM_000329.

In embodiments, the LRAT intron numbering corresponds to the mRNA sequence at NM_001301645 or NM_004744. In embodiments, the targeted portion of the LRAT RIC pre-mRNA is in intron 2. In embodiments, hybridization of an ASO to the targeted portion of the RIC pre-mRNA results in enhanced splicing at the splice site (5' splice site or 3' splice site) of retained intron 2 and subsequently increases LRAT protein production. It is understood that the intron numbering may change in reference to a different LRAT isoform sequence. One of skill in the art can determine the corresponding intron number in any isoform based on an intron sequence provided herein or using the number provided in reference to the mRNA sequence at NM_001301645 or NM_004744. One of skill in the art also can determine the sequences of flanking exons in any LRAT isoform for targeting using the methods of the invention, based on an intron sequence provided herein or using the intron number provided in reference to the mRNA sequence at NM_001301645 or NM_004744.

In embodiments, the RDH8 intron numbering corresponds to the mRNA sequence at NM_015725. In embodiments, the targeted portion of the RDH8 RIC pre-mRNA is in intron 4. In embodiments, hybridization of an ASO to the targeted portion of the RIC pre-mRNA results in enhanced splicing at the splice site (5' splice site or 3' splice site) of retained intron 4 and subsequently increases RDH8 protein production. It is understood that the intron numbering may change in reference to a different RDH8 isoform sequence. One of skill in the art can determine the corresponding intron number in any isoform based on an intron sequence provided herein or using the number provided in reference to the mRNA sequence at NM_015725. One of skill in the art also can determine the sequences of flanking exons in any RDH8 isoform for targeting using the methods of the invention, based on an intron sequence provided herein or using the intron number provided in reference to the mRNA sequence at NM_015725.

In embodiments, the RDH12 intron numbering corresponds to the mRNA sequence at NM_152443. In embodiments, the targeted portion of the RDH12 RIC pre-mRNA is in intron 7. In embodiments, hybridization of an ASO to the targeted portion of the RIC pre-mRNA results in enhanced splicing at the splice site (5' splice site or 3' splice site) of retained intron 7 and subsequently increases RDH12 protein production. It is understood that the intron numbering may change in reference to a different RDH12 isoform sequence. One of skill in the art can determine the corresponding intron number in any isoform based on an intron sequence provided herein or using the number provided in reference to the mRNA sequence at NM_152443. One of skill in the art also can determine the sequences of flanking exons in any RDH12 isoform for targeting using the methods of the invention, based on an intron sequence provided herein or using the intron number provided in reference to the mRNA sequence at NM_152443.

In embodiments, the RGR intron numbering corresponds to the mRNA sequence at NM_002921, NM_001012722, or NM_001012720. In embodiments, the targeted portion of the RGR RIC pre-mRNA is in intron 1 and/or 2. In embodiments, the percent retained intron can be 46 or 61. In embodiments, hybridization of an ASO to the targeted portion of the RIC pre-mRNA results in enhanced splicing at the splice site (5' splice site or 3' splice site) of retained intron 1 and/or 2 and subsequently increases RGR protein production. It is understood that the intron numbering may change in reference to a different RGR isoform sequence. One of skill in the art can determine the corresponding intron number in any isoform based on an intron sequence provided herein or using the number provided in reference to the mRNA sequence at NM_002921, NM_001012722, or NM_001012720. One of skill in the art also can determine the sequences of flanking exons in any RGR isoform for targeting using the methods of the invention, based on an intron sequence provided herein or using the intron number provided in reference to the mRNA sequence at NM_002921, NM_001012722, or NM_001012720.

In embodiments, the CNGA3 intron numbering corresponds to the mRNA sequence at NM_001298 or NM_001079878. In embodiments, the targeted portion of the CNGA3 RIC pre-mRNA is in intron 6 or 5. In embodiments, the targeted portion of the CNGA3 RIC pre-mRNA is in intron 6. In embodiment, the targeted portion of the CNGA3 RIC pre-mRNA is in intron 5. In embodiments, the percent retained intron can be 27. In embodiments, hybridization of an ASO to the targeted portion of the RIC pre-mRNA results in enhanced splicing at the splice site (5' splice site or 3' splice site) of retained intron 6 or 5 and subsequently increases CNGA3 protein production. It is understood that the intron numbering may change in reference to a different CNGA3 isoform sequence. One of skill in the art can determine the corresponding intron number in any isoform based on an intron sequence provided herein or using the number provided in reference to the mRNA sequence at NM_001298 or NM_001079878. One of skill in the art also can determine the sequences of flanking exons in any CNGA3 isoform for targeting using the methods of the invention, based on an intron sequence provided herein or using the intron number provided in reference to the mRNA sequence at NM_001298 or NM_001079878.

In embodiments, the PER1 intron numbering corresponds to the mRNA sequence at NM_002616. In embodiments, the targeted portion of the PER1 RIC pre-mRNA is in intron 1 and/or 14. In embodiments, hybridization of an ASO to the targeted portion of the RIC pre-mRNA results in enhanced splicing at the splice site (5' splice site or 3' splice site) of retained intron 1 and/or 14 and subsequently increases PER1 protein production. It is understood that the intron numbering may change in reference to a different PER1 isoform sequence. One of skill in the art can determine the corresponding intron number in any isoform based on an intron sequence provided herein or using the number provided in reference to the mRNA sequence at NM_002616. One of skill in the art also can determine the sequences of flanking exons in any PER1 isoform for targeting using the methods of the invention, based on an intron sequence provided herein or using the intron number provided in reference to the mRNA sequence at NM_002616.

In embodiments, the IDUA intron numbering corresponds to the mRNA sequence at NM_000203 or NR_110313. In embodiments, the targeted portion of the IDUA RIC pre-mRNA is in intron 3 and/or 4 and/or 5 and/or 6 and/or 7. In embodiments, the percent retained intron can be 28, 29, 18, 20, or 12. In embodiments, hybridization of an ASO to the targeted portion of the RIC pre-mRNA results in enhanced splicing at the splice site (5' splice site or 3' splice site) of retained intron 3 and/or 4 and/or 5 and/or 6 and/or land subsequently increases IDUA protein production. It is understood that the intron numbering may change in reference to a different IDUA isoform sequence. One of skill in the art can determine the corresponding intron number in any isoform based on an intron sequence provided herein or using the number provided in reference to the mRNA sequence at NM_000203 or NR_110313. One of skill in the art also can determine the sequences of flanking exons in any IDUA isoform for targeting using the methods of the invention, based on an intron sequence provided herein or using the intron number provided in reference to the mRNA sequence at NM_000203 or NR_110313.

In embodiments, the ABCA4 intron number corresponds to the mRNA sequence at NM_000350. In embodiments, the targeted portion of the ABCA4 RIC pre-mRNA is in intron 40 and/or 38 and/or 36 and/or 44 and/or 39. In embodiments, hybridization of an ASO to the targeted portion of the RIC pre-mRNA results in enhanced splicing at the splice site (5' splice site or 3' splice site) of retained intron 40 and/or 38 and/or 36 and/or 44 and/or 39 and subsequently increases ABCA4 protein production. It is understood that the intron numbering may change in reference to a different ABCA4 isoform sequence. One of skill in the art can determine the corresponding intron number in any isoform based on an intron sequence provided herein or using the number provided in reference to the mRNA sequence at NM_000350. One of skill in the art also can determine the sequences of flanking exons in any ABCA4 isoform for targeting using the methods of the invention, based on an intron sequence provided herein or using the intron number provided in reference to the mRNA sequence at NM_000350.

In embodiments, the MYOC intron number corresponds to the mRNA sequence at NM_000261. In embodiments, the targeted portion of the MYOC RIC pre-mRNA is in intron 1 and/or 2. In embodiments, hybridization of an ASO to the targeted portion of the RIC pre-mRNA results in enhanced splicing at the splice site (5' splice site or 3' splice site) of retained 1 and/or 2 and subsequently increases MYOC protein production. It is understood that the intron numbering may change in reference to a different MYOC isoform sequence. One of skill in the art can determine the corresponding intron number in any isoform based on an intron sequence provided herein or using the number provided in reference to the mRNA sequence at NM_000261. One of skill in the art also can determine the sequences of flanking exons in any MYOC isoform for targeting using the methods of the invention, based on an intron sequence provided herein or using the intron number provided in reference to the mRNA sequence at NM_000261.

In embodiments, the NR2E3 intron number corresponds to the mRNA sequence at NM_014249 or NM_016346. In embodiments, the targeted portion of the NR2E3 RIC pre-mRNA is in intron 1 and/or 2 and/or 3 and/or 4 and/or 5 and/or 6 and/or 7. In embodiments, hybridization of an ASO to the targeted portion of the RIC pre-mRNA results in enhanced splicing at the splice site (5' splice site or 3' splice site) of retained 1 and/or 2 and/or 3 and/or 4 and/or 5 and/or 6 and/or 7 and subsequently increases NR2E3 protein production. It is understood that the intron numbering may change in reference to a different NR2E3 isoform sequence. One of skill in the art can determine the corresponding intron number in any isoform based on an intron sequence provided herein or using the number provided in reference to the mRNA sequence at NM_014249 or NM_016346. One of skill in the art also can determine the sequences of flanking exons in any NR2E3 isoform for targeting using the methods of the invention, based on an intron sequence provided herein or using the intron number provided in reference to the mRNA sequence at NM_014249 or NM_016346.

In embodiments, the NXNL1 intron number corresponds to the mRNA sequence at NM_138454. In embodiments, the targeted portion of the NXNL1 RIC pre-mRNA is in intron 1. In embodiments, hybridization of an ASO to the targeted portion of the RIC pre-mRNA results in enhanced splicing at the splice site (5' splice site or 3' splice site) of retained 1 and subsequently increases NXNL1 protein production. It is understood that the intron numbering may change in reference to a different NXNL1 isoform sequence. One of skill in the art can determine the corresponding intron number in any isoform based on an intron sequence provided herein or using the number provided in reference to the mRNA sequence at NM_138454. One of skill in the art also can determine the sequences of flanking exons in any NXNL1 isoform for targeting using the methods of the invention, based on an intron sequence provided herein or using the intron number provided in reference to the mRNA sequence at NM_138454.

In embodiments, the CRX intron number corresponds to the mRNA sequence at NM_000554. In embodiments, the targeted portion of the CRX RIC pre-mRNA is in intron 1 and/or 2 and/or 3. In embodiments, hybridization of an ASO to the targeted portion of the RIC pre-mRNA results in enhanced splicing at the splice site (5' splice site or 3' splice site) of retained 1 and/or 2 and/or 3 and subsequently increases CRX protein production. It is understood that the intron numbering may change in reference to a different CRX isoform sequence. One of skill in the art can determine the corresponding intron number in any isoform based on an intron sequence provided herein or using the number provided in reference to the mRNA sequence at NM_000554. One of skill in the art also can determine the sequences of flanking exons in any CRX isoform for targeting using the methods of the invention, based on an intron sequence provided herein or using the intron number provided in reference to the mRNA sequence at NM_000554.

ABCA4

In some embodiments, the ASOs disclosed herein target a RIC pre-mRNA transcribed from an ABCA4 genomic sequence (an ABCA4 RIC pre-mRNA). In some embodiments, the ABCA4 genomic sequence is SEQ ID NO: 34790. In some embodiments, the ABCA4 RIC pre-mRNA is SEQ ID NO: 34813. In some embodiments, the ABCA4 RIC pre-mRNA transcript comprises retained intron 40 and/or 38 and/or 36 and/or 44 and/or 39. In some embodiments, when the ABCA4 RIC pre-mRNA transcript comprises retained intron 40, the ASOs disclosed herein target SEQ ID NO: 61463. In some embodiments, when the ABCA4 RIC pre-mRNA transcript comprises retained intron 38, the ASOs disclosed herein target SEQ ID NO: 61495. In some embodiments, when the ABCA4 RIC pre-mRNA transcript comprises retained intron 36, the ASOs disclosed herein target SEQ ID NO: 61445. In some embodiments, when the ABCA4 RIC pre-mRNA transcript comprises retained intron 44, the ASOs disclosed herein target SEQ ID NO: 61470. In some embodiments, when the ABCA4 RIC pre-mRNA transcript comprises retained intron 39, the ASOs disclosed herein target SEQ ID NO: 61453. In some embodiments, when the ABCA4 RIC pre-mRNA transcript comprises retained intron 40, the ASO has a sequence according to any one of SEQ ID NOs: 34873-35104. In some embodiments, when the ABCA4 RIC pre-mRNA transcript comprises retained intron 38, the ASO has a sequence according to any one of SEQ ID NOs: 35105-35332. In some embodiments, when the ABCA4 RIC pre-mRNA transcript comprises retained intron 36, the ASO has a sequence according to any one of SEQ ID NOs: 35333-. In some embodiments, when the ABCA4 RIC pre-mRNA transcript comprises retained intron 44, the ASO has a sequence according to any one of SEQ ID NOs: 35564-35805. In some embodiments, when the ABCA4 RIC pre-mRNA transcript comprises retained intron 39, the ASO has a sequence according to any one of SEQ ID NOs: 35806-35915. In some embodiments, the ASOs target an ABCA4 RIC pre-mRNA sequence.

RPE65

In some embodiments, the ASOs disclosed herein target a RIC pre-mRNA transcribed from a RPE65 genomic sequence (an RPE65 RIC pre-mRNA). In some embodiments, the RPE65 genomic sequence is SEQ ID NO: 34791. In some embodiments, the RPE65 RIC pre-mRNA is SEQ ID NO: 34814. In some embodiments, the RPE65 RIC pre-mRNA transcript comprises retained intron 9 and/or 10. In some embodiments, when the RPE65 RIC pre-mRNA transcript comprises retained intron 9, the ASOs disclosed herein target SEQ ID NO: 61480. In some embodiments, when the RPE65 RIC pre-mRNA transcript comprises retained intron 10, the ASOs disclosed herein target SEQ ID NO: 61460. In some embodiments, when the RPE65 RIC pre-mRNA transcript comprises retained intron 9, the ASO has a sequence according to any one of SEQ ID NOs: 35916-36082. In some embodiments, when the RPE65 RIC pre-mRNA transcript comprises retained intron 10, the ASO has a sequence according to any one of SEQ ID NOs: 36083-36317. In some embodiments, the ASOs target an RPE65 RIC pre-mRNA sequence.

MYOC

In some embodiments, the ASOs disclosed herein target a RIC pre-mRNA transcribed from a MYOC genomic sequence (a MYOC RIC pre-mRNA). In some embodiments, the MYOC genomic sequence is SEQ ID NO: 34792. In some embodiments, the MYOC RIC pre-mRNA is SEQ ID NO: 34815. In some embodiments, the MYOC RIC pre-mRNA transcript comprises retained intron 1 and/or 2. In some embodiments, when the MYOC RIC pre-mRNA transcript comprises retained intron 1, the ASOs disclosed herein target SEQ ID NO: 61458. In some embodiments, when the MYOC RIC pre-mRNA transcript comprises retained intron 2, the ASOs disclosed herein target SEQ ID NO: 61485. In some embodiments, when the MYOC RIC pre-mRNA transcript comprises retained intron 1, the ASO has a sequence according to any one of SEQ ID NOs: 36318-36644. In some embodiments, when the MYOC RIC pre-mRNA transcript comprises retained intron 2, the ASO has a sequence according to any one of SEQ ID NOs: 36645-37107. In some embodiments, the ASOs target a MYOC RIC pre-mRNA sequence.

CNGA3

In some embodiments, the ASOs disclosed herein target a RIC pre-mRNA transcribed from a CNGA3 genomic sequence (a CNGA3 RIC pre-mRNA). In some embodiments, the CNGA3 genomic sequence is SEQ ID NO: 34793. In some embodiments, the CNGA3 RIC pre-mRNA is SEQ ID NO: 34816 or 34817. In some embodiments, the CNGA3 RIC pre-mRNA transcript comprises retained intron 6 and/or 5. In some embodiments, when the CNGA3 RIC pre-mRNA transcript comprises retained intron 6, the ASOs disclosed herein target SEQ ID NO: 61500. In some embodiments, when the CNGA3 RIC pre-mRNA transcript comprises retained intron 5, the ASOs disclosed herein target SEQ ID NO: 61500. In some embodiments, when the CNGA3 RIC pre-mRNA transcript comprises retained intron 6, the ASO has a sequence according to any one of SEQ ID NOs: 37108-37333. In some embodiments, when the CNGA3 RIC pre-mRNA transcript comprises retained intron 5, the ASO has a sequence according to any one of SEQ ID NOs: 37334-37559. In some embodiments, the ASOs target a CNGA3 RIC pre-mRNA sequence.

MFSD8

In some embodiments, the ASOs disclosed herein target a RIC pre-mRNA transcribed from a MFSD8 genomic sequence (an MFSD8 RIC pre-mRNA). In some embodiments, the MFSD8 genomic sequence is SEQ ID NO: 34794. In some embodiments, the MFSD8 RIC pre-mRNA is SEQ ID NO: 34818. In some embodiments, the MFSD8 RIC pre-mRNA transcript comprises retained intron 11 and/or 12. In some embodiments, when the MFSD8 RIC pre-mRNA transcript comprises retained intron 11, the ASOs disclosed herein target SEQ ID NO: 61492. In some embodiments, when the MFSD8 RIC pre-mRNA transcript comprises retained intron 12, the ASOs disclosed herein target SEQ ID NO: 61497. In some embodiments, when the MFSD8 RIC pre-mRNA transcript comprises retained intron 11, the ASO has a sequence according to any one of SEQ ID NOs: 37560-37641. In some embodiments, when the MFSD8 RIC pre-mRNA transcript comprises retained intron 12, the ASO has a sequence according to any one of SEQ ID NOs: 37642-38420. In some embodiments, the ASOs target an MFSD8 RIC pre-mRNA sequence.

IDUA

In some embodiments, the ASOs disclosed herein target a RIC pre-mRNA transcribed from a IDUA genomic sequence (an IDUA RIC pre-mRNA). In some embodiments, the IDUA genomic sequence is SEQ ID NO: 34795. In some embodiments, the IDUA RIC pre-mRNA is SEQ ID NO: 34819 or 34820. In some embodiments, the IDUA RIC pre-mRNA transcript comprises retained intron 3 and/or 4 and/or 5 and/or 6 and/or 7. In some embodiments, when the IDUA RIC pre-mRNA transcript comprises retained intron 3, the ASOs disclosed herein target SEQ ID NO: 61457. In some embodiments, when the IDUA RIC pre-mRNA transcript comprises retained intron 4, the ASOs disclosed herein target SEQ ID NO: 61468. In some embodiments, when the IDUA RIC pre-mRNA transcript comprises retained intron 5, the ASOs disclosed herein target SEQ ID NO: 61489. In some embodiments, when the IDUA RIC pre-mRNA transcript comprises retained intron 6, the ASOs disclosed herein target SEQ ID NO: 61444. In some embodiments, when the IDUA RIC pre-mRNA transcript comprises retained intron 7, the ASOs disclosed herein target SEQ ID NO: 61452. In some embodiments, when the IDUA RIC pre-mRNA transcript comprises retained intron 3, the ASO has a sequence according to any one of SEQ ID NOs: 38421-38486 or 38827-38893. In some embodiments, when the IDUA RIC pre-mRNA transcript comprises retained intron 4, the ASO has a sequence according to any one of SEQ ID NOs: 38487-38602 or 38893-39008. In some embodiments, when the IDUA RIC pre-mRNA transcript comprises retained intron 5, the ASO has a sequence according to any one of SEQ ID NOs: 38603-38668 or 39009-39074. In some embodiments, when the IDUA RIC pre-mRNA transcript comprises retained intron 6, the ASO has a sequence according to any one of SEQ ID NOs: 38669-38741 or 39075-39147. In some embodiments, when the IDUA RIC pre-mRNA transcript comprises retained intron 7, the ASO has a sequence according to any one of SEQ ID NOs: 38742-38826 or 39147-39232. In some embodiments, the ASOs target an IDUA RIC pre-mRNA sequence.

LRAT

In some embodiments, the ASOs disclosed herein target a RIC pre-mRNA transcribed from a LRAT genomic sequence (an LRAT RIC pre-mRNA). In some embodiments, the LRAT genomic sequence is SEQ ID NO: 34796. In some embodiments, the LRAT RIC pre-mRNA is SEQ ID NO: 34821 or 34822. In some embodiments, the LRAT RIC pre-mRNA transcript comprises retained intron 2. In some embodiments, when the LRAT RIC pre-mRNA transcript comprises retained intron 2, the ASOs disclosed herein target SEQ ID NO: 61474. In some embodiments, when the LRAT RIC pre-mRNA transcript comprises retained intron 2, the ASO has a sequence according to any one of SEQ ID NOs: 39233-41436. In some embodiments, the ASOs target an LRAT RIC pre-mRNA sequence.

OPTN

In some embodiments, the ASOs disclosed herein target a RIC pre-mRNA transcribed from a OPTN genomic sequence (an OPTN RIC pre-mRNA). In some embodiments, the OPTN genomic sequence is SEQ ID NO: 34797. In some embodiments, the OPTN RIC pre-mRNA is SEQ ID NO: 34823, 34824, 34825, or 34826. In some embodiments, the OPTN RIC pre-mRNA transcript comprises retained intron 9 or 8 or 7. In some embodiments, when the OPTN RIC pre-mRNA transcript comprises retained intron 9, the ASOs disclosed herein target SEQ ID NO: 61503. In some embodiments, when the OPTN RIC pre-mRNA transcript comprises retained intron 8, the ASOs disclosed herein target SEQ ID NO: 61503. In some embodiments, when the OPTN RIC pre-mRNA transcript comprises retained intron 7, the ASOs disclosed herein target SEQ ID NO: 61503. In some embodiments, when the OPTN RIC pre-mRNA transcript comprises retained intron 9, the ASO has a sequence according to any one of SEQ ID NOs: 41437-41669 or 41903-42135. In some embodiments, when the OPTN RIC pre-mRNA transcript comprises retained intron 8, the ASO has a sequence according to any one of SEQ ID NOs: 41670-41903. In some embodiments, when the OPTN RIC pre-mRNA transcript comprises retained intron 7, the ASO has a sequence according to any one of SEQ ID NOs: 42136-42368. In some embodiments, the ASOs target an OPTN RIC pre-mRNA sequence.

RGR

In some embodiments, the ASOs disclosed herein target a RIC pre-mRNA transcribed from a RGR genomic sequence (an RGR RIC pre-mRNA). In some embodiments, the RGR genomic sequence is SEQ ID NO: 34798. In some embodiments, the RGR RIC pre-mRNA is SEQ ID NO: 34827, 34828, or 34829. In some embodiments, the RGR RIC pre-mRNA transcript comprises retained intron 1 and/or 2. In some embodiments, when the RGR RIC pre-mRNA transcript comprises retained intron 1, the ASOs disclosed herein target SEQ ID NO: 61446. In some embodiments, when the RGR RIC pre-mRNA transcript comprises retained intron 2, the ASOs disclosed herein target SEQ ID NO: 61476 or 61472. In some embodiments, when the RGR RIC pre-mRNA transcript comprises retained intron 1, the ASO has a sequence according to any one of SEQ ID NOs: 42369-42595, 42830-43056, or 43289-43515. In some embodiments, when the RGR RIC pre-mRNA transcript comprises retained intron 2, the ASO has a sequence according to any one of SEQ ID NOs: 42596-42829, 43057-43288, or 43516-43747. In some embodiments, the ASOs target an RGR RIC pre-mRNA sequence.

TEAD1

In some embodiments, the ASOs disclosed herein target a RIC pre-mRNA transcribed from a TEAD1 genomic sequence (a TEAD1 RIC pre-mRNA). In some embodiments, the TEAD1 genomic sequence is SEQ ID NO: 34799. In some embodiments, the TEAD1 RIC pre-mRNA is SEQ ID NO: 34830. In some embodiments, the TEAD1 RIC pre-mRNA transcript comprises retained intron 4. In some embodiments, when the TEAD1 RIC pre-mRNA transcript comprises retained intron 4, the ASOs disclosed herein target SEQ ID NO: 61461. In some embodiments, when the TEAD1 RIC pre-mRNA transcript comprises retained intron 4, the ASO has a sequence according to any one of SEQ ID NOs: 43748-43952. In some embodiments, the ASOs target a TEAD1 RIC pre-mRNA sequence.

PAX6

In some embodiments, the ASOs disclosed herein target a RIC pre-mRNA transcribed from a PAX6 genomic sequence (a PAX6 RIC pre-mRNA). In some embodiments, the PAX6 genomic sequence is SEQ ID NO: 34800. In some embodiments, the PAX6 RIC pre-mRNA is SEQ ID NO: 34831, 34832, 34833, 34834, 34835, 34836, 34837, 34838, 34839, 34840, or 34841. In some embodiments, the PAX6 RIC pre-mRNA transcript comprises retained intron 2 and/or 3 or 1 and/or 3 and/or 4 or 3 and/or 4 and/or 5 or 4 and/or 5 and/or 6 or 4 and/or 6 and/or 7 or 2 and/or 3 and/or 4. In some embodiments, when the PAX6 RIC pre-mRNA transcript comprises retained intron 1, the ASOs disclosed herein target SEQ ID NO: 61496. In some embodiments, when the PAX6 RIC pre-mRNA transcript comprises retained intron 2, the ASOs disclosed herein target SEQ ID NO: 61486 or 61483. In some embodiments, when the PAX6 RIC pre-mRNA transcript comprises retained intron 3, the ASOs disclosed herein target SEQ ID NO: 61466, 61467, 61483, or 61448. In some embodiments, when the PAX6 RIC pre-mRNA transcript comprises retained intron 4, the ASOs disclosed herein target SEQ ID NO: 61502, 61448, or 61483. In some embodiments, when the PAX6 RIC pre-mRNA transcript comprises retained intron 5, the ASOs disclosed herein target SEQ ID NO: 61502 or 61448. In some embodiments, when the PAX6 RIC pre-mRNA transcript comprises retained intron 6, the ASOs disclosed herein target SEQ ID NO: 61502 or 61467. In some embodiments, when the PAX6 RIC pre-mRNA transcript comprises retained intron 7, the ASOs disclosed herein target SEQ ID NO: 61502. In some embodiments, when the PAX6 RIC pre-mRNA transcript comprises retained intron 1, the ASO has a sequence according to any one of SEQ ID NOs: 44297-44564. In some embodiments, when the PAX6 RIC pre-mRNA transcript comprises retained intron 2, the ASO has a sequence according to any one of SEQ ID NOs: 43955-44088 or 48374-48574. In some embodiments, when the PAX6 RIC pre-mRNA transcript comprises retained intron 3, the ASO has a sequence according to any one of SEQ ID NOs: 44089-44302, 44565-44637, 44850-45049, or 48578-48809. In some embodiments, when the PAX6 RIC pre-mRNA transcript comprises retained intron 4, the ASO has a sequence according to any one of SEQ ID NOs: 44638-44849, 45050-45281, 45493-45692, 46136-46335, 46779-46978, 47257-47456, 47900-48099, 48810-49220, or 49499-49698. In some embodiments, when the PAX6 RIC pre-mRNA transcript comprises retained intron 5, the ASO has a sequence according to any one of SEQ ID NOs: 45282-45492, 45693-45924, 46336-46567, or 47457-47688. In some embodiments, when the PAX6 RIC pre-mRNA transcript comprises retained intron 6, the ASO has a sequence according to any one of SEQ ID NOs: 45925-46135, 46568-46778, 46979-47045, 47689-47899, 48100-48166, 49221-49287, or 49699-49765. In some embodiments, when the PAX6 RIC pre-mRNA transcript comprises retained intron 7, the ASO has a sequence according to any one of SEQ ID NOs: 47046-47256, 48167-48377, 49288-49498, or 49766-49976. In some embodiments, the ASOs target a PAX6 RIC pre-mRNA sequence.

ROM1

In some embodiments, the ASOs disclosed herein target a RIC pre-mRNA transcribed from a ROM1 genomic sequence (a ROM1 RIC pre-mRNA). In some embodiments, the ROM1 genomic sequence is SEQ ID NO: 34801. In some embodiments, the ROM1 RIC pre-mRNA is SEQ ID NO: 34842. In some embodiments, the ROM1 RIC pre-mRNA transcript comprises retained intron 1. In some embodiments, when the ROM1 RIC pre-mRNA transcript comprises retained intron 1, the ASOs disclosed herein target SEQ ID NO: 61454. In some embodiments, when the ROM1 RIC pre-mRNA transcript comprises retained intron 1, the ASO has a sequence according to any one of SEQ ID NOs: 49969-50275. In some embodiments, the ASOs target a ROM1 RIC pre-mRNA sequence.

RDH5

In some embodiments, the ASOs disclosed herein target a RIC pre-mRNA transcribed from a RDH5 genomic sequence (an RDH5 RIC pre-mRNA). In some embodiments, the RDH5 genomic sequence is SEQ ID NO: 34802. In some embodiments, the RDH5 RIC pre-mRNA is SEQ ID NO: 34843 or 34844. In some embodiments, the RDH5 RIC pre-mRNA transcript comprises retained intron 1 and/or 2. In some embodiments, when the RDH5 RIC pre-mRNA transcript comprises retained intron 1, the ASOs disclosed herein target SEQ ID NO: 61493 or 61498. In some embodiments, when the RDH5 RIC pre-mRNA transcript comprises retained intron 2, the ASOs disclosed herein target SEQ ID NO: 61455 or 61473. In some embodiments, when the RDH5 RIC pre-mRNA transcript comprises retained intron 1, the ASO has a sequence according to any one of SEQ ID NOs: 50276-50489 or 50276-50846. In some embodiments, when the RDH5 RIC pre-mRNA transcript comprises retained intron 2, the ASO has a sequence according to any one of SEQ ID NOs: 50490-50633 or 50847-50991. In some embodiments, the ASOs target an RDH5 RIC pre-mRNA sequence.

RDH12

In some embodiments, the ASOs disclosed herein target a RIC pre-mRNA transcribed from a RDH12 genomic sequence (an RDH12 RIC pre-mRNA). In some embodiments, the RDH12 genomic sequence is SEQ ID NO: 34803. In some embodiments, the RDH12 RIC pre-mRNA is SEQ ID NO: 34845. In some embodiments, the RDH12 RIC pre-mRNA transcript comprises retained intron 7. In some embodiments, when the RDH12 RIC pre-mRNA transcript comprises retained intron 7, the ASOs disclosed herein target SEQ ID NO: 61482. In some embodiments, when the RDH12 RIC pre-mRNA transcript comprises retained intron 7, the ASO has a sequence according to any one of SEQ ID NOs: 50992-51247. In some embodiments, the ASOs target an RDH12 RIC pre-mRNA sequence.

NR2E3

In some embodiments, the ASOs disclosed herein target a RIC pre-mRNA transcribed from a NR2E3 genomic sequence (an NR2E3 RIC pre-mRNA). In some embodiments, the NR2E3 genomic sequence is SEQ ID NO: 34804. In some embodiments, the NR2E3 RIC pre-mRNA is SEQ ID NO: 34846 or 34846. In some embodiments, the NR2E3 RIC pre-mRNA transcript comprises retained intron 1 and/or 2 and/or 3 and/or 4 and/or 5 and/or 6 and/or 7. In some embodiments, when the NR2E3 RIC pre-mRNA transcript comprises retained intron 1, the ASOs disclosed herein target SEQ ID NO: 61491. In some embodiments, when the NR2E3 RIC pre-mRNA transcript comprises retained intron 2, the ASOs disclosed herein target SEQ ID NO: 61449. In some embodiments, when the NR2E3 RIC pre-mRNA transcript comprises retained intron 3, the ASOs disclosed herein target SEQ ID NO: 61494. In some embodiments, when the NR2E3 RIC pre-mRNA transcript comprises retained intron 4, the ASOs disclosed herein target SEQ ID NO: 61487. In some embodiments, when the NR2E3 RIC pre-mRNA transcript comprises retained intron 5, the ASOs disclosed herein target SEQ ID NO: 61447. In some embodiments, when the NR2E3 RIC pre-mRNA transcript comprises retained intron 6, the ASOs disclosed herein target SEQ ID NO: 61465. In some embodiments, when the NR2E3 RIC pre-mRNA transcript comprises retained intron 7, the ASOs disclosed herein target SEQ ID NO: 61501 or 61490. In some embodiments, when the NR2E3 RIC pre-mRNA transcript comprises retained intron 1, the ASO has a sequence according to any one of SEQ ID NOs: 51256-16661 or 52052-52254. In some embodiments, when the NR2E3 RIC pre-mRNA transcript comprises retained intron 2, the ASO has a sequence according to any one of SEQ ID NOs: 51459-16272 or 52255-52320. In some embodiments, when the NR2E3 RIC pre-mRNA transcript comprises retained intron 3, the ASO has a sequence according to any one of SEQ ID NOs: 51525-51595 or 52321-52391. In some embodiments, when the NR2E3 RIC pre-mRNA transcript comprises retained intron 4, the ASO has a sequence according to any one of SEQ ID NOs: 51596-51687 or 52392-52483. In some embodiments, when the NR2E3 RIC pre-mRNA transcript comprises retained intron 5, the ASO has a sequence according to any one of SEQ ID NOs: 51688-51924 or 52484-52720. In some embodiments, when the NR2E3 RIC pre-mRNA transcript comprises retained intron 6, the ASO has a sequence according to any one of SEQ ID NOs: 51925-51966 or 52721-52762. In some embodiments, when the NR2E3 RIC pre-mRNA transcript comprises retained intron 7, the ASO has a sequence according to any one of SEQ ID NOs: 51967-52051 or 52763-53006. In some embodiments, the ASOs target an NR2E3 RIC pre-mRNA sequence.

RLBP1

In some embodiments, the ASOs disclosed herein target a RIC pre-mRNA transcribed from a RLBP1 genomic sequence (an RLBP1 RIC pre-mRNA). In some embodiments, the RLBP1 genomic sequence is SEQ ID NO: 34805. In some embodiments, the RLBP1 RIC pre-mRNA is SEQ ID NO: 34848. In some embodiments, the RLBP1 RIC pre-mRNA transcript comprises retained intron 2 and/or 5 In some embodiments, when the RLBP1 RIC pre-mRNA transcript comprises retained intron 2, the ASOs disclosed herein target SEQ ID NO: 61462. In some embodiments, when the RLBP1 RIC pre-mRNA transcript comprises retained intron 5, the ASOs disclosed herein target SEQ ID NO: 61456. In some embodiments, when the RLBP1 RIC pre-mRNA transcript comprises retained intron 2, the ASO has a sequence according to any one of SEQ ID NOs: 52999-53172. In some embodiments, when the RLBP1 RIC pre-mRNA transcript comprises retained intron 5, the ASO has a sequence according to any one of SEQ ID NOs: 53173-53427. In some embodiments, the ASOs target an RLBP1 RIC pre-mRNA sequence.

CTNS

In some embodiments, the ASOs disclosed herein target a RIC pre-mRNA transcribed from a CTNS genomic sequence (a CTNS RIC pre-mRNA). In some embodiments, the CTNS genomic sequence is SEQ ID NO: 34806. In some embodiments, the CTNS RIC pre-mRNA is SEQ ID NO: 34849 or 34850. In some embodiments, the CTNS RIC pre-mRNA transcript comprises retained intron 9 and/or 10. In some embodiments, when the CTNS RIC pre-mRNA transcript comprises retained intron 9, the ASOs disclosed herein target SEQ ID NO: 61479. In some embodiments, when the CTNS RIC pre-mRNA transcript comprises retained intron 10, the ASOs disclosed herein target SEQ ID NO: 61481. In some embodiments, when the CTNS RIC pre-mRNA transcript comprises retained intron 9, the ASO has a sequence according to any one of SEQ ID NOs: 53436-53658 or 53884-54106. In some embodiments, when the CTNS RIC pre-mRNA transcript comprises retained intron 10, the ASO has a sequence according to any one of SEQ ID NOs: 53659-53883 or 54107-54331. In some embodiments, the ASOs target a CTNS RIC pre-mRNA sequence.

PER1

In some embodiments, the ASOs disclosed herein target a RIC pre-mRNA transcribed from a PER1 genomic sequence (a PER1 RIC pre-mRNA). In some embodiments, the PER1 genomic sequence is SEQ ID NO: 34807. In some embodiments, the PER1 RIC pre-mRNA is SEQ ID NO: 34851. In some embodiments, the PER1 RIC pre-mRNA transcript comprises retained intron 1 and/or 14. In some embodiments, when the PER1 RIC pre-mRNA transcript comprises retained intron 1, the ASOs disclosed herein target SEQ ID NO: 61471. In some embodiments, when the PER1 RIC pre-mRNA transcript comprises retained intron 14, the ASOs disclosed herein target SEQ ID NO: 61499. In some embodiments, when the PER1 RIC pre-mRNA transcript comprises retained intron 1, the ASO has a sequence according to any one of SEQ ID NOs: 54324-54571. In some embodiments, when the PER1 RIC pre-mRNA transcript comprises retained intron 14, the ASO has a sequence according to any one of SEQ ID NOs: 54572-54634. In some embodiments, the ASOs target a PER1 RIC pre-mRNA sequence.

FSCN2

In some embodiments, the ASOs disclosed herein target a RIC pre-mRNA transcribed from a FSCN2 genomic sequence (an FSCN2 RIC pre-mRNA). In some embodiments, the FSCN2 genomic sequence is SEQ ID NO: 34808. In some embodiments, the FSCN2 RIC pre-mRNA is SEQ ID NO: 34852 or 34853. In some embodiments, the FSCN2 RIC pre-mRNA transcript comprises retained intron 1 and/or 3. In some embodiments, when the FSCN2 RIC pre-mRNA transcript comprises retained intron 1, the ASOs disclosed herein target SEQ ID NO: 61459. In some embodiments, when the FSCN2 RIC pre-mRNA transcript comprises retained intron 3, the ASOs disclosed herein target SEQ ID NO: 61451 or 61450. In some embodiments, when the FSCN2 RIC pre-mRNA transcript comprises retained intron 1, the ASO has a sequence according to any one of SEQ ID NOs: 54635-55021 or 55137-55523. In some embodiments, when the FSCN2 RIC pre-mRNA transcript comprises retained intron 3, the ASO has a sequence according to any one of SEQ ID NOs: 55022-55136 or 55524-55638. In some embodiments, the ASOs target an FSCN2 RIC pre-mRNA sequence.

TCF4

In some embodiments, the ASOs disclosed herein target a RIC pre-mRNA transcribed from a TCF4 genomic sequence (a TCF4 RIC pre-mRNA). In some embodiments, the TCF4 genomic sequence is SEQ ID NO: 34809. In some embodiments, the TCF4 RIC pre-mRNA is SEQ ID NO: 34854, 34855, 34856, 34857, 34858, 34859, 34860, 34861, 34862, 34863, 34864, 34865, 34866, 34867, 34868, or 34869. In some embodiments, the TCF4 RIC pre-mRNA transcript comprises retained intron 9 or 12 or 14 or 16 or 15 or 17 or 11.

In some embodiments, when the TCF4 RIC pre-mRNA transcript comprises retained intron 9, the ASOs disclosed herein target SEQ ID NO: 61477. In some embodiments, when the TCF4 RIC pre-mRNA transcript comprises retained intron 12, the ASOs disclosed herein target SEQ ID NO: 61477 or 61478. In some embodiments, when the TCF4 RIC pre-mRNA transcript comprises retained intron 14, the ASOs disclosed herein target SEQ ID NO: 61477. In some embodiments, when the TCF4 RIC pre-mRNA transcript comprises retained intron 16, the ASOs disclosed herein target SEQ ID NO: 61477 or 61478. In some embodiments, when the TCF4 RIC pre-mRNA transcript comprises retained intron 15, the ASOs disclosed herein target SEQ ID NO: 61477 or 61478. In some embodiments, when the TCF4 RIC pre-mRNA transcript comprises retained intron 17, the ASOs disclosed herein target SEQ ID NO: 61478. In some embodiments, when the TCF4 RIC pre-mRNA transcript comprises retained intron 11, the ASOs disclosed herein target SEQ ID NO: 61478. In some embodiments, when the TCF4 RIC pre-mRNA transcript comprises retained intron 9, the ASO has a sequence according to any one of SEQ ID NOs: 55649-56366. In some embodiments, when the TCF4 RIC pre-mRNA transcript comprises retained intron 12, the ASO has a sequence according to any one of SEQ ID NOs: 56367-56852 or 57579-57820. In some embodiments, when the TCF4 RIC pre-mRNA transcript comprises retained intron 14, the ASO has a sequence according to any one of SEQ ID NOs: 56853-57094. In some embodiments, when the TCF4 RIC pre-mRNA transcript comprises retained intron 16, the ASO has a sequence according to any one of SEQ ID NOs: 57095-57336, 58065-58308, 58795-59038, or 59283-59526. In some embodiments, when the TCF4 RIC pre-mRNA transcript comprises retained intron 15, the ASO has a sequence according to any one of SEQ ID NOs: 57337-57578, 57821-58064, or 58299-58550. In some embodiments, when the TCF4 RIC pre-mRNA transcript comprises retained intron 17, the ASO has a sequence according to any one of SEQ ID NOs: 58551-58794. In some embodiments, when the TCF4 RIC pre-mRNA transcript comprises retained intron 11, the ASO has a sequence according to any one of SEQ ID NOs: 59039-59282. In some embodiments, the ASOs target a TCF4 RIC pre-mRNA sequence.

RDH8

In some embodiments, the ASOs disclosed herein target a RIC pre-mRNA transcribed from a RDH8 genomic sequence (an RDH8 RIC pre-mRNA). In some embodiments, the RDH8 genomic sequence is SEQ ID NO: 34810. In some embodiments, the RDH8 RIC pre-mRNA is SEQ ID NO: 34870. In some embodiments, the RDH8 RIC pre-mRNA transcript comprises retained intron 4. In some embodiments, when the RDH8 RIC pre-mRNA transcript comprises retained intron 4, the ASOs disclosed herein target SEQ ID NO: 61469. In some embodiments, when the RDH8 RIC pre-mRNA transcript comprises retained intron 4, the ASO has a sequence according to any one of SEQ ID NOs: 59526-59662. In some embodiments, the ASOs target an RDH8 RIC pre-mRNA sequence.

NXNL1

In some embodiments, the ASOs disclosed herein target a RIC pre-mRNA transcribed from a NXNL1 genomic sequence (an NXNL1 RIC pre-mRNA). In some embodiments, the NXNL1 genomic sequence is SEQ ID NO: 34811. In some embodiments, the NXNL1 RIC pre-mRNA is SEQ ID NO: 34871. In some embodiments, the NXNL1 RIC pre-mRNA transcript comprises retained intron 1. In some embodiments, when the NXNL1 RIC pre-mRNA transcript comprises retained intron 1, the ASOs disclosed herein target SEQ ID NO: 61488. In some embodiments, when the NXNL1 RIC pre-mRNA transcript comprises retained intron 1, the ASO has a sequence according to any one of SEQ ID NOs: 59663-60020. In some embodiments, the ASOs target an NXNL1 RIC pre-mRNA sequence.

CRX

In some embodiments, the ASOs disclosed herein target a RIC pre-mRNA transcribed from a CRX genomic sequence (a CRX RIC pre-mRNA). In some embodiments, the CRX genomic sequence is SEQ ID NO: 34812. In some embodiments, the CRX RIC pre-mRNA is SEQ ID NO: 34872. In some embodiments, the CRX RIC pre-mRNA transcript comprises retained intron 1 and/or 2 and/or 3. In some embodiments, when the CRX RIC pre-mRNA transcript comprises retained intron 1, the ASOs disclosed herein target SEQ ID NO: 61464. In some embodiments, when the CRX RIC pre-mRNA transcript comprises retained intron 2, the ASOs disclosed herein target SEQ ID NO: 61484. In some embodiments, when the CRX RIC pre-mRNA transcript comprises retained intron 3, the ASOs disclosed herein target SEQ ID NO: 61475. In some embodiments, when the CRX RIC pre-mRNA transcript comprises retained intron 1, the ASO has a sequence according to any one of SEQ ID NOs: 60021-60254. In some embodiments, when the CRX RIC pre-mRNA transcript comprises retained intron 2, the ASO has a sequence according to any one of SEQ ID NOs: 60255-60484. In some embodiments, when the CRX RIC pre-mRNA transcript comprises retained intron 3, the ASO has a sequence according to any one of SEQ ID NOs: 60485-61443. In some embodiments, the ASOs target a CRX RIC pre-mRNA sequence.

In some embodiments the RIC pre-mRNA transcript comprises a retained intron. In some embodiments, the ASO targets an exon flanking the 5' splice site. In some embodiments, the ASO targets the retained intron. In some embodiments, the ASO targets an exon flanking the 3' splice site. A subsequent example of ASO targeting is provided below using TEAD1.

In some embodiments, the ASO targets exon 4 of TEAD1 RIC pre-mRNA comprising a retained intron 4. In some embodiments, the ASO targets an exon 4 sequence upstream (or 5') from the 5' splice site of a TEAD RIC pre-mRNA comprising a retained intron 4. In some embodiments, the ASO targets an exon sequence about 4 to about 44 nucleotides upstream (or 5') from the 5' splice site of a TEAD1 RIC pre-mRNA comprising a retained intron 4. In some embodiments, the ASO has a sequence according to any one of SEQ ID NOs: 43748-43756.

In some embodiments, the ASO targets intron 4 in a TEAD1 RIC pre-mRNA comprising a retained intron 4. In some embodiments, the ASO targets an intron 4 sequence downstream (or 3') from the 5' splice site of a TEAD1 RIC pre-mRNA comprising a retained intron 4. In some embodiments, the ASO targets an intron 4 sequence about 6 to about 496 nucleotides downstream (or 3') from the 5' splice site of a TEAD1 RIC pre-mRNA comprising a retained intron 4. In some embodiments, the ASO has a sequence according to any one of SEQ ID NOs: 8968-9064.

In some embodiments, the ASO targets an intron 4 sequence upstream (or 5') from the 3' splice site of a TEAD1 RIC pre-mRNA comprising a retained intron 4. In some embodiments, the ASO targets an intron 4 sequence about 16 to about 499 nucleotides upstream (or 5') from the 3' splice site of a TEAD1 RIC pre-mRNA a comprising retained intron 4. In some embodiments, the ASO has a sequence according to any one of SEQ ID NOs: 43854-43943.

In some embodiments, the ASO targets exon 5 in a TEAD1 RIC pre-mRNA comprising a retained intron 4. In some embodiments, the ASO targets an exon 5 sequence downstream (or 3') from the 3' splice site of a TEAD1 RIC pre-mRNA comprising a retained intron 4. In some embodiments, the ASO targets an exon 5 sequence about 2 to about 42 nucleotides downstream (or 3') from the 3' splice site of a TEAD1 RIC pre-mRNA comprising a retained intron 4. In some embodiments, the ASO has a sequence according to any one of SEQ ID NOs: 44044-43952.

In embodiments, the targeted portion of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA pre-mRNA is in intron 1, 2, 3, 4, 5, 6, 7, 8, 9, 10, 11, 12, 13, 14, 15, 16, 17, 18, 19, 20, 21, 22, 23, 24, or 25. In embodiments, hybridization of an ASO to the targeted portion of the RIC pre-mRNA results in enhanced splicing at the splice site (5' splice site or 3' splice site) of at least one of retained introns 1, 2, 3, 4, 5, 6, 7, 8, 9, 10, 11, 12, 13, 14, 15, 16, 17, 18, 19, 20, 21, 22, 23, 24, or 25, and subsequently increases ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein production.

The degree of intron retention can be expressed as percent intron retention (PIR), the percentage of transcripts in which a given intron is retained. In brief, PIR can be calculated as the percentage of the average number of reads mapping to the exon-intron junctions, over the sum of the average of the exon-intron junction reads plus the exon-exon junction reads.

PIR values for SCN1A have been reported, e.g., by Braunschweig, et al., 2014, (see, e.g., Supplemental Table S9), incorporated by reference herein in its entirety.

In embodiments, the methods described herein are used to increase the production of a functional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein. As used herein, the term "functional" refers to the amount of activity or function of a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein that is necessary to eliminate any one or more symptoms of a treated condition. In embodiments, the methods are used to increase the production of a partially functional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein. As used herein, the term "partially functional" refers to any amount of activity or function of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein that is less than the amount of activity or function that is necessary to eliminate or prevent any one or more symptoms of a disease or condition. In some embodiments, a partially functional protein or RNA will have at least 10%, at least 20%, at least 30%, at least 40%, at least 50%, at least 60%, at least 70%, at least 75%, at least 80%, 85%, at least 90%, or at least 95% less activity relative to the fully functional protein or RNA.

In embodiments, the method is a method of increasing the expression of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein by cells of a subject having a RIC pre-mRNA encoding the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, wherein the subject has a deficient amount of activity of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, and wherein the deficient amount of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein is caused by haploinsufficiency of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein. In such an embodiment, the subject has a first allele encoding a functional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, and a second allele from which the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein is not produced. In another such embodiment, the subject has a first allele encoding a functional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, and a second allele encoding a nonfunctional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein. In another such embodiment, the subject has a first allele encoding a functional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, and a second allele encoding a partially functional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein. In any of these embodiments, the antisense oligomer binds to a targeted portion of the RIC pre-mRNA transcribed from the first allele (encoding functional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein), thereby inducing constitutive splicing of the retained intron from the RIC pre-mRNA, and causing an increase in the level of mature mRNA encoding functional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, and an increase in the expression of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein in the cells of the subject In embodiments, the subject has a first allele encoding a functional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, and a second allele encoding a partially functional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, and the antisense oligomer binds to a targeted portion of the RIC pre-mRNA transcribed from the first allele (encoding functional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein) or a targeted portion of the RIC pre-mRNA transcribed from the second allele (encoding partially functional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein), thereby inducing constitutive splicing of the retained intron from the RIC pre-mRNA, and causing an increase in the level of mature mRNA encoding the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, and an increase in the expression of functional or partially functional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein in the cells of the subject.

In related embodiments, the method is a method of using an ASO to increase the expression of a protein or functional RNA. In embodiments, an ASO is used to increase the expression of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein in cells of a subject having a RIC pre-mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, wherein the subject has a deficiency in the amount or function of a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein.

In embodiments, the RIC pre-mRNA transcript that encodes the protein that is causative of the disease or condition is targeted by the ASOs described herein. In some embodiments, a RIC pre-mRNA transcript that encodes a protein that is not causative of the disease is targeted by the ASOs. For example, a disease that is the result of a mutation or deficiency of a first protein in a particular pathway may be ameliorated by targeting a RIC pre-mRNA that encodes a second protein, thereby increasing production of the second protein. In some embodiments, the function of the second protein is able to compensate for the mutation or deficiency of the first protein (which is causative of the disease or condition).

In embodiments, the subject has:
a. a first mutant allele from which
  i) the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein is produced at a reduced level compared to production from a wild-type allele,
  ii) the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein is produced in a form having reduced function compared to an equivalent wild-type protein, or
  iii) the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein or functional RNA is not produced; and
b. a second mutant allele from which
  i) the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein is produced at a reduced level compared to production from a wild-type allele,
  ii) the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein is produced in a form having reduced function compared to an equivalent wild-type protein, or
  iii) the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein is not produced, and
wherein the RIC pre-mRNA is transcribed from the first allele and/or the second allele. In these embodiments, the ASO binds to a targeted portion of the RIC pre-mRNA transcribed from the first allele or the second allele, thereby inducing constitutive splicing of the retained intron from the RIC pre-mRNA, and causing an increase in the level of mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein and an increase in the expression of the target protein or functional RNA in the cells of the subject. In these embodiments, the target protein or functional RNA having an increase in expression level resulting from the constitutive splicing of the retained intron from the RIC pre-mRNA is either in a form having reduced function compared to the equivalent wild-type protein (partially-functional), or having full function compared to the equivalent wild-type protein (fully-functional).

In embodiments, the level of mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein is increased 1.1 to 10-fold, when compared to the amount of mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA that is produced in a control cell, e.g., one that is not treated with the antisense oligomer or one that is treated with an antisense oligomer that does not bind to the targeted portion of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA.

In embodiments, the condition caused by a deficient amount or activity of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein is not a condition caused by alternative or aberrant splicing of the retained intron to which the ASO is targeted. In embodiments, the condition caused by a deficient amount or activity of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein is not a condition caused by alternative or aberrant splicing of any retained intron in a RIC pre-mRNA encoding the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein. In embodiments, alternative or aberrant splicing may occur in a pre-mRNA transcribed from the gene, however the compositions and methods of the invention do not prevent or correct this alternative or aberrant splicing.

In embodiments, a subject treated using the methods of the invention expresses a partially functional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein from one allele, wherein the partially functional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein is caused by a frameshift mutation, a nonsense mutation, a missense mutation, or a partial gene deletion. In embodiments, a subject treated using the methods of the invention expresses a nonfunctional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein from one allele, wherein the nonfunctional ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein is caused by a frameshift mutation, a nonsense mutation, a missense mutation, a partial gene deletion, in one allele. In embodiments, a subject treated using the methods of the invention has a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA whole gene deletion, in one allele.

Use of TANGO for Increasing Protein Expression

As described above, in embodiments, Targeted Augmentation of Nuclear Gene Output (TANGO) can be used in the methods of the invention to increase expression of a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein. In these embodiments, a retained-intron-containing pre-mRNA (RIC pre-mRNA) encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein is present in the nucleus of a cell. Cells having a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA that comprises a retained intron, an exon flanking the 5' splice site, and an exon flanking the 3' splice site, encoding the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, can be contacted with antisense oligomers (ASOs) that are complementary to a targeted portion of the RIC pre-mRNA. Hybridization of the ASOs to the targeted portion of the RIC pre-mRNA can result in enhanced splicing at the splice site (5' splice site or 3' splice site) of the retained intron and subsequently increases target protein production.

The terms "pre-mRNA," and "pre-mRNA transcript" may be used interchangeably and refer to any pre-mRNA species that contains at least one intron. In embodiments, pre-mRNA or pre-mRNA transcripts comprise a 5'-7-methylguanosine cap and/or a poly-A tail. In embodiments, pre-mRNA or pre-mRNA transcripts comprise both a 5'-7-methylguanosine cap and a poly-A tail. In some embodiments, the pre-mRNA transcript does not comprise a 5'-7-methylguanosine cap and/or a poly-A tail. A pre-mRNA transcript is a non-productive messenger RNA (mRNA) molecule if it is not translated into a protein (or transported into the cytoplasm from the nucleus).

As used herein, a "retained-intron-containing pre-mRNA" ("RIC pre-mRNA") is a pre-mRNA transcript that contains at least one retained intron. The RIC pre-mRNA contains a retained intron, an exon flanking the 5' splice site of the retained intron, an exon flanking the 3' splice site of the retained intron, and encodes the target protein. An "RIC pre-mRNA encoding a target protein" is understood to encode the target protein when fully spliced. A "retained intron" is any intron that is present in a pre-mRNA transcript when one or more other introns, such as an adjacent intron, encoded by the same gene have been spliced out of the same pre-mRNA transcript. In some embodiments, the retained intron is the most abundant intron in RIC pre-mRNA encoding the target protein. In embodiments, the retained intron is the most abundant intron in a population of RIC pre-mRNAs transcribed from the gene encoding the target protein in a cell, wherein the population of RIC pre-mRNAs comprises two or more retained introns. In embodiments, an antisense oligomer targeted to the most abundant intron in the population of RIC pre-mRNAs encoding the target protein induces splicing out of two or more retained introns in the population, including the retained intron to which the antisense oligomer is targeted or binds. In embodiments, a mature mRNA encoding the target protein is thereby produced. The terms "mature mRNA," and "fully-spliced mRNA," are used interchangeably herein to describe a fully processed mRNA encoding a target protein (e.g., mRNA that is exported from the nucleus into the cytoplasm and translated into target protein) or a fully processed functional RNA. The term "productive mRNA," also can be used to describe a fully processed mRNA encoding a target protein. In embodiments, the targeted region is in a retained intron that is the most abundant intron in a RIC pre-mRNA encoding the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein.

As used herein, the term "comprise" or variations thereof such as "comprises" or "comprising" are to be read to indicate the inclusion of any recited feature (e.g. in the case of an antisense oligomer, a defined nucleobase sequence) but not the exclusion of any other features. Thus, as used herein, the term "comprising" is inclusive and does not exclude additional, unrecited features (e.g. in the case of an antisense oligomer, the presence of additional, unrecited nucleobases).

In embodiments of any of the compositions and methods provided herein, "comprising" may be replaced with "consisting essentially of" or "consisting of" The phrase "consisting essentially of" is used herein to require the specified feature(s) (e.g. nucleobase sequence) as well as those which do not materially affect the character or function of the claimed invention. As used herein, the term "consisting" is used to indicate the presence of the recited feature (e.g. nucleobase sequence) alone (so that in the case of an antisense oligomer consisting of a specified nucleobase sequence, the presence of additional, unrecited nucleobases is excluded).

In embodiments, the targeted region is in a retained intron that is the second most abundant intron in a RIC pre-mRNA encoding the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein. For example, the second most abundant retained intron may be targeted rather than the most abundant retained intron due to the uniqueness of the nucleotide sequence of the second most abundant retained intron, ease of ASO design to target a particular nucleotide sequence, and/or amount of increase in protein production resulting from targeting the intron with an ASO. In embodiments, the retained intron is the second most abundant intron in a population of RIC pre-mRNAs transcribed from the gene encoding the target protein in a cell, wherein the population of RIC pre-mRNAs comprises two or more retained introns. In embodiments, an antisense oligomer targeted to the second most abundant intron in the population of RIC pre-mRNAs encoding the target protein induces splicing out of two or more retained introns in the population, including the retained intron to which the antisense oligomer is targeted or binds. In embodiments, fully-spliced (mature) RNA encoding the target protein is thereby produced.

In embodiments, an ASO is complementary to a targeted region that is within a non-retained intron in a RIC pre-mRNA. In embodiments, the targeted portion of the RIC pre-mRNA is within: the region +6 to +100 relative to the 5' splice site of the non-retained intron; or the region −16 to −100 relative to the 3' splice site of the non-retained intron. In embodiments, the targeted portion of the RIC pre-mRNA is within the region +100 relative to the 5' splice site of the non-retained intron to −100 relative to the 3' splice site of the non-retained intron. As used to identify the location of a region or sequence, "within" is understood to include the residues at the positions recited. For example, a region +6 to +100 includes the residues at positions +6 and +100. In embodiments, fully-spliced (mature) RNA encoding the target protein is thereby produced.

In embodiments, the retained intron of the RIC pre-mRNA is an inefficiently spliced intron. As used herein, "inefficiently spliced" may refer to a relatively low frequency of splicing at a splice site adjacent to the retained intron (5' splice site or 3' splice site) as compared to the frequency of splicing at another splice site in the RIC pre-mRNA. The term "inefficiently spliced" may also refer to the relative rate or kinetics of splicing at a splice site, in which an "inefficiently spliced" intron may be spliced or removed at a slower rate as compared to another intron in a RIC pre-mRNA.

In embodiments, the 9-nucleotide sequence at −3e to −1e of the exon flanking the 5' splice site and +1 to +6 of the retained intron is identical to the corresponding wild-type sequence. In embodiments, the 16 nucleotide sequence at −15 to −1 of the retained intron and +1e of the exon flanking the 3' splice site is identical to the corresponding wild-type sequence. As used herein, the "wild-type sequence" refers to the nucleotide sequence for the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA gene in the published reference genome deposited in the NCBI repository of biological and scientific information (operated by National Center for Biotechnology Information, National Library of Medicine, 8600 Rockville Pike, Bethesda, Md. USA 20894). As used herein, the "wild-type sequence" refers to NCBI Gene ID: (ROM1:6094; TEAD1: 7003; RDH5:5959; NR2E3:10002; PAX6:5080; CRX: 1406; FSCN2: 25794; ABCA4:24; MYOC:4653; TCF4: 6925; MFSD8:256471; CTNS:1497; NXNL1:115861). Also used herein, a nucleotide position denoted with an "e" indicates the nucleotide is present in the sequence of an exon (e.g., the exon flanking the 5' splice site or the exon flanking the 3' splice site).

The methods involve contacting cells with an ASO that is complementary to a portion of a pre-mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, resulting in increased expression of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA. As used herein, "contacting" or administering to cells refers to any method of providing an ASO in immediate proximity with the cells such that the ASO and the cells interact. A cell that is contacted with an ASO will take up or transport the ASO into the cell. The method involves contacting a condition or disease-associated or condition or disease-relevant cell with any of the ASOs described herein. In some embodiments, the ASO may be further modified or attached (e.g., covalently attached) to another molecule to target the ASO to a cell type, enhance contact between the ASO and the condition or disease-associated or condition or disease-relevant cell, or enhance uptake of the ASO.

As used herein, the term "increasing protein production" or "increasing expression of a target protein" means enhancing the amount of protein that is translated from an mRNA in a cell. A "target protein" may be any protein for which increased expression/production is desired.

In embodiments, contacting a cell that expresses a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA with an ASO that is complementary to a targeted portion of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA transcript results in a measurable increase in the amount of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein (e.g., a target protein) encoded by the pre-mRNA. Methods of measuring or detecting production of a protein will be evident to one of skill in the art and include any known method, for example, Western blotting, flow cytometry, immunofluorescence microscopy, and ELISA.

In embodiments, contacting cells with an ASO that is complementary to a targeted portion of a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA transcript results in an increase in the amount of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein produced by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein produced by the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold compared to the amount of target protein produced by an control compound. A control compound can be, for example, an oligonucleotide that is not complementary to the targeted portion of the RIC pre-mRNA.

In some embodiments, contacting cells with an ASO that is complementary to a targeted portion of a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA transcript results in an increase in the amount of mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA respectively, including the mature mRNA encoding the target protein. In some embodiments, the amount of mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, or the mature mRNA encoding the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, is increased by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of the mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, or the mature mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein produced in the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold compared to the amount of mature RNA produced in an untreated cell, e.g., an untreated cell or a cell treated with a control compound. A control compound can be, for example, an oligonucleotide that is not complementary to the targeted portion of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA.

Constitutive Splicing of a Retained Intron from a RIC pre-mRNA

The methods and antisense oligonucleotide compositions provided herein are useful for increasing the expression of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein in cells, for example, in a subject having a deficiency in the amount or activity of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, by increasing the level of mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, or the mature mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein. In particular, the methods and compositions as described herein can induce the constitutive splicing of a retained intron from a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA transcript encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, thereby increasing the level of mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, or the mature mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein and increasing the expression of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein.

Constitutive splicing of a retained intron from a RIC pre-mRNA correctly removes the retained intron from the RIC pre-mRNA, wherein the retained intron has wild-type splice sequences. Constitutive splicing, as used herein, does not encompass splicing of a retained intron from a RIC pre-mRNA transcribed from a gene or allele having a mutation that causes alternative splicing or aberrant splicing of a pre-mRNA transcribed from the gene or allele. For example, constitutive splicing of a retained intron, as induced using the methods and antisense oligonucleotides provided herein, does not correct aberrant splicing in or influence alternative splicing of a pre-mRNA to result in an increased expression of a target protein or functional RNA.

In embodiments, constitutive splicing can correctly remove a retained intron from a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA, wherein the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA is transcribed from a wild-type gene or allele, or a polymorphic gene or allele, that encodes a fully-functional target protein or functional RNA, and wherein the gene or allele does not have a mutation that causes alternative splicing or aberrant splicing of the retained intron.

In some embodiments, constitutive splicing of a retained intron from a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein correctly removes a retained intron from a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein, wherein the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA is transcribed from a gene or allele from which the target gene or functional RNA is produced at a reduced level compared to production from a wild-type allele, and wherein the gene or allele does not have a mutation that causes alternative splicing or aberrant splicing of the retained intron. In these embodiments, the correct removal of the constitutively spliced retained intron results in production of target protein or functional RNA that is functional when compared to an equivalent wild-type protein or functional RNA.

In other embodiments, constitutive splicing can correctly remove a retained intron from a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA, wherein the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA is transcribed from a gene or allele that encodes a target protein or functional RNA produced in a form having reduced function compared to an equivalent wild-type protein or functional RNA, and wherein the gene or allele does not have a mutation that causes alternative splicing or aberrant splicing of the retained intron. In these embodiments, the correct removal of the constitutively spliced retained intron results in production of partially functional target protein, or functional RNA that is partially functional when compared to an equivalent wild-type protein or functional RNA.

"Correct removal" of the retained intron by constitutive splicing refers to removal of the entire intron, without removal of any part of an exon.

In embodiments, an antisense oligomer as described herein or used in any method described herein does not increase the amount of mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein or the amount of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein by modulating alternative splicing or aberrant splicing of a pre-mRNA transcribed from the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA gene. Modulation of alternative splicing or aberrant splicing can be measured using any known method for analyzing the sequence and length of RNA species, e.g., by RT-PCR and using methods described elsewhere herein and in the literature. In embodiments, modulation of alternative or aberrant splicing is determined based on an increase or decrease in the amount of the spliced species of interest of at least 10% or 1.1-fold. In embodiments, modulation is determined based on an increase or decrease at a level that is at least 10% to 100% or 1.1 to 10-fold, as described herein regarding determining an increase in mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein in the methods of the invention.

In embodiments, the method is a method wherein the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA can be produce by partial splicing of a wild-type ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA pre-mRNA. In embodiments, the method is a method wherein the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA can be produce by partial splicing of a full-length wild-type ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA pre-mRNA. In embodiments, the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA can be produce by partial splicing of a full-length ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA pre-mRNA. In these embodiments, a full-length ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA pre-mRNA may have a polymorphism in a splice site of the retained intron that does not impair correct splicing of the retained intron as compared to splicing of the retained intron having the wild-type splice site sequence.

In embodiments, the mRNA encoding ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein is a full-length mature mRNA, or a wild-type mature mRNA. In these embodiments, a full-length mature mRNA may have a polymorphism that does not affect the activity of the target protein or the functional RNA encoded by the mature mRNA, as compared to the activity of ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA protein encoded by the wild-type mature mRNA.

Antisense Oligomers

One aspect of the present disclosure is a composition comprising antisense oligomers that enhances splicing by binding to a targeted portion of a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA. As used herein, the terms "ASO" and "antisense oligomer" are used interchangeably and refer to an oligomer such as a polynucleotide, comprising nucleobases, that hybridizes to a target nucleic acid (e.g., a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA) sequence by Watson-Crick base pairing or wobble base pairing (G-U). The ASO may have exact sequence complementary to the target sequence or near complementarity (e.g., sufficient complementarity to bind the target sequence and enhancing splicing at a splice site). ASOs are designed so that they bind (hybridize) to a target nucleic acid (e.g., a targeted portion of a pre-mRNA transcript) and remain hybridized under physiological conditions. Typically, if they hybridize to a site other than the intended (targeted) nucleic acid sequence, they hybridize to a limited number of sequences that are not a target nucleic acid (to a few sites other than a target nucleic acid). Design of an ASO can take into consideration the occurrence of the nucleic acid sequence of the targeted portion of the pre-mRNA transcript or a sufficiently similar nucleic acid sequence in other locations in the genome or cellular pre-mRNA or transcriptome, such that the likelihood the ASO will bind other sites and cause "off-target" effects is limited. Any antisense oligomers known in the art, for example in PCT Application No. PCT/US2014/054151, published as WO 2015/035091, titled "Reducing Nonsense-Mediated mRNA Decay," can be used to practice the methods described herein.

In some embodiments, ASOs "specifically hybridize" to or are "specific" to a target nucleic acid or a targeted portion of a RIC pre-mRNA. Typically such hybridization occurs with a Tm substantially greater than 37° C., preferably at least 50° C., and typically between 60° C. to approximately 90° C. Such hybridization preferably corresponds to stringent hybridization conditions. At a given ionic strength and pH, the Tm is the temperature at which 50% of a target sequence hybridizes to a complementary oligonucleotide.

Oligomers, such as oligonucleotides, are "complementary" to one another when hybridization occurs in an antiparallel configuration between two single-stranded polynucleotides. A double-stranded polynucleotide can be "complementary" to another polynucleotide, if hybridization can occur between one of the strands of the first polynucleotide and the second. Complementarity (the degree to which one polynucleotide is complementary with another) is quantifiable in terms of the proportion (e.g., the percentage) of bases in opposing strands that are expected to form hydrogen bonds with each other, according to generally accepted base-pairing rules. The sequence of an antisense oligomer (ASO) need not be 100% complementary to that of its target nucleic acid to hybridize. In certain embodiments, ASOs can comprise at least 70%, at least 75%, at least 80%, at least 85%, at least 90%, at least 95%, at least 96%, at least 97%, at least 98%, or at least 99% sequence complementarity to a target region within the target nucleic acid sequence to which they are targeted. For example, an ASO in which 18 of 20 nucleobases of the oligomeric compound are complementary to a target region, and would therefore specifically hybridize, would represent 90 percent complementarity. In this example, the remaining non-complementary nucleobases may be clustered together or interspersed with complementary nucleobases and need not be contiguous to each other or to complementary nucleobases. Percent complementarity of an ASO with a region of a target nucleic acid can be determined routinely using BLAST programs (basic local alignment search tools) and PowerBLAST programs known in the art (Altschul et al., J. Mol. Biol., 1990, 215, 403-410; Zhang and Madden, Genome Res., 1997, 7, 649-656).

An ASO need not hybridize to all nucleobases in a target sequence and the nucleobases to which it does hybridize may be contiguous or noncontiguous. ASOs may hybridize over one or more segments of a pre-mRNA transcript, such that intervening or adjacent segments are not involved in the hybridization event (e.g., a loop structure or hairpin structure may be formed). In certain embodiments, an ASO hybridizes to noncontiguous nucleobases in a target pre-mRNA transcript. For example, an ASO can hybridize to nucleobases in a pre-mRNA transcript that are separated by one or more nucleobase(s) to which the ASO does not hybridize.

The ASOs described herein comprise nucleobases that are complementary to nucleobases present in a target portion of a RIC pre-mRNA. The term ASO embodies oligonucleotides and any other oligomeric molecule that comprises nucleobases capable of hybridizing to a complementary nucleobase on a target mRNA but does not comprise a sugar moiety, such as a peptide nucleic acid (PNA). The ASOs may comprise naturally-occurring nucleotides, nucleotide analogs, modified nucleotides, or any combination of two or three of the preceding. The term "naturally occurring nucleotides" includes deoxyribonucleotides and ribonucleotides. The term "modified nucleotides" includes nucleotides with modified or substituted sugar groups and/or having a modified backbone. In some embodiments, all of the nucleotides of the ASO are modified nucleotides. Chemical modifications of ASOs or components of ASOs that are compatible with the methods and compositions described herein will be evident to one of skill in the art and can be found, for example, in U.S. Pat. No. 8,258,109 B2, U.S. Pat. No. 5,656,612, U.S. Patent Publication No. 2012/0190728, and Dias and Stein, Mol. Cancer Ther. 2002, 1, 347-355, herein incorporated by reference in their entirety.

The nucleobase of an ASO may be any naturally occurring, unmodified nucleobase such as adenine, guanine, cytosine, thymine and uracil, or any synthetic or modified nucleobase that is sufficiently similar to an unmodified nucleobase such that it is capable of hydrogen bonding with a nucleobase present on a target pre-mRNA. Examples of modified nucleobases include, without limitation, hypoxanthine, xanthine, 7-methylguanine, 5,6-dihydrouracil, 5-methylcytosine, and 5-hydroxymethoylcytosine.

The ASOs described herein also comprise a backbone structure that connects the components of an oligomer. The term "backbone structure" and "oligomer linkages" may be used interchangeably and refer to the connection between monomers of the ASO. In naturally occurring oligonucleotides, the backbone comprises a 3'-5' phosphodiester linkage connecting sugar moieties of the oligomer. The backbone structure or oligomer linkages of the ASOs described herein may include (but are not limited to) phosphorothioate, phosphorodithioate, phosphoroselenoate, phosphorodiselenoate, phosphoroanilothioate, phosphoraniladate, phosphoramidate, and the like. See e.g., LaPlanche et al., Nucleic Acids Res. 14:9081 (1986); Stec et al., J. Am. Chem. Soc. 106:6077 (1984), Stein et al., Nucleic Acids Res. 16:3209 (1988), Zon et al., Anti Cancer Drug Design 6:539 (1991); Zon et al., Oligonucleotides and Analogues: A Practical Approach, pp. 87-108 (F. Eckstein, Ed., Oxford University Press, Oxford England (1991)); Stec et al., U.S. Pat. No. 5,151,510; Uhlmann and Peyman, Chemical Reviews 90:543 (1990). In some embodiments, the backbone structure of the ASO does not contain phosphorous but rather contains peptide bonds, for example in a peptide nucleic acid (PNA), or linking groups including carbamate, amides, and linear and cyclic hydrocarbon groups. In some embodiments, the backbone modification is a phosphorothioate linkage. In some embodiments, the backbone modification is a phosphoramidate linkage.

In embodiments, the stereochemistry at each of the phosphorus internucleotide linkages of the ASO backbone is random. In embodiments, the stereochemistry at each of the phosphorus internucleotide linkages of the ASO backbone is controlled and is not random. For example, U.S. Pat. App. Pub. No. 2014/0194610, "Methods for the Synthesis of Functionalized Nucleic Acids," incorporated herein by reference, describes methods for independently selecting the handedness of chirality at each phosphorous atom in a nucleic acid oligomer. In embodiments, an ASO used in the methods of the invention comprises an ASO having phosphorus internucleotide linkages that are not random. In embodiments, a composition used in the methods of the invention comprises a pure diastereomeric ASO. In embodiments, a composition used in the methods of the invention comprises an ASO that has diastereomeric purity of at least about 90%, at least about 91%, at least about 92%, at least about 93%, at least about 94%, at least about 95%, at least about 96%, at least about 97%, at least about 98%, at least about 99%, about 100%, about 90% to about 100%, about 91% to about 100%, about 92% to about 100%, about 93% to about 100%, about 94% to about 100%, about 95% to about 100%, about 96% to about 100%, about 97% to about 100%, about 98% to about 100%, or about 99% to about 100%.

In embodiments, the ASO has a nonrandom mixture of Rp and Sp configurations at its phosphorus internucleotide linkages. For example, it has been suggested that a mix of Rp and Sp is required in antisense oligonucleotides to achieve a balance between good activity and nuclease stability (Wan, et al., 2014, "Synthesis, biophysical properties and biological activity of second generation antisense oligonucleotides containing chiral phosphorothioate linkages," Nucleic Acids Research 42(22): 13456-13468, incorporated herein by reference). In embodiments, an ASO used in the methods of the invention comprises about 5-100% Rp, at least about 5% Rp, at least about 10% Rp, at least about 15% Rp, at least about 20% Rp, at least about 25% Rp, at least about 30% Rp, at least about 35% Rp, at least about 40% Rp, at least about 45% Rp, at least about 50% Rp, at least about 55% Rp, at least about 60% Rp, at least about 65% Rp, at least about 70% Rp, at least about 75% Rp, at least about 80% Rp, at least about 85% Rp, at least about 90% Rp, or at least about 95% Rp, with the remainder Sp, or about 100% Rp. In embodiments, an ASO used in the methods of the invention comprises about 10% to about 100% Rp, about 15% to about 100% Rp, about 20% to about 100% Rp, about 25% to about 100% Rp, about 30% to about 100% Rp, about 35% to about 100% Rp, about 40% to about 100% Rp, about 45% to about 100% Rp, about 50% to about 100% Rp, about 55% to about 100% Rp, about 60% to about 100% Rp, about 65% to about 100% Rp, about 70% to about 100% Rp, about 75% to about 100% Rp, about 80% to about 100% Rp, about 85% to about 100% Rp, about 90% to about 100% Rp, or about 95% to about 100% Rp, about 20% to about 80% Rp, about 25% to about 75% Rp, about 30% to about 70% Rp, about 40% to about 60% Rp, or about 45% to about 55% Rp, with the remainder Sp.

In embodiments, an ASO used in the methods of the invention comprises about 5-100% Sp, at least about 5% Sp, at least about 10% Sp, at least about 15% Sp, at least about 20% Sp, at least about 25% Sp, at least about 30% Sp, at least about 35% Sp, at least about 40% Sp, at least about 45% Sp, at least about 50% Sp, at least about 55% Sp, at least about 60% Sp, at least about 65% Sp, at least about 70% Sp, at least about 75% Sp, at least about 80% Sp, at least about 85% Sp, at least about 90% Sp, or at least about 95% Sp, with the remainder Rp, or about 100% Sp. In embodiments, an ASO used in the methods of the invention, comprises about 10% to about 100% Sp, about 15% to about 100% Sp, about 20% to about 100% Sp, about 25% to about 100% Sp, about 30% to about 100% Sp, about 35% to about 100% Sp, about 40% to about 100% Sp, about 45% to about 100% Sp, about 50% to about 100% Sp, about 55% to about 100% Sp, about 60% to about 100% Sp, about 65% to about 100% Sp, about 70% to about 100% Sp, about 75% to about 100% Sp, about 80% to about 100% Sp, about 85% to about 100% Sp, about 90% to about 100% Sp, or about 95% to about 100% Sp, about 20% to about 80% Sp, about 25% to about 75% Sp, about 30% to about 70% Sp, about 40% to about 60% Sp, or about 45% to about 55% Sp, with the remainder Rp.

Any of the ASOs described herein may contain a sugar moiety that comprises ribose or deoxyribose, as present in naturally occurring nucleotides, or a modified sugar moiety or sugar analog, including a morpholine ring. Non-limiting examples of modified sugar moieties include 2' substitutions such as 2'-O-methyl (2'-O-Me), 2'-O-methoxyethyl (2'MOE), 2'-O-aminoethyl, 2'F; N3'→P5' phosphoramidate, 2'dimethylaminooxyethoxy, 2'dimethylaminoethoxyethoxy, 2'-guanidinidium, 2'-O-guanidinium ethyl, carbamate modified sugars, and bicyclic modified sugars. In some embodiments, the sugar moiety modification is selected from 2'-O-Me, 2'F, and 2'MOE. In some embodiments, the sugar moiety modification is an extra bridge bond, such as in a locked nucleic acid (LNA). In some embodiments the sugar analog contains a morpholine ring, such as phosphorodiamidate morpholino (PMO). In some embodiments, the sugar moiety comprises a ribofuransyl or 2'deoxyribofuransyl modification. In some embodiments, the sugar moiety comprises 2'4'-constrained 2'O-methyloxyethyl (cMOE) modifications. In some embodiments, the sugar moiety comprises cEt 2', 4' constrained 2'-O ethyl BNA modifications. In some embodiments, the sugar moiety comprises tricycloDNA (tcDNA) modifications. In some embodiments, the sugar moiety comprises ethylene nucleic acid (ENA) modifications. In some embodiments, the sugar moiety comprises MCE modifications. Modifications are known in the art and described in the literature, e.g., by Jarver, et al., 2014, "A Chemical View of Oligonucleotides for Exon Skipping and Related Drug Applications," Nucleic Acid Therapeutics 24(1): 37-47, incorporated by reference for this purpose herein.

In some examples, each monomer of the ASO is modified in the same way, for example each linkage of the backbone of the ASO comprises a phosphorothioate linkage or each ribose sugar moiety comprises a 2'O-methyl modification. Such modifications that are present on each of the monomer components of an ASO are referred to as "uniform modifications." In some examples, a combination of different modifications may be desired, for example, an ASO may comprise a combination of phosphorodiamidate linkages and sugar moieties comprising morpholine rings (morpholinos). Combinations of different modifications to an ASO are referred to as "mixed modifications" or "mixed chemistries."

In some embodiments, the ASO comprises one or more backbone modification. In some embodiments, the ASO comprises one or more sugar moiety modification. In some embodiments, the ASO comprises one or more backbone modification and one or more sugar moiety modification. In some embodiments, the ASO comprises 2'MOE modifications and a phosphorothioate backbone. In some embodiments, the ASO comprises a phosphorodiamidate morpholino (PMO). In some embodiments, the ASO comprises a peptide nucleic acid (PNA). Any of the ASOs or any component of an ASO (e.g., a nucleobase, sugar moiety, backbone) described herein may be modified in order to achieve desired properties or activities of the ASO or reduce undesired properties or activities of the ASO. For example, an ASO or one or more component of any ASO may be modified to enhance binding affinity to a target sequence on a pre-mRNA transcript; reduce binding to any non-target sequence; reduce degradation by cellular nucleases (i.e., RNase H); improve uptake of the ASO into a cell and/or into the nucleus of a cell; alter the pharmacokinetics or pharmacodynamics of the ASO; and modulate the half-life of the ASO.

In some embodiments, the ASOs are comprised of 2'-O-(2-methoxyethyl) (MOE) phosphorothioate-modified nucleotides. ASOs comprised of such nucleotides are especially well-suited to the methods disclosed herein; oligomers having such modifications have been shown to have significantly enhanced resistance to nuclease degradation and increased bioavailability, making them suitable, for example, for oral delivery in some embodiments described herein. See e.g., Geary et al., J Pharmacol Exp Ther. 2001; 296(3):890-7; Geary et al., J Pharmacol Exp Ther. 2001; 296(3):898-904.

Methods of synthesizing ASOs will be known to one of skill in the art. Alternatively or in addition, ASOs may be obtained from a commercial source.

Unless specified otherwise, the left-hand end of single-stranded nucleic acid (e.g., pre-mRNA transcript, oligonucleotide, ASO, etc.) sequences is the 5' end and the left-hand direction of single or double-stranded nucleic acid sequences is referred to as the 5' direction. Similarly, the right-hand end or direction of a nucleic acid sequence (single or double stranded) is the 3' end or direction. Generally, a region or sequence that is 5' to a reference point in a nucleic acid is referred to as "upstream," and a region or sequence that is 3' to a reference point in a nucleic acid is referred to as "downstream." Generally, the 5' direction or end of an mRNA is where the initiation or start codon is located, while the 3' end or direction is where the termination codon is located. In some aspects, nucleotides that are upstream of a reference point in a nucleic acid may be designated by a negative number, while nucleotides that are downstream of a reference point may be designated by a positive number. For example, a reference point (e.g., an exon-exon junction in mRNA) may be designated as the "zero" site, and a nucleotide that is directly adjacent and upstream of the reference point is designated "minus one," e.g., "−1," while a nucleotide that is directly adjacent and downstream of the reference point is designated "plus one," e.g., "+1."

In other embodiments, the ASOs are complementary to (and bind to) a targeted portion of a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA that is downstream (in the 3' direction) of the 5' splice site of the retained intron in a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA (e.g., the direction designated by positive numbers relative to the 5' splice site) (FIG. 1). In some embodiments, the ASOs are complementary to a targeted portion of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA that is within the region +6 to +100 relative to the 5' splice site of the retained intron. In some embodiments, the ASO is not complementary to nucleotides +1 to +5 relative to the 5' splice site (the first five nucleotides located downstream of the 5' splice site). In some embodiments, the ASOs may be complementary to a targeted portion of a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA that is within the region between nucleotides +6 and +50 relative to the 5' splice site of the retained intron. In some aspects, the ASOs are complementary to a targeted portion that is within the region +6 to +90, +6 to +80, +6 to +70, +6 to +60, +6 to +50, +6 to +40, +6 to +30, or +6 to +20 relative to 5' splice site of the retained intron.

In some embodiments, the ASOs are complementary to a targeted region of a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA that is upstream (5' relative) of the 3' splice site of the retained intron in a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA (e.g., in the direction designated by negative numbers) (FIG. 1). In some embodiments, the ASOs are complementary to a targeted portion of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA that is within the region −16 to −100 relative to the 3' splice site of the retained intron. In some embodiments, the ASO is not complementary to nucleotides −1 to −15 relative to the 3' splice site (the first 15 nucleotides located upstream of the 3' splice site). In some embodiments, the ASOs are complementary to a targeted portion of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA that is within the region −16 to −50 relative to the 3' splice site of the retained intron. In some aspects, the ASOs are complementary to a targeted portion that is within the region −16 to −90, −16 to −80, −16 to −70, −16 to −60, −16 to −50, −16 to −40, or −16 to −30 relative to 3' splice site of the retained intron.

In embodiments, the targeted portion of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA is within the region +100 relative to the 5' splice site of the retained intron to −100 relative to the 3' splice site of the retained intron.

In some embodiments, the ASOs are complementary to a targeted portion of a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA that is within the exon flanking the 5' splice site (upstream) of the retained intron (FIG. 1). In some embodiments, the ASOs are complementary to a targeted portion of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA that is within the region +2e to −4e in the exon flanking the 5' splice site of the retained intron. In some embodiments, the ASOs are not complementary to nucleotides −1e to −3e relative to the 5' splice site of the retained intron. In some embodiments, the ASOs are complementary to a targeted portion of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA that is within the region −4e to −100e, −4e to −90e, −4e to −80e, −4e to −70e, −4e to −60e, −4e to −50e, −4 to −40e, −4e to −30e, or −4e to −20e relative to the 5' splice site of the retained intron.

In some embodiments, the ASOs are complementary to a targeted portion of a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA that is within the exon flanking the 3' splice site (downstream) of the retained intron (FIG. 1). In some embodiments, the ASOs are complementary to a targeted portion to the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA that is within the region +2e to −4e in the exon flanking the 3' splice site of the retained intron. In some embodiments, the ASOs are not complementary to nucleotide +1e relative to the 3' splice site of the retained intron. In some embodiments, the ASOs are complementary to a targeted portion of the ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA that is within the region +2e to +100e, +2e to +90e, +2e to +80e, +2e to +70e, +2e to +60e, +2e to +50e, +2e to +40e, +2e to +30e, or +2 to +20e relative to the 3' splice site of the retained intron. The ASOs may be of any length suitable for specific binding and effective enhancement of splicing. In some embodiments, the ASOs consist of 8 to 50 nucleobases. For example, the ASO may be 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, or 50 nucleobases in length. In some embodiments, the ASOs consist of more than 50 nucleobases. In some embodiments, the ASO is from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, 12 to 15 nucleobases, 13 to 50 nucleobases, 13 to 40 nucleobases, 13 to 35 nucleobases, 13 to 30 nucleobases, 13 to 25 nucleobases, 13 to 20 nucleobases, 14 to 50 nucleobases, 14 to 40 nucleobases, 14 to 35 nucleobases, 14 to 30 nucleobases, 14 to 25 nucleobases, 14 to 20 nucleobases, 15 to 50 nucleobases, 15 to 40 nucleobases, 15 to 35 nucleobases, 15 to 30 nucleobases, 15 to 25 nucleobases, 15 to 20 nucleobases, 20 to 50 nucleobases, 20 to 40 nucleobases, 20 to 35 nucleobases, 20 to 30 nucleobases, 20 to 25 nucleobases, 25 to 50 nucleobases, 25 to 40 nucleobases, 25 to 35 nucleobases, or 25 to 30 nucleobases in length. In some embodiments, the ASOs are 18 nucleotides in length. In some embodiments, the ASOs are 15 nucleotides in length. In some embodiments, the ASOs are 25 nucleotides in length.

In some embodiments, two or more ASOs with different chemistries but complementary to the same targeted portion of the RIC pre-mRNA are used. In some embodiments, two or more ASOs that are complementary to different targeted portions of the RIC pre-mRNA are used.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties, and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

In some embodiments, the nucleic acid to be targeted by an ASO is a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA expressed in a cell, such as a eukaryotic cell. In some embodiments, the term "cell" may refer to a population of cells. In some embodiments, the cell is in a subject. In some embodiments, the cell is isolated from a subject. In some embodiments, the cell is ex vivo. In some embodiments, the cell is a condition or disease-relevant cell or a cell line. In some embodiments, the cell is in vitro (e.g., in cell culture).

Pharmaceutical Compositions

Pharmaceutical compositions or formulations comprising the antisense oligonucleotide of the described compositions and for use in any of the described methods can be prepared according to conventional techniques well known in the pharmaceutical industry and described in the published literature. In embodiments, a pharmaceutical composition or formulation for treating a subject comprises an effective amount of any antisense oligomer as described above, or a pharmaceutically acceptable salt, solvate, hydrate or ester thereof, and a pharmaceutically acceptable diluent. The antisense oligomer of a pharmaceutical formulation may further comprise a pharmaceutically acceptable excipient, diluent or carrier.

Pharmaceutically acceptable salts are suitable for use in contact with the tissues of humans and lower animals without undue toxicity, irritation, allergic response, etc., and are commensurate with a reasonable benefit/risk ratio. (See, e.g., S. M. Berge, et al., J. Pharmaceutical Sciences, 66: 1-19 (1977), incorporated herein by reference for this purpose. The salts can be prepared in situ during the final isolation and purification of the compounds, or separately by reacting the free base function with a suitable organic acid. Examples of pharmaceutically acceptable, nontoxic acid addition salts are salts of an amino group formed with inorganic acids such as hydrochloric acid, hydrobromic acid, phosphoric acid, sulfuric acid and perchloric acid or with organic acids such as acetic acid, oxalic acid, maleic acid, tartaric acid, citric acid, succinic acid or malonic acid or by using other documented methodologies such as ion exchange. Other pharmaceutically acceptable salts include adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, lower alkyl sulfonate and aryl sulfonate.

In embodiments, the compositions are formulated into any of many possible dosage forms such as, but not limited to, tablets, capsules, gel capsules, liquid syrups, soft gels, suppositories, and enemas. In embodiments, the compositions are formulated as suspensions in aqueous, non-aqueous or mixed media. Aqueous suspensions may further contain substances that increase the viscosity of the suspension including, for example, sodium carboxymethylcellulose, sorbitol and/or dextran. The suspension may also contain stabilizers. In embodiments, a pharmaceutical formulation or composition of the present invention includes, but is not limited to, a solution, emulsion, microemulsion, foam or liposome-containing formulation (e.g., cationic or noncationic liposomes).

The pharmaceutical composition or formulation of the present invention may comprise one or more penetration enhancer, carrier, excipients or other active or inactive ingredients as appropriate and well known to those of skill in the art or described in the published literature. In embodiments, liposomes also include sterically stabilized liposomes, e.g., liposomes comprising one or more specialized lipids. These specialized lipids result in liposomes with enhanced circulation lifetimes. In embodiments, a sterically stabilized liposome comprises one or more glycolipids or is derivatized with one or more hydrophilic polymers, such as a polyethylene glycol (PEG) moiety. In embodiments, a surfactant is included in the pharmaceutical formulation or compositions. The use of surfactants in drug products, formulations and emulsions is well known in the art. In embodiments, the present invention employs a penetration enhancer to effect the efficient delivery of the antisense oligonucleotide, e.g., to aid diffusion across cell membranes and/or enhance the permeability of a lipophilic drug. In embodiments, the penetration enhancers is a surfactant, fatty acid, bile salt, chelating agent, or non-chelating nonsurfactant.

In embodiments, the pharmaceutical formulation comprises multiple antisense oligonucleotides. In embodiments, the antisense oligonucleotide is administered in combination with another drug or therapeutic agent. In embodiments, the antisense oligonucleotide is administered with one or more agents capable of promoting penetration of the subject antisense oligonucleotide across the blood-brain barrier by any method known in the art. For example, delivery of agents by administration of an adenovirus vector to motor neurons in muscle tissue is described in U.S. Pat. No. 6,632,427, "Adenoviral-vector-mediated gene transfer into medullary motor neurons," incorporated herein by reference. Delivery of vectors directly to the brain, e.g., the striatum, the thalamus, the hippocampus, or the substantia nigra, is described, e.g., in U.S. Pat. No. 6,756,523, "Adenovirus vectors for the transfer of foreign genes into cells of the central nervous system particularly in brain," incorporated herein by reference.

In embodiments, the antisense oligonucleotides are linked or conjugated with agents that provide desirable pharmaceutical or pharmacodynamic properties. In embodiments, the antisense oligonucleotide is coupled to a substance, known in the art to promote penetration or transport across the blood-brain barrier, e.g., an antibody to the transferrin receptor. In embodiments, the antisense oligonucleotide is linked with a viral vector, e.g., to render the antisense compound more effective or increase transport across the blood-brain barrier. In embodiments, osmotic blood brain barrier disruption is assisted by infusion of sugars, e.g., meso erythritol, xylitol, D(+) galactose, D(+) lactose, D(+) xylose, dulcitol, myo-inositol, L(−) fructose, D(−) mannitol, D(+) glucose, D(+) arabinose, D(−) arabinose, cellobiose, D(+) maltose, D(+) raffinose, L(+) rhamnose, D(+) melibiose, D(−) ribose, adonitol, D(+) arabitol, L(−) arabitol, D(+) fucose, L(−) fucose, D(−) lyxose, L(+) lyxose, and L(−) lyxose, or amino acids, e.g., glutamine, lysine, arginine, asparagine, aspartic acid, cysteine, glutamic acid, glycine, histidine, leucine, methionine, phenylalanine, proline, serine, threonine, tyrosine, valine, and taurine. Methods and materials for enhancing blood brain barrier penetration are described, e.g., in U.S. Pat. No. 4,866,042, "Method for the delivery of genetic material across the blood brain barrier," U.S. Pat. No. 6,294,520, "Material for passage through the blood-brain barrier," and U.S. Pat. No. 6,936,589, "Parenteral delivery systems," each incorporated herein by reference.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties, and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

Treatment of Subjects

Any of the compositions provided herein may be administered to an individual. "Individual" may be used interchangeably with "subject" or "patient." An individual may be a mammal, for example a human or animal such as a non-human primate, a rodent, a rabbit, a rat, a mouse, a horse, a donkey, a goat, a cat, a dog, a cow, a pig, or a sheep. In embodiments, the individual is a human. In embodiments, the individual is a fetus, an embryo, or a child. In other embodiments, the individual may be another eukaryotic organism, such as a plant. In some embodiments, the compositions provided herein are administered to a cell ex vivo.

In some embodiments, the compositions provided herein are administered to an individual as a method of treating a disease or disorder. In some embodiments, the individual has a genetic disease, such as any of the diseases described herein. In some embodiments, the individual is at risk of having the disease, such as any of the diseases described herein. In some embodiments, the individual is at increased risk of having a disease or disorder caused by insufficient amount of a protein or insufficient activity of a protein. If an individual is "at an increased risk" of having a disease or disorder caused insufficient amount of a protein or insufficient activity of a protein, the method involves preventative or prophylactic treatment. For example, an individual may be at an increased risk of having such a disease or disorder because of family history of the disease. Typically, individuals at an increased risk of having such a disease or disorder benefit from prophylactic treatment (e.g., by preventing or delaying the onset or progression of the disease or disorder).

Suitable routes for administration of ASOs of the present invention may vary depending on cell type to which delivery of the ASOs is desired. The ASOs of the present invention may be administered to patients parenterally, for example, by intravitreal injection, subretinal injection, topical application, implantation, intraperitoneal injection, intramuscular injection, subcutaneous injection, or intravenous injection. In embodiments, delivery is to the heart or liver. In embodiments, a fetus is treated in utero, e.g., by administering the ASO composition to the fetus directly or indirectly (e.g., via the mother).

The compositions of the present invention may be provided to muscle cells by any suitable means, including direct administration (e.g., locally by injection or topical administration at a treatment site) or systemically (e.g., parenterally or orally), intranasally, orally, or by intravitreal, subretinal, implantation, inhalational, enteral, topical, intrauterine, vaginal, sublingual, rectal, intramuscular, intrapleural, intraventricular, intraperitoneal, ophthalmic, intravenous, or subcutaneous means.

Methods of Identifying Additional ASOs that Enhance Splicing

Also within the scope of the present invention are methods for identifying (determining) additional ASOs that enhance splicing of a ROM1, TEAD1, RDH5, NR2E3, PAX6, CRX, FSCN2, ABCA4, MYOC, TCF4, MFSD8, CTNS, NXNL1, OPTN, RLBP1, RPE65, LRAT, RDH8, RDH12, RGR, CNGA3, ALMS1, PER1 or IDUA RIC pre-mRNA, specifically at the target intron. ASOs that specifically hybridize to different nucleotides within the target region of the pre-mRNA may be screened to identify (determine) ASOs that improve the rate and/or extent of splicing of the target intron. In some embodiments, the ASO may block or interfere with the binding site(s) of a splicing repressor(s)/silencer. Any method known in the art may be used to identify (determine) an ASO that when hybridized to the target region of the intron results in the desired effect (e.g., enhanced splicing, protein or functional RNA production). These methods also can be used for identifying ASOs that enhance splicing of the retained intron by binding to a targeted region in an exon flanking the retained intron, or in a non-retained intron. An example of a method that may be used is provided below.

A round of screening, referred to as an ASO "walk" may be performed using ASOs that have been designed to hybridize to a target region of a pre-mRNA. For example, the ASOs used in the ASO walk can be tiled every 5 nucleotides from approximately 100 nucleotides upstream of the 5' splice site of the retained intron (e.g., a portion of sequence of the exon located upstream of the target/retained intron) to approximately 100 nucleotides downstream of the 5' splice site of the target/retained intron and/or from approximately 100 nucleotides upstream of the 3' splice site of the retained intron to approximately 100 nucleotides downstream of the 3' splice site of the target/retained intron (e.g., a portion of sequence of the exon located downstream of the target/retained intron). For example, a first ASO of 15 nucleotides in length may be designed to specifically hybridize to nucleotides +6 to +20 relative to the 5' splice site of the target/retained intron. A second ASO is designed to specifically hybridize to nucleotides +11 to +25 relative to the 5' splice site of the target/retained intron. ASOs are designed as such spanning the target region of the pre-mRNA. In embodiments, the ASOs can be tiled more closely, e.g., every 1, 2, 3, or 4 nucleotides. Further, the ASOs can be tiled from 100 nucleotides downstream of the 5' splice site, to 100 nucleotides upstream of the 3' splice site.

One or more ASOs, or a control ASO (an ASO with a scrambled sequence, sequence that is not expected to hybridize to the target region) are delivered, for example by transfection, into a disease-relevant cell line that expresses the target pre-mRNA (e.g., the RIC pre-mRNA described elsewhere herein). The splicing-inducing effects of each of the ASOs may be assessed by any method known in the art, for example by reverse transcriptase (RT)-PCR using primers that span the splice junction, as described herein (see "Identification of intron-retention events"). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein.

The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

A second round of screening, referred to as an ASO "micro-walk" may be performed using ASOs that have been designed to hybridize to a target region of a pre-mRNA. The ASOs used in the ASO micro-walk are tiled every 1 nucleotide to further refine the nucleotide acid sequence of the pre-mRNA that when hybridized with an ASO results in enhanced splicing.

Regions defined by ASOs that promote splicing of the target intron are explored in greater detail by means of an ASO "micro-walk", involving ASOs spaced in 1-nt steps, as well as longer ASOs, typically 18-25 nt.

As described for the ASO walk above, the ASO micro-walk can be perform by delivering one or more ASOs, or a control ASO (an ASO with a scrambled sequence, sequence that is not expected to hybridize to the target region), for example by transfection, into a disease-relevant cell line that expresses the target pre-mRNA. The splicing-inducing effects of each of the ASOs may be assessed by any method known in the art, for example by reverse transcriptase (RT)-PCR using primers that span the splice junction, as described herein (see "Identification of intron-retention events"). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

ASOs that when hybridized to a region of a pre-mRNA result in enhanced splicing and increased protein production may be tested in vivo using animal models, for example transgenic mouse models in which the full-length human gene has been knocked-in or in humanized mouse models of disease. Suitable routes for administration of ASOs may vary depending on the disease and/or the cell types to which delivery of the ASOs is desired. ASOs may be administered, for example, by intraperitoneal injection, intramuscular injection, subcutaneous injection, or intravenous injection. Following administration, the cells, tissues, and/or organs of the model animals may be assessed to determine the effect of the ASO treatment by for example evaluating splicing (efficiency, rate, extent) and protein production by methods known in the art and described herein. The animal models may also be any phenotypic or behavioral indication of the disease or disease severity.

Compositions and Methods for Treatment of Liver Disease

Liver disease is a debilitating condition that results in an estimated 60,000 deaths per year in the United States alone. In many cases, the only hope for those suffering from liver failure is a liver transplant, though the donor pool is only estimated to be approximately 4,000. Therefore, the odds of receiving a transplant is low, and there are few treatments available to ameliorate the condition for those unable to receive a transplant. Therefore, there exists a need for compositions and methods for treating liver diseases.

Individual introns in primary transcripts of protein-coding genes having one or more than one intron are spliced from the primary transcript with different efficiencies. In most cases only the fully spliced mRNA is exported through nuclear pores for subsequent translation in the cytoplasm. Unspliced and partially spliced transcripts are detectable in the nucleus. It is generally thought that nuclear accumulation of transcripts that are not fully spliced is a mechanism to prevent the accumulation of potentially deleterious mRNAs in the cytoplasm that may be translated to protein. For some genes, splicing of the least efficient intron is a rate-limiting post-transcriptional step in gene expression, prior to translation in the cytoplasm.

Substantial levels of partially-spliced transcripts of the gene, which encodes a protein that is deficient in a subset of liver diseases, have been discovered in the nucleus of human cells. These pre-mRNA species comprise at least one retained intron. The present invention provides compositions and methods for upregulating splicing of one or more retained introns that are rate-limiting for the nuclear stages of gene expression to increase steady-state production of fully-spliced, mature mRNA, and thus, translated protein levels. These compositions and methods utilize antisense oligomers (ASOs) that promote constitutive splicing at an intron splice site of a retained-intron-containing pre-mRNA that accumulates in the nucleus. Thus, in embodiments, protein is increased using the methods of the invention to treat a condition caused by a protein deficiency.

Liver diseases that can be treated by the invention described herein are diseases where a subject is deficient in a gene product, where deficiency in a gene product causes the liver disease.

These AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 and NCOA5 pre-mRNA species comprise at least one retained intron. The present invention provides compositions and methods for upregulating splicing of one or more retained AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 and NCOA5 and NCOA5 introns that are rate-limiting for the nuclear stages of gene expression to increase steady-state production of fully-spliced, mature mRNA, and thus, translated aminomethyltransferase, adenosine deaminase, protoporphyrinogen oxidase, uroporphyrinogen decarboxylase, hydroxymethylbilane synthase, very long chain acyl-CoA dehydrogenase, pyruvate carboxylase isovaleryl-CoA dehydrogenase, apolipoprotein A-V, galactose-1-phosphate uridylyltransferase, low density lipoprotein receptor adaptor protein 1, hepatocyte nuclear factor 4-alpha, glucokinase, hepatic nuclear factor-1-alpha albumin proximal factor, protein O-glucosyltransferase 1, phosphatidylinositol 3-kinase regulatory subunit 1, Tribbles-1, transforming growth factor beta-1, hemochromatosis type 2B, thrombopoietin, patatin-like phospholipase domain-containing protein 3, copper-transporting ATPase 2, fumarylacetoacetase, argininosuccinate lyase, hereditary hemochromatosis protein, alstrom syndrome protein 1, 3 beta-hydroxysteroid dehydrogenase type 7, peroxisome proliferator activated receptor delta, interleukin 6, ceramide synthase 2 or nuclear receptor coactivator 5 protein levels. These compositions and methods can utilize antisense oligomers (ASOs) that promote constitutive splicing at intron splice sites of a retained-intron-containing AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 and NCOA5 pre-mRNA (RIC pre-mRNA) that accumulates in the nucleus. Thus, in embodiments, aminomethyltransferase, adenosine deaminase, protoporphyrinogen oxidase, uroporphyrinogen decarboxylase, hydroxymethylbilane synthase, very long chain acyl-CoA dehydrogenase, pyruvate carboxylase isovaleryl-CoA dehydrogenase, apolipoprotein A-V, galactose-1-phosphate uridylyltransferase, low density lipoprotein receptor adaptor protein 1, hepatocyte nuclear factor 4-alpha, glucokinase, hepatic nuclear factor-1-alpha albumin proximal factor, protein O-glucosyltransferase 1, phosphatidylinositol 3-kinase regulatory subunit 1, Tribbles-1, transforming growth factor beta-1, hemochromatosis type 2B, thrombopoietin, patatin-like phospholipase domain-containing protein 3, copper-transporting ATPase 2, fumarylacetoacetase, argininosuccinate lyase, hereditary hemochromatosis protein, alstrom syndrome protein 1, 3 beta-hydroxysteroid dehydrogenase type 7, peroxisome proliferator activated receptor delta, interleukin 6, ceramide synthase 2 or nuclear receptor coactivator 5 protein can be increased using the methods of the invention to treat a condition caused by aminomethyltransferase, adenosine deaminase, protoporphyrinogen oxidase, uroporphyrinogen decarboxylase, hydroxymethylbilane synthase, very long chain acyl-CoA dehydrogenase, pyruvate carboxylase isovaleryl-CoA dehydrogenase, apolipoprotein A-V, galactose-1-phosphate uridylyltransferase, low density lipoprotein receptor adaptor protein 1, hepatocyte nuclear factor 4-alpha, glucokinase, hepatic nuclear factor-1-alpha albumin proximal factor, protein O-glucosyltransferase 1, phosphatidylinositol 3-kinase regulatory subunit 1, Tribbles-1, transforming growth factor beta-1, hemochromatosis type 2B, thrombopoietin, patatin-like phospholipase domain-containing protein 3, copper-transporting ATPase 2, fumarylacetoacetase, argininosuccinate lyase, hereditary hemochromatosis protein, alstrom syndrome protein 1, 3 beta-hydroxysteroid dehydrogenase type 7, peroxisome proliferator activated receptor delta, interleukin 6, ceramide synthase 2 or nuclear receptor coactivator 5 deficiency.

In some embodiments, disclosed herein are compositions and methods for upregulating splicing of one or more retained AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 introns that are rate-limiting for the nuclear stages of gene expression to increase steady-state production of fully-spliced, mature mRNA, and thus, translated AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 protein levels. These compositions and methods can utilize antisense oligomers (ASOs) that promote constitutive splicing at intron splice sites of a retained-intron-containing AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 pre-mRNA (RIC pre-mRNA)

that accumulates in the nucleus. Thus, in embodiments, AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 protein can be increased using the methods of the invention to treat a condition caused by AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 deficiency.

In other embodiments, the methods of the invention can be used to increase aminomethyltransferase, adenosine deaminase, protoporphyrinogen oxidase, uroporphyrinogen decarboxylase, hydroxymethylbilane synthase, very long chain acyl-CoA dehydrogenase, pyruvate carboxylase isovaleryl-CoA dehydrogenase, apolipoprotein A-V, galactose-1-phosphate uridylyltransferase, low density lipoprotein receptor adaptor protein 1, hepatocyte nuclear factor 4-alpha, glucokinase, hepatic nuclear factor-1-alpha albumin proximal factor, protein O-glucosyltransferase 1, phosphatidylinositol 3-kinase regulatory subunit 1, Tribbles-1, transforming growth factor beta-1, hemochromatosis type 2B, thrombopoietin, patatin-like phospholipase domain-containing protein 3, copper-transporting ATPase 2, fumarylacetoacetase, argininosuccinate lyase, hereditary hemochromatosis protein, alstrom syndrome protein 1, 3 beta-hydroxysteroid dehydrogenase type 7, peroxisome proliferator activated receptor delta, interleukin 6, ceramide synthase 2 or nuclear receptor coactivator 5 production to treat a condition in a subject in need thereof. In embodiments, the subject has a condition in which aminomethyltransferase, adenosine deaminase, protoporphyrinogen oxidase, uroporphyrinogen decarboxylase, hydroxymethylbilane synthase, very long chain acyl-CoA dehydrogenase, pyruvate carboxylase isovaleryl-CoA dehydrogenase, apolipoprotein A-V, galactose-1-phosphate uridylyltransferase, low density lipoprotein receptor adaptor protein 1, hepatocyte nuclear factor 4-alpha, glucokinase, hepatic nuclear factor-1-alpha albumin proximal factor, protein O-glucosyltransferase 1, phosphatidylinositol 3-kinase regulatory subunit 1, Tribbles-1, transforming growth factor beta-1, hemochromatosis type 2B, thrombopoietin, patatin-like phospholipase domain-containing protein 3, copper-transporting ATPase 2, fumarylacetoacetase, argininosuccinate lyase, hereditary hemochromatosis protein, alstrom syndrome protein 1, 3 beta-hydroxysteroid dehydrogenase type 7, peroxisome proliferator activated receptor delta, interleukin 6, ceramide synthase 2 or nuclear receptor coactivator 5 is not necessarily deficient relative to wild-type, but where an increase in aminomethyltransferase, adenosine deaminase, protoporphyrinogen oxidase, uroporphyrinogen decarboxylase, hydroxymethylbilane synthase, very long chain acyl-CoA dehydrogenase, pyruvate carboxylase isovaleryl-CoA dehydrogenase, apolipoprotein A-V, galactose-1-phosphate uridylyltransferase, low density lipoprotein receptor adaptor protein 1, hepatocyte nuclear factor 4-alpha, glucokinase, hepatic nuclear factor-1-alpha albumin proximal factor, protein O-glucosyltransferase 1, phosphatidylinositol 3-kinase regulatory subunit 1, Tribbles-1, transforming growth factor beta-1, hemochromatosis type 2B, thrombopoietin, patatin-like phospholipase domain-containing protein 3, copper-transporting ATPase 2, fumarylacetoacetase, argininosuccinate lyase, hereditary hemochromatosis protein, alstrom syndrome protein 1, 3 beta-hydroxysteroid dehydrogenase type 7, peroxisome proliferator activated receptor delta, interleukin 6, ceramide synthase 2 or nuclear receptor coactivator 5 mitigates the condition nonetheless. In embodiments, the condition can be caused by a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 and NCOA5 haploinsufficiency.

In embodiments, the described compositions and methods are used to treat a subject or patient having a liver condition that is caused by a deficiency in the target protein. In embodiments the described compositions and methods are used to treat a subject or patient having a liver condition that is not caused by a deficiency in the target protein. In embodiments, the subject or patient having a liver condition can benefit from increased production of the target protein by supplementing normal production of the target protein. In related embodiments, the subject or patient having a liver condition can benefit from increased production of the target protein by increasing mature mRNA production and/or supplementing normal production of the target protein. In certain embodiments, wherein the condition that is not necessarily caused by a deficiency of the target protein but is nonetheless treated by increasing production of the target protein using the present methods, the target protein is TRIB1, TGFB1, HAMP, THPO, PNPLA3, PPARD, IL6, CERS2, or NCOA5. In embodiments, the target protein acts on a secondary target to ameliorate or treat the liver condition in the subject. In embodiments, the secondary target protein is deficient in the subject. In embodiments, the secondary target protein is not deficient in the subject.

Glycine Encephalopathy

In some embodiments, the invention described herein can be used to treat the autosomal recessive liver disorder Glycine Encephalopathy (GCE). The predominant phenotype of GCE is the neonatal phenotype, which manifests early in life. Symptoms of this phenotype include lethargy, hypotonia, myoclonic jerks, seizures, mental retardation, apnea and often death. In other instances, GCE manifests in childhood, with symptoms including mild mental retardation, delirium, chorea, and vertical gaze palsy. The late onset form of GCE results in spastic diplegia and optic atrophy, but typically does not result in mental retardation or seizures.

GCE can manifest as a result of deficiency in the glycine cleavage system in the liver. Deficiency in the protein aminomethyltransferase (AMT) has been implicated in the progression of GCE and studies have linked AMT deficiency and the progression of GCE. AMT is a component of the glycine cleavage system in the mitochondria of liver cells. The AMT gene, which codes for the AMT protein, is a 6 kb gene spanning 9 exons located on 3p21.2. Mutations in the AMT gene have been shown to cause the clinical phenotype associated with GCE. In one study, a patient heterozygous for a G269D mutation. Other studies have examined other missense mutations in AMT that result in the progression of GCE, thereby establishing a positive link between AMT deficiency and the progression of GCE.

Zellweger Syndrome/Heimler Syndrome

In some embodiments, the invention described herein can be used to treat the autosomal recessive liver disorder Zellweger Syndrome. Zellweger Syndrome is a severe peroxisomal biogenesis disorder characterized by severe neurologic dysfunction, craniofacial abnormalities, and liver dysfunction. Patients afflicted with the classic Zellweger Syndrome phenotype typically die within the first year of life.

In some embodiments, the invention described herein can be used to treat the autosomal recessive liver disorder Heimler syndrome. Heimler syndrome is the mildest form the peroxisomal biogenesis disorders characterized by sensorineural hearing loss, enamel hypoplasia of the secondary dentition and nail abnormalities.

Adenosine Deaminase Deficiency

In some embodiments, the invention described herein can be used to treat the autosomal recessive liver disease Adenosine Deaminase (ADA) deficiency. ADA deficiency generally manifests in infancy, and is generally fatal, though a small subset of patients display a late onset form of the disease that is generally milder than the infantile form. Patients afflicted with the late onset form of ADA deficiency typically show gradual immunologic deterioration, which leads to a number of secondary infections.

Deficiency in the ADA protein results in the clinical manifestations shown in ADA deficiency. The ADA gene, which is located at 20q13 and spans 10 exons, codes for the ADA protein. Mutations in the ADA gene resulting in deficient amounts of ADA protein have been shown to be responsible for the progression of ADA deficiency. In one study, a pair of children diagnosed with ADA deficiency were examined. Both children were found to have diminished levels of ADA protein, while both of the parents were found to have intermediate levels of the ADA protein. This finding supported the recessive pattern of inheritance proposed for the disease, and provides a positive link between diminished ADA protein and the clinical manifestations of ADA deficiency.

Porphyria Variegata

In some embodiments, the invention described herein can be used to treat the liver disease porphyria variegate (VP). VP is characterized by cutaneous manifestations, such as increased photosensitivity, blistering, skin fragility, and postinflammatory hyperpigmentation. Additional manifestations include abdominal pain, dark urine, and neuropsychiatric symptoms that characterize the acute hepatic porphyrias.

Deficiency in the protoporphyrinogen oxidase (PPDX) protein results in the clinical manifestations shown in VP. The PPDX gene, which is located at 1q23.3 and spans 13 exons, codes for the PPDX protein. Mutations in the PPDX gene resulting in deficient amounts of PPDX protein have been shown to be responsible for the progression of VP. While there exists a rare homozygous form of VP, "classical" VP is characterized by mutations in a single allele of the PPDX gene, thus proceeding via a haploinsufficiency mechanism. Several studies have linked heterozygous mutations in PPDX with the progression of VP, which is a result of diminished levels of PPDX protein found in patients afflicted with VP.

Porphyria Cutanea Tarda

In some embodiments, the invention described herein can be used to treat the autosomal dominant liver disease porphyria cutanea tarda (PCT). PCT is characterized by light sensitive dermatitis and excretion of uroporphyrin in urine.

Deficiency in the uroporphyrinogen decarboxylase (UROD) protein results in the clinical manifestations shown in PCT. The UROD gene, which is located at 1p34.1 and spans 10 exons, codes for the UROD protein. Mutations in the UROD gene resulting in deficient amounts of UROD protein have been shown to be responsible for the progression of PCT. In one study, a G381V mutation in the UROD gene was shown in a patient with the familial version of PCT, which resulted in diminished levels of the UROD protein. Other studies have also shown correlation between diminished UROD protein levels and the progression of PCT.

Acute Intermittent Porphyria

In some embodiments, the invention described herein can be used to treat the autosomal dominant liver disease acute intermittent porphyria (AIP). AIP is characterized by defects in the biosynthesis of heme. Clinical manifestations of AIP include abdominal pain, gastrointestinal dysfunction, and neurologic disturbance that may lead to death.

Deficiency in the hydroxymethylbilane synthase (HMBS) protein (nonerythroid, or both erythroid and nonerythroid) results in the clinical manifestations shown in AIP. The HMBS gene, which is located at 11q23.3 and spans 15 exons, codes for the HMBS protein. HMBS also is referred to as porphobilinogen deaminase (PBGD). Mutations in the HMBS gene resulting in deficient amounts of HMBS protein have been shown to be responsible for the progression of AIP. In one study, 19 separate mutations in HMBS were found in 28 families displaying AIP, further providing a link between HMBS deficiency and AIP.

Very Long Chain Acyl-CoA Dehydrogenase Deficiency

In some embodiments, the invention described herein can be used to treat the autosomal recessive liver disease, very long chain acyl-CoA dehydrogenase (VLCAD) deficiency. VLCAD is characterized by nonketotic hypoglycemia, cardiorespiratory arrest, hepatomegaly, cardiomegaly, and hypotonia, which are believed to be manifestations resulting from a defect in mitochondrial fatty acid oxidation.

Deficiency in the VLCAD protein results in the clinical manifestations shown in VLCAD deficiency. The ACADVL gene, which is located at 17p13.1 and spans 20 exons, codes for the VLCAD protein. Mutations in the ACADVL gene resulting in deficient amounts of VLCAD protein have been shown to be responsible for the progression of VLCAD deficiency. In one study, 2 patients displaying VLCAD deficiency were found to have a 105 bp deletion in the ACADVL gene. In another study, 21 different missense mutations were found in 18 children displaying VLCAD deficiency. In aggregate, studies such as these have shown a positive link between deficiency in VLCAD and the clinical manifestations seen in patients displaying VLCAD deficiency.

Pyruvate Carboxylase Deficiency

In some embodiments, the invention described herein can be used to treat the autosomal recessive liver disease pyruvate carboxylase (PC) deficiency. PC deficiency is categorized into 3 phenotypic subtypes. Patients with type A, which is more prevalent in North America, display lactic academia and psychomotor retardation. Patients with type B, which is more severe than type A and is more prevalent in France and the United Kingdom, display increased serum lactate, ammonia, citrulline and lysine, and intracellular redox disturbance with a higher incidence of mortality. Type C is the more milder form of PC deficiency and is generally benign.

Deficiency in the pyruvate carboxylase (PC) protein results in the clinical manifestations shown in PC deficiency. The PC gene, which is located at 11q13.2 and spans 19 exons, codes for the PC protein. The familial inheritance is believed to proceed via an autosomal recessive mechanism, and the carrier frequency is estimated to be as high as 1 in 10 in certain families. Mutations in the PC gene resulting in deficient amounts of PC protein have been shown to be responsible for the progression of PC deficiency. In one study, missense mutations in the PC gene in patients suffering from type A PC deficiency were discovered, thereby providing a link between a deficiency in PC protein levels and the clinical manifestations associated with PC deficiency.

Isovaleric Acidemia

In some embodiments, the invention described herein can be used to treat the autosomal recessive liver disease isovaleric academia (IVA). IVA is categorized into 2 phenotypic subtypes: an acute and chronic subtype. The acute subtype leads to massive metabolic acidosis and ultimately death. The chronic subtype results in periods of attacks of severe ketoacidosis followed by asymptomatic periods. Clinical manifestations of IVA include peculiar odor, an aversion to dietary protein and vomiting.

Deficiency in the isovaleryl-CoA dehydrogenase (IVD) protein results in the clinical manifestations shown in IVA. The IVD gene, which is located at 15q13 and spans 12 exons, codes for the IVD protein. Mutations in the IVD gene resulting in deficient amounts of IVD protein have been shown to be responsible for the progression of IVA deficiency. Several studies have looked at a number of different mutations in IVD that result in IVD deficiency, and have shown that mutations that result in deficiency in the amount of IVD protein result in the clinical manifestations seen in IVA.

Hyperchylomicronemia/Hypertriglyceridemia

In some embodiments, the invention described herein can be used to treat the autosomal dominant liver disease hyperchylomicronemia. Hyperchylomicronemia is characterized by increased amounts of chylomicrons and very low density lipoprotein (VLDL) and decreased LDL and high density lipoprotein (HDL) in the plasma.

In some embodiments, the invention described herein can be used to treat the autosomal dominant liver disease hypertriglyceridemia. Patients afflicted with hypertriglyceridemia generally have normal levels of cholesterol while displaying elevated levels of triglycerides. Other than elevated triglycerides, patients are generally asymptomatic.

Deficiency in apolipoprotein A-V (APOA5) protein results in the clinical manifestations shown in both hyperchylomicronemia and hypertriglyceridemia. The APOA5 gene, which is located at 11q23.3 and spans 4 exons, codes for the APOA5 protein. Mutations in the APOA5 gene resulting in deficient amounts of APOA5 protein have been shown to be responsible for the progression of both hyperchylomicronemia and hypertriglyceridemia. Several studies have looked at a number of different mutations in APOA5 that result in both hyperchylomicronemia and hypertriglyceridemia. For example in one study, a S19W mutation in APOA5 was shown to result in a deficiency in the amount of APOA5 protein, which manifested as hyperchylomicronemia in a family of patients.

Galactosemia

In some embodiments, the invention described herein can be used to treat the autosomal recessive liver disease galactosemia. Galactosemia generally manifests during neonatal development, and is characterized by jaundice, hepatosplenomegaly, hepatocellular insufficiency, food intolerance, hypoglycemia, renal tubular dysfunction, muscle hypotonia, sepsis, and cataracts. Overtime, patients afflicted with galactosemia experience mental retardation, verbal dyspraxia, motor abnormalities, and hypergonadotropic hypogonadism.

Deficiency in the galactose-1-phosphate uridylyltransferase (GALT) protein results in the clinical manifestations shown in galactosemia. The GALT gene, which is located at 15q11.2 and spans 11 exons, codes for the GALT protein. Mutations in the GALT gene resulting in deficient amounts of GALT protein have been shown to be responsible for the progression of galactosemia. Several studies have looked at a number of different mutations in GALT that result in galactosemia, and have shown that mutations that result in deficiency in the amount of GALT protein result in the clinical manifestations seen in galactosemia. In one study, a M142K mutation was found to decrease the amount of GALT protein to approximately 4% of the normal level, which provides a positive link between deficiency in the amount of GALT protein and the clinical progression of galactosemia.

Hypercholesterolemia

In some embodiments, the invention described herein can be used to treat the autosomal recessive liver disease hypercholesterolemia (ARH). ARH is characterized by severely elevated plasma low density lipoprotein (LDL) cholesterol, tuberous and tendon xanthomata and premature atherosclerosis.

Deficiency in the protein low density lipoprotein receptor adaptor protein 1 (LDLRAP1) results in the clinical manifestations shown in ARH. The LDLRAP1 gene, which is located at 1p36.11 and spans 9 exons, codes for the LDL-RAP1 protein. Mutations in the LDLRAP1 gene resulting in deficient amounts of LDLRAP1 protein have been shown to be responsible for the progression of ARH. Several studies have looked at a number of different mutations in LDLRAP1 that result in ARH, and have shown that mutations that result in deficiency in the amount of LDLRAP1 protein result in the clinical manifestations seen in ARH. A number of studies examined a conserved nonsense mutation in the LDLRAP1 gene, which resulted in substantial decrease in the amount of LDLRAP1 protein, and hence the clinical manifestations associated with ARH.

Diabetes Mellitus

In some embodiments, the invention described herein can be used to treat maturity-onset diabetes of the young type 1 (MODY1). In other embodiments, the invention described herein can be used to treat maturity-onset diabetes of the young type 2 (MODY2). In other embodiments, the invention described herein can be used to treat maturity-onset diabetes of the young type 3 (MODY3). In other embodiments, the invention described herein can be used to treat noninsulin-dependent diabetes mellitus (NIDDM). In other embodiments, the invention described herein can be used to treat insulin-dependent diabetes mellitus 1 (IDDM1). In other embodiments, the invention described herein can be used to treat insulin-dependent diabetes mellitus 20 (IDDM20). In other embodiments, the invention described herein can be used to treat Falconi renotubular syndrome 4 with maturity-onset diabetes of the young (FRTS4). In other embodiments, the invention described herein can be used to treat hyperinsulemic hypoglycemia familial 3 (HHF3). In other embodiments, the invention described herein can be used to treat permanent neonatal diabetes mellitus (PNDM). Diabetes mellitus are a group of metabolic diseases characterized by high blood sugar, with symptoms including frequent urination, increased thirst, increased hunger, diabetic ketoacidosis, cardiovascular disease, stroke, chronic kidney failure, foot ulcers and damage to the eyes.

While there are a number of factors that can contribute to the progression of diabetes, deficiency in the protein hepatocyte nuclear factor 4-alpha (HNF4A) has been shown to correlate to the incidence of MODY1, NIDDM and FRTS4. The HNF4A gene, which is located at 20q13.12 and spans 12 exons, codes for the HNF4A protein. Mutations in the HNF4A gene resulting in deficient amounts of HNF4A protein have been shown to be responsible for the progression of MODY1, NIDDM and FRTS4. Several studies have looked at a number of different mutations in HNF4A that result in MODY1, NIDDM and FRTS4 and have shown that mutations that result in deficiency in the amount of HNF4A protein result in the clinical manifestations seen in diabetes. For example, one study demonstrated that a nonsense mutation at Q268 was present in a large population of patients afflicted with MODY1. In another study, the authors concluded that mutations in HNF4A is associated with increased birth weight and macrosomia, which eventually evolves into the hyperinsulinemia seen in patients afflicted with diabetes. Studies such this and others have positively correlated the deficiency in the amount of expressed HNF4A protein with the progression of diabetes.

Deficiency in the protein glucokinase (GCK) has been shown to correlate to the incidence of NIDDM, MODY2, HHF3 and PNDM. The GCK gene, which is located at 7p13 and spans 12 exons, codes for the GCK protein. Mutations in the GCK gene resulting in deficient amounts of GCK protein have been shown to be responsible for the progression of NIDDM, MODY2, HHF3 and PNDM. Several studies have looked at a number of different mutations in GCK that result in NIDDM, MODY2, HHF3 and PNDM and have positively correlated the deficiency in the amount of expressed GCK protein with the progression of diabetes.

Deficiency in the protein hepatic nuclear factor-1-alpha albumin proximal factor (HNF1A) has been shown to correlate to the incidence of MODY3, IDDM20, IDDM1 and NIDDM. The HNF1A gene, which is located at 12q24.31 and spans 10 exons, codes for the HNF1A protein. Mutations in the HNF1A gene resulting in deficient amounts of HNF1A protein have been shown to be responsible for the progression of MODY3, IDDM20, IDDM1 and NIDDM. Several studies have looked at a number of different mutations in HNF1A that result in MODY3, IDDM20, IDDM1 and NIDDM, and have positively correlated the deficiency in the amount of expressed HNF1A protein with the progression of diabetes.

Deficiency in the protein nuclear receptor coactivator 5 (NCOA5) has been shown to correlate to the incidence of type II diabetes, glucose intolerance and ultimately liver cancer. The NCOA5 gene, which is located at 20q13.12 and spans 8 exons, codes for the NCOA5 protein. Mutations in the NCOA5 gene resulting in deficient amounts of NCOA5 protein have been shown to be responsible for the progression of diabetes. Several studies have looked at a number of different mutations in NCOA5 that result in diabetes, and have positively correlated the deficiency in the amount of expressed NCOA5 protein with the progression of diabetes.

Hepatic Adenoma

In some embodiments, the invention described herein can be used to treat the autosomal dominant liver disease hepatic adenoma. Hepatic adenoma is an uncommon benign liver tumor with a very low risk of malignant transformation. Patients afflicted with hepatic adenoma are generally asymptomatic unless the tumor begins to hemorrhage, which could lead to hypotension, tachycardia and diaphoresis.

Deficiency in the HNF1A protein can result in the progression of hepatic adenoma. Mutations in the HNF1A gene resulting in deficient amounts of HNF1A protein have been shown to be responsible for the progression of hepatic adenoma.

Dowling-Degos Disease 4

In some embodiments, the invention described herein can be used to treat the autosomal dominant liver disease Dowling-Degos disease 4 (DDD4). DDD4 is characterized by retricular pigmentation that presents in adult life, particularly in the folds of the skin. While the manifestations affect somatic cells, the pigmentation results from dysfunction of the liver.

Deficiency in the protein O-glucosyltransferase 1 (POGLUT1) results in the clinical manifestations shown in DDD4. The POGLUT1 gene, which is located at 3q13.33 and spans 11 exons, codes for the POGLUT1 protein. Mutations in the POGLUT1 gene resulting in deficient amounts of POGLUT1 protein have been shown to be responsible for the progression of DDD4. Several studies have looked at a number of different mutations in POGLUT1 that result in DDD4, and have shown that mutations that result in deficiency in the amount of POGLUT1 protein result in the clinical manifestations seen in DDD4.

SHORT Syndrome/Immunodeficiency 36/Agammaglobulinemia 7

In some embodiments, the invention described herein can be used to treat SHORT syndrome. SHORT syndrome is an acronym for the clinical conditions that are associated with the condition, including short stature, hyperextensibility of joints and/or inguinal hernia, ocular depression, rieger anomaly and teething delay. Other symptoms characteristic of SHORT syndrome include a triangular face, small chin with a dimple, loss of fat under the skin, abnormal position of the ears, hearing loss and delayed speech.

In some embodiments, the invention described herein can be used to treat the autosomal dominant disease immunodeficiency 36 (IMD36). IMD36 is characterized by impaired B-cell function, hypogammaglobulinemia and recurrent infections.

In some embodiments, the invention described herein can be used to treat the autosomal recessive disease agammaglobulinemia 7 (AGM7). AGM7 is characterized by impaired B-cell function, hypogammaglobulinemia and recurrent infections. AGM7 is an immunodeficiency disease characterized by low serum antibodies and low circulating B cells, which results in recurrent infections.

Deficiency in the protein phosphatidylinositol 3-kinase regulatory subunit 1 (PIK3R1) results in the clinical manifestations shown in SHORT syndrome, IMD36 and AGM7. The PIK3R1 gene, which is located at 5q13.1 and spans 16 exons, codes for the PIK3R1 protein. Mutations in the PIK3R1 gene resulting in deficient amounts of PIK3R1 protein have been shown to be responsible for the progression of SHORT syndrome, IMD36 and AGM7. Several studies have looked at a number of different mutations in PIK3R1 that result in SHORT syndrome, IMD36 and AGM7. In one study, a R649W mutation in PIK3R1 was found a population of unrelated individuals diagnosed with SHORT syndrome. The same mutation was witnessed in an affected mother and her two sons, which provided evidence of the autosomal dominant pattern of inheritance of SHORT syndrome.

Lipid Metabolism Dysfunction

In some embodiments, the invention described herein can be used to treat the lipid metabolism deficiency caused by deficiency in the protein Tribbles-1 (TRIB1). Deficiency in the amount of TRIB1 protein, which is encoded by the TRIB1 gene located on 8q24.13 and spans 3 exons, has been shown to be correlated to an increased risk of atherosclerosis. Mice lacking TRIB1 were shown to have diminished adipose tissue mass accompanied by increased lipolysis, which positively linked diminished levels of TRIB1 with dysfunction in lipid metabolism.

In some embodiments, the invention described herein can be used to treat the lipid metabolism deficiency caused by deficiency in the protein peroxisome proliferator activated receptor delta (PPARD). Deficiency in the amount of PPARD protein, which is encoded by the PPARD gene located on chromosome 6 and spans 8 exons, has been shown to be correlated to increased lipid metabolism dysfunction.

Liver Inflammation

In some embodiments, the invention described herein can be used to treat the liver inflammation caused by deficiency in the protein transforming growth factor beta-1 (TGFB1). Deficiency in the amount of TGBF1 protein, which is encoded by the TGBF1 gene located on 19813.2 and spans 7 exons, has been shown to be correlated to an increased risk of atherosclerosis. Knockout mice displaying the TGBF1 (−/−) genotype were shown to develop severe liver inflammation due to CD4(+) T-cell mediated inflammation. Such studies provide a positive correlation between deficiency in the amount of TGBF1 protein and increased incidence of liver inflammation.

In some embodiments, the invention described herein can be used to treat the lipid inflammation caused by deficiency in the protein interleukin 6 (IL6). Deficiency in the amount of IL6 protein, which is encoded by the IL6 gene located on 7p15.3 and spans 5 exons, has been shown to be correlated to lipid inflammation.

In some embodiments, the invention described herein can be used to treat the lipid inflammation or steatohepatitis caused by deficiency in the ceramide synthase 2 (CERS2) protein. Deficiency in the amount of CERS2 protein, which is encoded by the CERS2 gene located on 1q21.3 and spans 11 exons, has been shown to be correlated to steatohepatitis and insulin resistance.

Hemochromatosis Type 2B

In some embodiments, the invention described herein can be used to treat the autosomal recessive liver disease hemochromatosis type 2B (HFE2B). HFE2B (otherwise known as iron overload) is characterized by joint pain, fatigue and weakness, which ultimately results in organ damage.

Deficiency in the protein hepcidin antimicrobial peptide (HAMP) results in the clinical manifestations shown in HFE2B. The HAMP gene, which is located at 19q13.12 and spans 3 exons, codes for the HAMP protein. Mutations in the HAMP gene resulting in deficient amounts of HAMP protein have been shown to be responsible for the progression of HFE2B. Nonsense mutations have been reported at G93 and R56 in patients afflicted with HFE2B, while missense mutations such as G71D have also been found. These mutations, which result in diminished amounts of the HAMP protein, were proposed to be a direct cause of HFE2B, thereby providing a direct correlation between diminished levels of HAMP and incidence of HFE2B.

Thrombocytopenia

In some embodiments, the invention described herein can be used to treat the autosomal dominant disease thrombocytopenia. Thrombocytopenia is characterized by a decrease in the amount of thrombocytes in the blood. While many cases of thrombocytopenia are asymptomatic, some patients experience external bleeding such as nose bleeds, malaise, fatigue and general weakness.

Deficiency in the protein thrombopoietin (THPO) has been shown to be correlated to the incidence of thrombocytopenia. The THPO gene, which is located at 3q27.1 and spans 6 exons, codes for the THPO protein. Mutations in the THPO gene resulting in deficient amounts of THPO protein have been shown to be responsible for the progression of thrombocytopenia. In one study, a single nucleotide deletion at 3252 was seen in 3 generations of a family afflicted with thrombocytopenia. This study correlated the deficiency of THPO protein levels as a result of the deletion with the incidence of thrombocytopenia.

Non-Alcoholic Fatty Liver Disease

In some embodiments, the invention described herein can be used to treat non-alcoholic fatty liver disease (NAFLD). NAFLD is characterized by the accumulation of excess triglycerides in the liver, which can be associated with adverse metabolic consequences such as insulin resistance and dyslipidemia. Factors that can influence the progression of NAFLD include obesity, diabetes, and insulin resistance. In some instances, aggregated fatty deposits in a liver can promote an inflammatory response, which can progress to cirrhosis or liver cancer.

Deficiency in the protein patatin-like phospholipase domain-containing protein 3 (PNPLA3) has been shown to be correlated to the incidence of NAFLD. The PNPLA3 gene, which is located at 22q13 and spans 9 exons, codes for the PNPLA3 protein. Mutations in the PNPLA3 gene resulting in deficient amounts of PNPLA3 protein have been shown to be responsible for the progression of NAFLD. Polymorphisms such as C99G, G115C, I148M, T216P and K434E have been found in populations manifesting symptoms of NAFLD. These missense mutations were shown to result in decreased levels of PNPLA3, which provides a correlation between the deficiency of the PNPLA3 protein and the progression of NAFLD.

Wilson Disease

In some embodiments, the invention described herein can be used to treat the autosomal recessive disorder Wilson disease. Wilson disease is characterized by dramatic build-up of intracellular hepatic copper with subsequent hepatic and neurologic abnormalities. Wilson disease may present itself in a patient with tiredness, increased bleeding tendency or confusion (due to hepatic encephalopathy) and portal hypertension.

Deficiency in the protein copper-transporting ATPase 2 (ATP7B) has been shown to be correlated to the incidence of Wilson disease. The ATP7B gene, which is located at 13q14.3 and spans 21 exons, codes for the ATP7B protein. Mutations in the ATP7B gene resulting in deficient amounts of ATP7B protein have been shown to be responsible for the progression of Wilson disease. Mutations in ATP7B such as L492S, Y532H, G591D, R616Q and G626A have been found in populations manifesting symptoms of Wilson disease. These missense mutations were shown to result in decreased levels of ATP7B, which provides a correlation between the deficiency of the ATP7B protein and the progression of Wilson disease.

Tyrosinemia

In some embodiments, the invention described herein can be used to treat tyrosinemia. Tyrosinemia is characterized by progressive liver disease and a secondary renal tubular dysfunction leading to hypophosphatemic rickets. Onset varies from infancy to adolescence. In the most acute form patients present with severe liver failure within weeks after birth, whereas rickets may be the major symptom in chronic tyrosinemia. Untreated, patients die from cirrhosis or hepatocellular carcinoma at a young age Deficiency in the protein fumarylacetoacetase (FAH) has been shown to be correlated to the incidence of tyrosinemia. The FAH gene, which is located at 15q25.1 and spans 14 exons, codes for the FAH protein. Mutations in the FAH gene resulting in deficient amounts of FAH protein have been shown to be responsible for the progression of FAH. Polymorphisms such as N16I, A134D, C193R, D233V and Q279R have been found in populations manifesting symptoms of FAH. These missense mutations were shown to result in decreased levels of FAH, which provides a correlation between the deficiency of the tyrosinemia protein and the progression of FAH.

Argininosuccinate Lyase Deficiency

In some embodiments, the invention described herein can be used to treat the autosomal recessive disorder argininosuccinate lyase deficiency. Argininosuccinate lyase deficiency is characterized by mental and physical retardation, liver enlargement, skin lesions, dry and brittle hair showing trichorrhexis nodosa microscopically and fluorescing red, convulsions, and episodic unconsciousness.

Deficiency in the protein argininosuccinate lyase (ASL) has been shown to be correlated to the incidence of argininosuccinate lyase deficiency. The ASL gene, which is located at 7q11.21 and spans 17 exons, codes for the ASL protein. Mutations in the ASL gene resulting in deficient amounts of ASL protein have been shown to be responsible for the progression of argininosuccinate lyase deficiency. Polymorphisms such as R113Q, V178M, R182Q, R236W, Q286R and R456W have been found in populations manifesting symptoms of argininosuccinate lyase deficiency. These missense mutations were shown to result in decreased levels of ASL, which provides a correlation between the deficiency of the ASL protein and the progression of argininosuccinate lyase deficiency.

Hemochromatosis Type 1

In some embodiments, the invention described herein can be used to treat the autosomal recessive disorder hemochromatosis type 1. Hemochromatosis type 1 is characterized by iron overload. Excess iron is deposited in a variety of organs leading to their failure, and resulting in serious illnesses including cirrhosis, hepatomas, diabetes, cardiomyopathy, arthritis, and hypogonadotropic hypogonadism. Severe effects of the disease usually do not appear until after decades of progressive iron loading.

Deficiency in the hereditary hemochromatosis protein has been shown to be correlated to the incidence of hemochromatosis type 1. The HFE gene, which is located at 6p22.2 and spans 6 exons, codes for the hereditary hemochromatosis protein. Mutations in the ASL gene resulting in deficient amounts of hereditary hemochromatosis protein have been shown to be responsible for the progression of hemochromatosis type 1. Polymorphisms such as S65C, Q127H, A176V, C282Y, Q283P and V295A have been found in populations manifesting symptoms of hemochromatosis type 1. These missense mutations were shown to result in decreased levels of hereditary hemochromatosis protein, which provides a correlation between the deficiency of the hereditary hemochromatosis protein and the progression of hemochromatosis type 1.

Alstrom Syndrome

In some embodiments, the invention described herein can be used to treat the autosomal recessive disorder Alstrom syndrome. Alstrom syndrome is characterized by progressive cone-rod retinal dystrophy, neurosensory hearing loss, early childhood obesity and diabetes mellitus type 2. Dilated cardiomyopathy, acanthosis nigricans, male hypogonadism, hypothyroidism, developmental delay and hepatic dysfunction can also be associated with the syndrome.

Deficiency in the protein alstrom syndrome protein 1 has been shown to be correlated to the incidence of Alstrom syndrome. The ALMS1 gene, which is located at 2p13.1 and spans 23 exons, codes for the alstrom syndrome protein. Mutations in the ALMS1 gene resulting in deficient amounts of alstrom syndrome protein 1 have been shown to be responsible for the progression of Alstrom syndrome. Polymorphisms such as V671G, G1412A, I1875V, 52111R, D2672H and K3434E have been found in populations manifesting symptoms of Alstrom syndrome. These missense mutations were shown to result in decreased levels of alstrom syndrome protein 1, which provides a correlation between the deficiency of the alstrom syndrome protein 1 and the progression of Alstrom syndrome.

Congenital Bile Acid Synthesis Defect 1

In some embodiments, the invention described herein can be used to treat the autosomal recessive disorder congenital bile acid synthesis defect 1 (CBAS1). CBAS1 is a primary defect in bile synthesis leading to progressive liver disease. Clinical features include neonatal jaundice, severe intrahepatic cholestasis, cirrhosis.

Deficiency in the protein 3 beta-hydroxysteroid dehydrogenase type 7 (3BHS7) has been shown to be correlated to the incidence of CBAS1. The HSD3B7 gene, which is located at 16p11.2 and spans 6 exons, codes for the 3BHS7 protein. Mutations in the HSD3B7 gene resulting in deficient amounts of 3BHS7 protein have been shown to be responsible for the progression of CBAS1. Polymorphisms such as G19S, E147K, T250A and L347P have been found in populations manifesting symptoms of CBAS1. These missense mutations were shown to result in decreased levels of 3BHS7, which provides a correlation between the deficiency of the 3BHS7 protein and the progression of CBAS1.

Retained Intron Containing Pre-mRNA (RIC Pre-mRNA)

In embodiments, the methods of the present invention can exploit the presence of retained-intron-containing pre-mRNA (RIC pre-mRNA) transcribed from the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 gene and encoding aminomethyltransferase, adenosine deaminase, protoporphyrinogen oxidase, uroporphyrinogen decarboxylase, hydroxymethylbilane synthase, very long chain acyl-CoA dehydrogenase, pyruvate carboxylase isovaleryl-CoA dehydrogenase, apolipoprotein A-V, galactose-1-phosphate uridylyltransferase, low density lipoprotein receptor adaptor protein 1, hepatocyte nuclear factor 4-alpha, glucokinase, hepatic nuclear factor-1-alpha albumin proximal factor, protein O-glucosyltransferase 1, phosphatidylinositol 3-kinase regulatory subunit 1, Tribbles-1, transforming growth factor beta-1, hemochromatosis type 2B, thrombopoietin, patatin-like phospholipase domain-containing protein 3, copper-transporting ATPase 2, fumarylacetoacetase, argininosuccinate lyase, hereditary hemochromatosis protein, alstrom syndrome protein 1, 3 beta-hydroxysteroid dehydrogenase type 7, peroxisome proliferator activated receptor delta, interleukin 6, ceramide synthase 2 or nuclear receptor coactivator 5 protein, in the cell nucleus. Splicing of AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA species to produce mature, fully-spliced, AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 mRNA, can be induced using ASOs that stimulate splicing out of the retained introns. The resulting mature AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 mRNA can be exported to the cytoplasm and translated, thereby increasing the amount of aminomethyltransferase, adenosine deaminase, protoporphyrinogen oxidase, uroporphyrinogen decarboxylase, hydroxymethylbilane synthase, very long chain acyl-CoA dehydrogenase, pyruvate carboxylase isovaleryl-CoA dehydrogenase, apolipoprotein A-V, galactose-1-phosphate uridylyltransferase, low density lipoprotein receptor adaptor protein 1, hepatocyte nuclear factor 4-alpha, glucokinase, hepatic nuclear factor-1-alpha albumin proximal factor, protein O-glucosyltransferase 1, phosphatidylinositol 3-kinase regulatory subunit 1, Tribbles-1, transforming growth factor beta-1, hemochromatosis type 2B, thrombopoietin, patatin-like phospholipase domain-containing protein 3, copper-transporting ATPase 2, fumarylacetoacetase, argininosuccinate lyase, hereditary hemochromatosis protein, alstrom syndrome protein 1, 3 beta-hydroxysteroid dehydrogenase type 7, peroxisome proliferator activated receptor delta, interleukin 6, ceramide synthase 2 or nuclear receptor coactivator 5 protein in the patient's cells and alleviating symptoms of the CNS disease or conditions caused by deficiency in each protein. This method, described further below, is known as Targeted Augmentation of Nuclear Gene Output (TANGO).

AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 gene can be analyzed for intron-retention events. In some cases, AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 gene can be analyzed for intron-retention events. RNA sequencing (RNAseq), can be visualized in the UCSC genome browser, and can show AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 transcripts expressed in human liver cells and localized in either the cytoplasmic or nuclear fraction. In some embodiments, the retained-intron containing pre-mRNA transcripts are retained in the nucleus and are not exported out to the cytoplasm In embodiments, a retained intron is an intron that is identified as a retained intron based on a determination of at least about 5%, at least about 10%, at least about 15%, at least about 20%, at least about 25%, at least about 30%, at least about 35%, at least about 40%, at least about 45%, or at least about 50%, retention. In embodiments, a retained intron is an intron that is identified as a retained intron based on a determination of about 5% to about 100%, about 5% to about 95%, about 5% to about 90%, about 5% to about 85%, about 5% to about 80%, about 5% to about 75%, about 5% to about 70%, about 5% to about 65%, about 5% to about 60%, about 5% to about 65%, about 5% to about 60%, about 5% to about 55%, about 5% to about 50%, about 5% to about 45%, about 5% to about 40%, about 5% to about 35%, about 5% to about 30%, about 5% to about 25%, about 5% to about 20%, about 5% to about 15%, about 10% to about 100%, about 10% to about 95%, about 10% to about 90%, about 10% to about 85%, about 10% to about 80%, about 10% to about 75%, about 10% to about 70%, about 10% to about 65%, about 10% to about 60%, about 10% to about 65%, about 10% to about 60%, about 10% to about 55%, about 10% to about 50%, about 10% to about 45%, about 10% to about 40%, about 10% to about 35%, about 10% to about 30%, about 10% to about 25%, about 10% to about 20%, about 15% to about 100%, about 15% to about 95%, about 15% to about 90%, about 15% to about 85%, about 15% to about 80%, about 15% to about 75%, about 15% to about 70%, about 15% to about 65%, about 15% to about 60%, about 15% to about 65%, about 15% to about 60%, about 15% to about 55%, about 15% to about 50%, about 15% to about 45%, about 15% to about 40%, about 15% to about 35%, about 15% to about 30%, about 15% to about 25%, about 20% to about 100%, about 20% to about 95%, about 20% to about 90%, about 20% to about 85%, about 20% to about 80%, about 20% to about 75%, about 20% to about 70%, about 20% to about 65%, about 20% to about 60%, about 20% to about 65%, about 20% to about 60%, about 20% to about 55%, about 20% to about 50%, about 20% to about 45%, about 20% to about 40%, about 20% to about 35%, about 20% to about 30%, about 25% to about 100%, about 25% to about 95%, about 25% to about 90%, about 25% to about 85%, about 25% to about 80%, about 25% to about 75%, about 25% to about 70%, about 25% to about 65%, about 25% to about 60%, about 25% to about 65%, about 25% to about 60%, about 25% to about 55%, about 25% to about 50%, about 25% to about 45%, about 25% to about 40%, or about 25% to about 35%, retention. In embodiments, other ASOs useful for this purpose are identified, using, e.g., methods described herein.

In embodiments, the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 intron numbering corresponds to the one or more mRNA sequences at shown in Table 10 or Table 11. In embodiments, the targeted portion of the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA is in one or more introns as shown in Table 10 or Table 11. In embodiments, hybridization of an ASO to the targeted portion of the RIC pre-mRNA results in enhanced splicing at the splice site (5' splice site or 3' splice site) of one or more retained introns as shown in Table 10 or Table 11 and subsequently increases AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 protein production. It is understood that the intron numbering may change in reference to a different AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 isoform sequence. One of skill in the art can determine the corresponding intron number in any isoform based on an intron sequence provided herein or using the number provided in reference to the one or more mRNA sequence at shown in Table 10 or Table 11. One of skill in the art also can determine the sequences of flanking exons in any AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 isoform for targeting using the methods of the invention, based on an intron sequence provided herein or using the intron number provided in reference to the one or more mRNA sequence at shown in Table 10 or Table 11.

In some embodiments, the ASOs disclosed herein target a RIC pre-mRNA transcribed from a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 genomic sequence. In some embodiments, the ASOs disclosed herein target a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA sequence.

In some embodiments, the ASO targets a sequence of a RIC pre-mRNA transcript encoded by a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 genomic sequence. In some embodiments, the ASO targets a RIC pre-mRNA transcript encoded by a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 genomic sequence comprising a retained intron as shown in Table 10 or Table 11. In some embodiments, the ASO targets a RIC pre-mRNA encoded by SEQ ID NOs: 61504-61534.

In some embodiments, the ASO targets a RIC pre-mRNA transcript of SEQ ID NO: 61535-61633. In some embodiments, the ASO targets a RIC pre-mRNA transcript of SEQ ID NO: 61535-61633 comprising a retained intron as shown in Table 10 or Table 11. In some embodiments, the ASOs target SEQ ID NO: 139852-140004. In some embodiments, the ASO comprises a sequence of any one of SEQ ID NOs: 61634-139851.

In some embodiments, the ASO targets an exon sequence upstream of a retained intron as shown in Table 10 or Table 11 of a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA comprising a retained intron as shown in Table 10 or Table 11. In some embodiments, the ASO targets an exon sequence upstream (or 5') from the 5' splice site of a retained intron as shown in Table 10 or Table 11 of a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA comprising a retained intron as shown in Table 10 or Table 11. In some embodiments, the ASO targets an exon sequence about 4 to about 1000 nucleotides upstream (or 5') from the 5' splice site of a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA comprising a retained intron as shown in Table 10 or Table 11.

In some embodiments, the ASO targets an intron sequence upstream of a retained intron as shown in Table 10 or Table 11 of a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA comprising a retained intron as shown in Table 10 or Table 11. In some embodiments, the ASO targets an intron sequence downstream (or 3') from the 5' splice site of a retained intron as shown in Table 10 or Table 11 of a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA comprising a retained intron as shown in Table 10 or Table 11. In some embodiments, the ASO targets an exon sequence about 6 to about 500 nucleotides downstream (or 3') from the 5' splice site of a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA comprising a retained intron as shown in Table 10 or Table 11.

In some embodiments, the ASO targets an exon sequence downstream of a retained intron as shown in Table 10 or Table 11 of a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA comprising a retained intron as shown in Table 10 or Table 11. In some embodiments, the ASO targets an exon sequence downstream (or 3') from the 3' splice site of a retained intron as shown in Table 10 or Table 11 of a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA comprising a retained intron as shown in Table 10 or Table 11. In some embodiments, the ASO targets an exon sequence about 2 to about 1000 nucleotides downstream (or 3') from the 3' splice site of a AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA comprising a retained intron as shown in Table 10 or Table 11.

Protein Expression

In embodiments, the methods described herein are used to increase the production of a functional protein. As used herein, the term "functional" refers to the amount of activity or function of a protein that is necessary to eliminate any one or more symptoms of a treated condition. In embodiments, the methods are used to increase the production of a partially functional protein. As used herein, the term "partially functional" refers to any amount of activity or function of the protein that is less than the amount of activity or function that is necessary to eliminate or prevent any one or more symptoms of a disease or condition. In some embodiments, a partially functional protein or RNA will have at least 10%, at least 20%, at least 30%, at least 40%, at least 50%, at least 60%, at least 70%, at least 75%, at least 80%, 85%, at least 90%, or at least 95% less activity relative to the fully functional protein or RNA.

In embodiments, the method is a method of increasing the expression of the protein by cells of a subject having a RIC pre-mRNA encoding the protein, wherein the subject has a condition described herein caused by a deficient amount of activity of a protein described herein. In some embodiments, the deficient amount of the protein is caused by haploinsufficiency of the protein. In such an embodiment, the subject has a first allele encoding a functional protein, and a second allele from which the protein is not produced. In another such embodiment, the subject has a first allele encoding a functional protein, and a second allele encoding a nonfunctional protein. In another such embodiment, the subject has a first allele encoding a functional protein, and a second allele encoding a partially functional protein. In any of these embodiments, the antisense oligomer binds to a targeted portion of the RIC pre-mRNA transcribed from the first allele (encoding functional protein), thereby inducing constitutive splicing of the retained intron from the RIC pre-mRNA, and causing an increase in the level of mature mRNA encoding functional protein, and an increase in the expression of the protein in the cells of the subject.

In embodiments, the subject has a first allele encoding a functional protein, and a second allele encoding a partially functional protein, and the antisense oligomer binds to a targeted portion of the RIC pre-mRNA transcribed from the first allele or a targeted portion of the RIC pre-mRNA transcribed from the second allele (encoding partially functional protein), thereby inducing constitutive splicing of the retained intron from the RIC pre-mRNA, and causing an increase in the level of mature mRNA encoding the protein, and an increase in the expression of functional or partially functional protein in the cells of the subject.

In related embodiments, the method is a method of using an ASO to increase the expression of a protein or functional RNA. In embodiments, an ASO is used to increase the expression of a protein described herein in cells of a subject having a RIC pre-mRNA encoding the protein, wherein the subject has a deficiency in the amount or function of the protein.

In embodiments, the RIC pre-mRNA transcript that encodes the protein that is causative of the disease or condition is targeted by the ASOs described herein. In some embodiments, a RIC pre-mRNA transcript that encodes a protein that is not causative of the disease is targeted by the ASOs. For example, a disease that is the result of a mutation or deficiency of a first protein in a particular pathway may be ameliorated by targeting a RIC pre-mRNA that encodes a second protein, thereby increasing production of the second protein. In some embodiments, the function of the second protein is able to compensate for the mutation or deficiency of the first protein (which is causative of the disease or condition).

In embodiments, the subject has:
a) a first mutant allele from which
  i) the protein is produced at a reduced level compared to production from a wild-type allele,
  ii) the protein is produced in a form having reduced function compared to an equivalent wild-type protein, or
  iii) the protein or functional RNA is not produced; and
b) a second mutant allele from which
  i) the protein is produced at a reduced level compared to production from a wild-type allele,
  ii) the protein is produced in a form having reduced function compared to an equivalent wild-type protein, or
  iii) the protein is not produced, and wherein the RIC pre-mRNA is transcribed from the first allele and/or the second allele. In these embodiments, the ASO binds to a targeted portion of the RIC pre-mRNA transcribed from the first allele or the second allele, thereby inducing constitutive splicing of the retained intron from the RIC pre-mRNA, and causing an increase in the level of mRNA encoding a protein and an increase in the expression of the target protein or functional RNA in the cells of the subject. In these embodiments, the target protein or functional RNA having an increase in expression level resulting from the constitutive splicing of the retained intron from the RIC pre-mRNA is either in a form having reduced function compared to the equivalent wild-type protein (partially-functional), or having full function compared to the equivalent wild-type protein (fully-functional).

In embodiments, the level of mRNA encoding a protein described herein is increased 1.1 to 10-fold, when compared to the amount of mRNA encoding the protein that is produced in a control cell, e.g., one that is not treated with the antisense oligomer or one that is treated with an antisense oligomer that does not bind to the targeted portion of the RIC pre-mRNA.

In embodiments, the condition caused by a deficient amount or activity of a protein is not a condition caused by alternative or aberrant splicing of the retained intron to which the ASO is targeted. In embodiments, the condition caused by a deficient amount or activity of the protein is not a condition caused by alternative or aberrant splicing of any retained intron in a RIC pre-mRNA encoding the protein. In embodiments, alternative or aberrant splicing may occur in a pre-mRNA transcribed from the gene, however the compositions and methods of the invention do not prevent or correct this alternative or aberrant splicing.

In embodiments, a subject treated using the methods of the invention expresses a partially functional protein from one allele, wherein the partially functional protein is caused by a frameshift mutation, a nonsense mutation, a missense mutation, or a partial gene deletion. In embodiments, a subject treated using the methods of the invention expresses a nonfunctional protein from one allele, wherein the nonfunctional protein is caused by a frameshift mutation, a nonsense mutation, a missense mutation, a partial gene deletion, in one allele. In embodiments, a subject treated using the methods of the invention has a whole gene deletion, in one allele.

Use of TANGO for Increasing Protein Expression

As described above, in embodiments, Targeted Augmentation of Nuclear Gene Output (TANGO) is used in the methods of the invention to increase expression of a protein. In these embodiments, a retained-intron-containing pre-mRNA (RIC pre-mRNA) encoding a protein is present in the nucleus of a cell. Cells having a RIC pre-mRNA that comprises a retained intron, an exon flanking the 5' splice site, and an exon flanking the 3' splice site, encoding the protein, are contacted with antisense oligomers (ASOs) that are complementary to a targeted portion of the RIC pre-mRNA. Hybridization of the ASOs to the targeted portion of the RIC pre-mRNA results in enhanced splicing at the splice site (5' splice site or 3' splice site) of the retained intron and subsequently increases target protein production.

The terms "pre-mRNA," and "pre-mRNA transcript" may be used interchangeably and refer to any pre-mRNA species that contains at least one intron. In embodiments, premRNA or pre-mRNA transcripts comprise a 5'-7-methylguanosine cap and/or a poly-A tail. In embodiments, pre-mRNA or pre-mRNA transcripts comprise both a 5'-7-methylguanosine cap and a poly-A tail. In some embodiments, the pre-mRNA transcript does not comprise a 5'-7-methylguanosine cap and/or a poly-A tail. A pre-mRNA transcript is a non-productive messenger RNA (mRNA) molecule if it is not translated into a protein (or transported into the cytoplasm from the nucleus).

As used herein, a "retained-intron-containing pre-mRNA" ("RIC pre-mRNA") is a pre-mRNA transcript that contains at least one retained intron. The RIC pre-mRNA contains a retained intron, an exon flanking the 5' splice site of the retained intron, an exon flanking the 3' splice site of the retained intron, and encodes the target protein. An "RIC pre-mRNA encoding a target protein" is understood to encode the target protein when fully spliced. A "retained intron" is any intron that is present in a pre-mRNA transcript when one or more other introns, such as an adjacent intron, encoded by the same gene have been spliced out of the same pre-mRNA transcript. In some embodiments, the retained intron is the most abundant intron in RIC pre-mRNA encoding the target protein. In embodiments, the retained intron is the most abundant intron in a population of RIC pre-mRNAs transcribed from the gene encoding the target protein in a cell, wherein the population of RIC pre-mRNAs comprises two or more retained introns. In embodiments, an antisense oligomer targeted to the most abundant intron in the population of RIC pre-mRNAs encoding the target protein induces splicing out of two or more retained introns in the population, including the retained intron to which the antisense oligomer is targeted or binds. In embodiments, a mature mRNA encoding the target protein is thereby produced. The terms "mature mRNA," and "fully-spliced mRNA," are used interchangeably herein to describe a fully processed mRNA encoding a target protein (e.g., mRNA that is exported from the nucleus into the cytoplasm and translated into target protein) or a fully processed functional RNA. The term "productive mRNA," also can be used to describe a fully processed mRNA encoding a target protein. In embodiments, the targeted region is in a retained intron that is the most abundant intron in a RIC pre-mRNA encoding the protein.

As used herein, the term "comprise" or variations thereof such as "comprises" or "comprising" are to be read to indicate the inclusion of any recited feature (e.g. in the case of an antisense oligomer, a defined nucleobase sequence) but not the exclusion of any other features. Thus, as used herein, the term "comprising" is inclusive and does not exclude additional, unrecited features (e.g. in the case of an antisense oligomer, the presence of additional, unrecited nucleobases).

In embodiments of any of the compositions and methods provided herein, "comprising" may be replaced with "consisting essentially of" or "consisting of" The phrase "consisting essentially of" is used herein to require the specified feature(s) (e.g. nucleobase sequence) as well as those which do not materially affect the character or function of the claimed invention. As used herein, the term "consisting" is used to indicate the presence of the recited feature (e.g. nucleobase sequence) alone (so that in the case of an antisense oligomer consisting of a specified nucleobase sequence, the presence of additional, unrecited nucleobases is excluded).

In embodiments, the targeted region is in a retained intron that is the second most abundant intron in a RIC pre-mRNA encoding a protein described herein. For example, the second most abundant retained intron may be targeted rather than the most abundant retained intron due to the uniqueness of the nucleotide sequence of the second most abundant retained intron, ease of ASO design to target a particular nucleotide sequence, and/or amount of increase in protein production resulting from targeting the intron with an ASO. In embodiments, the retained intron is the second most abundant intron in a population of RIC pre-mRNAs transcribed from the gene encoding the target protein in a cell, wherein the population of RIC pre-mRNAs comprises two or more retained introns. In embodiments, an antisense oligomer targeted to the second most abundant intron in the population of RIC pre-mRNAs encoding the target protein induces splicing out of two or more retained introns in the population, including the retained intron to which the antisense oligomer is targeted or binds. In embodiments, fully-spliced (mature) RNA encoding the target protein is thereby produced.

In embodiments, an ASO is complementary to a targeted region that is within a non-retained intron in a RIC pre-mRNA. In embodiments, the targeted portion of the RIC pre-mRNA is within: the region +6 to +100 relative to the 5' splice site of the non-retained intron; or the region −16 to −100 relative to the 3' splice site of the non-retained intron. In embodiments, the targeted portion of the RIC pre-mRNA is within the region +100 relative to the 5' splice site of the non-retained intron to −100 relative to the 3' splice site of the non-retained intron. As used to identify the location of a region or sequence, "within" is understood to include the residues at the positions recited. For example, a region +6 to +100 includes the residues at positions +6 and +100. In embodiments, fully-spliced (mature) RNA encoding the target protein is thereby produced.

In embodiments, the retained intron of the RIC pre-mRNA is an inefficiently spliced intron. As used herein, "inefficiently spliced" may refer to a relatively low frequency of splicing at a splice site adjacent to the retained intron (5' splice site or 3' splice site) as compared to the frequency of splicing at another splice site in the RIC pre-mRNA. The term "inefficiently spliced" may also refer to the relative rate or kinetics of splicing at a splice site, in which an "inefficiently spliced" intron may be spliced or removed at a slower rate as compared to another intron in a RIC pre-mRNA.

In embodiments, the 9-nucleotide sequence at −3e to −1e of the exon flanking the 5' splice site and +1 to +6 of the retained intron is identical to the corresponding wild-type sequence. In embodiments, the 16 nucleotide sequence at −15 to −1 of the retained intron and +1e of the exon flanking the 3' splice site is identical to the corresponding wild-type sequence. As used herein, the "wild-type sequence" refers to the nucleotide sequence for a gene in the published reference genome deposited in the NCBI repository of biological and scientific information (operated by National Center for Biotechnology Information, National Library of Medicine, 8600 Rockville Pike, Bethesda, Md. USA 20894). Also used herein, a nucleotide position denoted with an "e" indicates the nucleotide is present in the sequence of an exon (e.g., the exon flanking the 5' splice site or the exon flanking the 3' splice site).

The methods involve contacting cells with an ASO that is complementary to a portion of a pre-mRNA encoding a protein described herein, resulting in increased expression of the protein. As used herein, "contacting" or administering to cells refers to any method of providing an ASO in immediate proximity with the cells such that the ASO and the cells interact. A cell that is contacted with an ASO will take up or transport the ASO into the cell. The method involves contacting a condition or disease-associated or condition or disease-relevant cell with an ASO. In some embodiments, the ASO may be further modified or attached (e.g., covalently attached) to another molecule to target the ASO to a cell type, enhance contact between the ASO and the condition or disease-associated or condition or disease-relevant cell, or enhance uptake of the ASO.

As used herein, the term "increasing protein production" or "increasing expression of a target protein" means enhancing the amount of protein that is translated from an mRNA in a cell. A "target protein" may be any protein for which increased expression/production is desired.

In embodiments, contacting a cell that expresses a RIC pre-mRNA with an ASO that is complementary to a targeted portion of the RIC pre-mRNA transcript results in a measurable increase in the amount of a protein (e.g., a target protein) encoded by the pre-mRNA. Methods of measuring or detecting production of a protein will be evident to one of skill in the art and include any known method, for example, Western blotting, flow cytometry, immunofluorescence microscopy, and ELISA.

In embodiments, contacting cells with an ASO that is complementary to a targeted portion of an RIC pre-mRNA transcript results in an increase in the amount of a protein produced by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of a protein produced by the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the amount of target protein produced by an control compound. A control compound can be, for example, an oligonucleotide that is not complementary to the targeted portion of the RIC pre-mRNA.

In some embodiments, contacting cells with an ASO that is complementary to a targeted portion of an RIC pre-mRNA transcript results in an increase in the amount of mRNA encoding a protein, including the mature mRNA encoding the target protein. In some embodiments, the amount of mRNA encoding a protein, or the mature mRNA encoding the protein, is increased by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of the mRNA encoding a protein, or the mature mRNA encoding a protein produced in the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold compared to the amount of mature RNA produced in an untreated cell, e.g., an untreated cell or a cell treated with a control compound. A control compound can be, for example, an oligonucleotide that is not complementary to the targeted portion of the RIC pre-mRNA.

Constitutive Splicing of a Retained Intron from a RIC pre-mRNA

The methods and antisense oligonucleotide compositions provided herein are useful for increasing the expression of a protein in cells, for example, in a subject having a condition described herein caused by a deficiency in the amount or activity of a protein described herein, by increasing the level of mRNA encoding the protein, or the mature mRNA encoding the protein. In particular, the methods and compositions as described herein induce the constitutive splicing of a retained intron from an RIC pre-mRNA transcript encoding the protein, thereby increasing the level of mRNA encoding the protein, or the mature mRNA encoding the protein and increasing the expression of the protein.

Constitutive splicing of a retained intron from a RIC pre-mRNA correctly removes the retained intron from the RIC pre-mRNA, wherein the retained intron has wild-type splice sequences. Constitutive splicing, as used herein, does not encompass splicing of a retained intron from a RIC pre-mRNA transcribed from a gene or allele having a mutation that causes alternative splicing or aberrant splicing of a pre-mRNA transcribed from the gene or allele. For example, constitutive splicing of a retained intron, as induced using the methods and antisense oligonucleotides provided herein, does not correct aberrant splicing in or influence alternative splicing of a pre-mRNA to result in an increased expression of a target protein or functional RNA.

In embodiments, constitutive splicing correctly removes a retained intron from an RIC pre-mRNA, wherein the RIC pre-mRNA is transcribed from a wild-type gene or allele, or a polymorphic gene or allele, that encodes a fully-functional target protein or functional RNA, and wherein the gene or allele does not have a mutation that causes alternative splicing or aberrant splicing of the retained intron.

In some embodiments, constitutive splicing of a retained intron from an RIC pre-mRNA encoding a protein correctly removes a retained intron from an RIC pre-mRNA encoding the protein, wherein the RIC pre-mRNA is transcribed from a gene or allele from which the target gene or functional RNA is produced at a reduced level compared to production from a wild-type allele, and wherein the gene or allele does not have a mutation that causes alternative splicing or aberrant splicing of the retained intron. In these embodiments, the correct removal of the constitutively spliced retained intron results in production of target protein or functional RNA that is functional when compared to an equivalent wild-type protein or functional RNA.

In other embodiments, constitutive splicing correctly removes a retained intron from an RIC pre-mRNA, wherein the RIC pre-mRNA is transcribed from a gene or allele that encodes a target protein or functional RNA produced in a form having reduced function compared to an equivalent wild-type protein or functional RNA, and wherein the gene or allele does not have a mutation that causes alternative splicing or aberrant splicing of the retained intron. In these embodiments, the correct removal of the constitutively spliced retained intron results in production of partially functional target protein, or functional RNA that is partially functional when compared to an equivalent wild-type protein or functional RNA.

"Correct removal" of the retained intron by constitutive splicing refers to removal of the entire intron, without removal of any part of an exon.

In embodiments, an antisense oligomer as described herein or used in any method described herein does not increase the amount of mRNA encoding a protein or the amount of a protein by modulating alternative splicing or aberrant splicing of a pre-mRNA transcribed from the gene. Modulation of alternative splicing or aberrant splicing can be measured using any known method for analyzing the sequence and length of RNA species, e.g., by RT-PCR and using methods described elsewhere herein and in the literature. In embodiments, modulation of alternative or aberrant splicing is determined based on an increase or decrease in the amount of the spliced species of interest of at least 10% or 1.1-fold. In embodiments, modulation is determined based on an increase or decrease at a level that is at least 10% to 100% or 1.1 to 10-fold, as described herein regarding determining an increase in mRNA encoding the protein in the methods of the invention.

In embodiments, the method is a method wherein the RIC pre-mRNA was produced by partial splicing of a wild-type pre-mRNA. In embodiments, the method is a method wherein the RIC pre-mRNA was produced by partial splicing of a full-length wild-type pre-mRNA. In embodiments, the RIC pre-mRNA was produced by partial splicing of a full-length pre-mRNA. In these embodiments, a full-length pre-mRNA may have a polymorphism in a splice site of the retained intron that does not impair correct splicing of the retained intron as compared to splicing of the retained intron having the wild-type splice site sequence.

In embodiments, the mRNA encoding a protein is a full-length mature mRNA, or a wild-type mature mRNA. In these embodiments, a full-length mature mRNA may have a polymorphism that does not affect the activity of the target protein or the functional RNA encoded by the mature mRNA, as compared to the activity of the protein encoded by the wild-type mature mRNA.

Antisense Oligomers

One aspect of the present disclosure is a composition comprising antisense oligomers that enhances splicing by binding to a targeted portion of an RIC pre-mRNA. As used herein, the terms "ASO" and "antisense oligomer" are used interchangeably and refer to an oligomer such as a polynucleotide, comprising nucleobases, that hybridizes to a target nucleic acid (e.g., an RIC pre-mRNA) sequence by Watson-Crick base pairing or wobble base pairing (G-U). The ASO may have exact sequence complementary to the target sequence or near complementarity (e.g., sufficient complementarity to bind the target sequence and enhancing splicing at a splice site). ASOs are designed so that they bind (hybridize) to a target nucleic acid (e.g., a targeted portion of a pre-mRNA transcript) and remain hybridized under physiological conditions. Typically, if they hybridize to a site other than the intended (targeted) nucleic acid sequence, they hybridize to a limited number of sequences that are not a target nucleic acid (to a few sites other than a target nucleic acid). Design of an ASO can take into consideration the occurrence of the nucleic acid sequence of the targeted portion of the pre-mRNA transcript or a sufficiently similar nucleic acid sequence in other locations in the genome or cellular pre-mRNA or transcriptome, such that the likelihood the ASO will bind other sites and cause "off-target" effects is limited. Any antisense oligomers known in the art, for example in PCT Application No. PCT/US2014/054151, published as WO 2015/035091, titled "Reducing Nonsense-Mediated mRNA Decay," can be used to practice the methods described herein.

In some embodiments, ASOs "specifically hybridize" to or are "specific" to a target nucleic acid or a targeted portion of a RIC pre-mRNA. Typically such hybridization occurs with a Tm substantially greater than 37° C., preferably at least 50° C., and typically between 60° C. to approximately 90° C. Such hybridization preferably corresponds to stringent hybridization conditions. At a given ionic strength and pH, the Tm is the temperature at which 50% of a target sequence hybridizes to a complementary oligonucleotide.

Oligomers, such as oligonucleotides, are "complementary" to one another when hybridization occurs in an antiparallel configuration between two single-stranded polynucleotides. A double-stranded polynucleotide can be "complementary" to another polynucleotide, if hybridization can occur between one of the strands of the first polynucleotide and the second. Complementarity (the degree to which one polynucleotide is complementary with another) is quantifiable in terms of the proportion (e.g., the percentage) of bases in opposing strands that are expected to form hydrogen bonds with each other, according to generally accepted base-pairing rules. The sequence of an antisense oligomer (ASO) need not be 100% complementary to that of its target nucleic acid to hybridize. In certain embodiments, ASOs can comprise at least 70%, at least 75%, at least 80%, at least 85%, at least 90%, at least 95%, at least 96%, at least 97%, at least 98%, or at least 99% sequence complementarity to a target region within the target nucleic acid sequence to which they are targeted. For example, an ASO in which 18 of 20 nucleobases of the oligomeric compound are complementary to a target region, and would therefore specifically hybridize, would represent 90 percent complementarity. In this example, the remaining non-complementary nucleobases may be clustered together or interspersed with complementary nucleobases and need not be contiguous to each other or to complementary nucleobases. Percent complementarity of an ASO with a region of a target nucleic acid can be determined routinely using BLAST programs (basic local alignment search tools) and PowerBLAST programs known in the art (Altschul et al., J. Mol. Biol., 1990, 215, 403-410; Zhang and Madden, Genome Res., 1997, 7, 649-656).

An ASO need not hybridize to all nucleobases in a target sequence and the nucleobases to which it does hybridize may be contiguous or noncontiguous. ASOs may hybridize over one or more segments of a pre-mRNA transcript, such that intervening or adjacent segments are not involved in the hybridization event (e.g., a loop structure or hairpin structure may be formed). In certain embodiments, an ASO hybridizes to noncontiguous nucleobases in a target pre-mRNA transcript. For example, an ASO can hybridize to nucleobases in a pre-mRNA transcript that are separated by one or more nucleobase(s) to which the ASO does not hybridize.

The ASOs described herein comprise nucleobases that are complementary to nucleobases present in a target portion of a RIC pre-mRNA. The term ASO embodies oligonucleotides and any other oligomeric molecule that comprises nucleobases capable of hybridizing to a complementary nucleobase on a target mRNA but does not comprise a sugar moiety, such as a peptide nucleic acid (PNA). The ASOs may comprise naturally-occurring nucleotides, nucleotide analogs, modified nucleotides, or any combination of two or three of the preceding. The term "naturally occurring nucleotides" includes deoxyribonucleotides and ribonucleotides. The term "modified nucleotides" includes nucleotides with modified or substituted sugar groups and/or having a modified backbone. In some embodiments, all of the nucleotides of the ASO are modified nucleotides. Chemical modifications of ASOs or components of ASOs that are compatible with the methods and compositions described herein will be evident to one of skill in the art and can be found, for example, in U.S. Pat. No. 8,258,109 B2, U.S. Pat. No. 5,656,612, U.S. Pat. Pub. No. 2012/0190728, and Dias and Stein, Mol. Cancer Ther. 2002, 1, 347-355, herein incorporated by reference in their entirety.

The nucleobase of an ASO may be any naturally occurring, unmodified nucleobase such as adenine, guanine, cytosine, thymine and uracil, or any synthetic or modified nucleobase that is sufficiently similar to an unmodified nucleobase such that it is capable of hydrogen bonding with a nucleobase present on a target pre-mRNA. Examples of modified nucleobases include, without limitation, hypoxanthine, xanthine, 7-methylguanine, 5,6-dihydrouracil, 5-methylcytosine, and 5-hydroxymethoylcytosine.

The ASOs described herein also comprise a backbone structure that connects the components of an oligomer. The term "backbone structure" and "oligomer linkages" may be used interchangeably and refer to the connection between monomers of the ASO. In naturally occurring oligonucleotides, the backbone comprises a 3'-5' phosphodiester linkage connecting sugar moieties of the oligomer. The backbone structure or oligomer linkages of the ASOs described herein may include (but are not limited to) phosphorothioate, phosphorodithioate, phosphoroselenoate, phosphorodiselenoate, phosphoroanilothioate, phosphoraniladate, phosphoramidate, and the like. See e.g., LaPlanche et al., Nucleic Acids Res. 14:9081 (1986); Stec et al., J. Am. Chem. Soc. 106:6077 (1984), Stein et al., Nucleic Acids Res. 16:3209 (1988), Zon et al., Anti Cancer Drug Design 6:539 (1991); Zon et al., Oligonucleotides and Analogues: A Practical Approach, pp. 87-108 (F. Eckstein, Ed., Oxford University Press, Oxford England (1991)); Stec et al., U.S. Pat. No. 5,151,510; Uhlmann and Peyman, Chemical Reviews 90:543 (1990). In some embodiments, the backbone structure of the ASO does not contain phosphorous but rather contains peptide bonds, for example in a peptide nucleic acid (PNA), or linking groups including carbamate, amides, and linear and cyclic hydrocarbon groups. In some embodiments, the backbone modification is a phosphorothioate linkage. In some embodiments, the backbone modification is a phosphoramidate linkage.

In embodiments, the stereochemistry at each of the phosphorus internucleotide linkages of the ASO backbone is random. In embodiments, the stereochemistry at each of the phosphorus internucleotide linkages of the ASO backbone is controlled and is not random. For example, U.S. Pat. App. Pub. No. 2014/0194610, "Methods for the Synthesis of Functionalized Nucleic Acids," incorporated herein by reference, describes methods for independently selecting the handedness of chirality at each phosphorous atom in a nucleic acid oligomer. In embodiments, an ASO used in the methods of the invention comprises an ASO having phosphorus internucleotide linkages that are not random. In embodiments, a composition used in the methods of the invention comprises a pure diastereomeric ASO. In embodiments, a composition used in the methods of the invention comprises an ASO that has diastereomeric purity of at least about 90%, at least about 91%, at least about 92%, at least about 93%, at least about 94%, at least about 95%, at least about 96%, at least about 97%, at least about 98%, at least about 99%, about 100%, about 90% to about 100%, about 91% to about 100%, about 92% to about 100%, about 93% to about 100%, about 94% to about 100%, about 95% to about 100%, about 96% to about 100%, about 97% to about 100%, about 98% to about 100%, or about 99% to about 100%.

In embodiments, the ASO has a nonrandom mixture of Rp and Sp configurations at its phosphorus internucleotide linkages. For example, it has been suggested that a mix of Rp and Sp is required in antisense oligonucleotides to achieve a balance between good activity and nuclease stability (Wan, et al., 2014, "Synthesis, biophysical properties and biological activity of second generation antisense oligonucleotides containing chiral phosphorothioate linkages," Nucleic Acids Research 42(22): 13456-13468, incorporated herein by reference). In embodiments, an ASO used in the methods of the invention comprises about 5-100% Rp, at least about 5% Rp, at least about 10% Rp, at least about 15% Rp, at least about 20% Rp, at least about 25% Rp, at least about 30% Rp, at least about 35% Rp, at least about 40% Rp, at least about 45% Rp, at least about 50% Rp, at least about 55% Rp, at least about 60% Rp, at least about 65% Rp, at least about 70% Rp, at least about 75% Rp, at least about 80% Rp, at least about 85% Rp, at least about 90% Rp, or at least about 95% Rp, with the remainder Sp, or about 100% Rp. In embodiments, an ASO used in the methods of the invention comprises about 10% to about 100% Rp, about 15% to about 100% Rp, about 20% to about 100% Rp, about 25% to about 100% Rp, about 30% to about 100% Rp, about 35% to about 100% Rp, about 40% to about 100% Rp, about 45% to about 100% Rp, about 50% to about 100% Rp, about 55% to about 100% Rp, about 60% to about 100% Rp, about 65% to about 100% Rp, about 70% to about 100% Rp, about 75% to about 100% Rp, about 80% to about 100% Rp, about 85% to about 100% Rp, about 90% to about 100% Rp, or about 95% to about 100% Rp, about 20% to about 80% Rp, about 25% to about 75% Rp, about 30% to about 70% Rp, about 40% to about 60% Rp, or about 45% to about 55% Rp, with the remainder Sp.

In embodiments, an ASO used in the methods of the invention comprises about 5-100% Sp, at least about 5% Sp, at least about 10% Sp, at least about 15% Sp, at least about 20% Sp, at least about 25% Sp, at least about 30% Sp, at least about 35% Sp, at least about 40% Sp, at least about 45% Sp, at least about 50% Sp, at least about 55% Sp, at least about 60% Sp, at least about 65% Sp, at least about 70% Sp, at least about 75% Sp, at least about 80% Sp, at least about 85% Sp, at least about 90% Sp, or at least about 95% Sp, with the remainder Rp, or about 100% Sp. In embodiments, an ASO used in the methods of the invention comprises about 10% to about 100% Sp, about 15% to about 100% Sp, about 20% to about 100% Sp, about 25% to about 100% Sp, about 30% to about 100% Sp, about 35% to about 100% Sp, about 40% to about 100% Sp, about 45% to about 100% Sp, about 50% to about 100% Sp, about 55% to about 100% Sp, about 60% to about 100% Sp, about 65% to about 100% Sp, about 70% to about 100% Sp, about 75% to about 100% Sp, about 80% to about 100% Sp, about 85% to about 100% Sp, about 90% to about 100% Sp, or about 95% to about 100% Sp, about 20% to about 80% Sp, about 25% to about 75% Sp, about 30% to about 70% Sp, about 40% to about 60% Sp, or about 45% to about 55% Sp, with the remainder Rp.

Any of the ASOs described herein may contain a sugar moiety that comprises ribose or deoxyribose, as present in naturally occurring nucleotides, or a modified sugar moiety or sugar analog, including a morpholine ring. Non-limiting examples of modified sugar moieties include 2' substitutions such as 2'-O-methyl (2'-O-Me), 2'-O-methoxyethyl (2'MOE), 2'-O-aminoethyl, 2'F; N3'→P5' phosphoramidate, 2'dimethylaminooxyethoxy, 2'dimethylaminoethoxyethoxy, 2'-guanidinidium, 2'-O-guanidinium ethyl, carbamate modified sugars, and bicyclic modified sugars. In some embodiments, the sugar moiety modification is selected from 2'-O-Me, 2'F, and 2'MOE. In some embodiments, the sugar moiety modification is an extra bridge bond, such as in a locked nucleic acid (LNA). In some embodiments the sugar analog contains a morpholine ring, such as phosphorodiamidate morpholino (PMO). In some embodiments, the sugar moiety comprises a ribofuransyl or 2'deoxyribofuransyl modification. In some embodiments, the sugar moiety comprises 2'4'-constrained 2'O-methyloxyethyl (cMOE) modifications. In some embodiments, the sugar moiety comprises cEt 2', 4' constrained 2'-O ethyl BNA modifications. In some embodiments, the sugar moiety comprises tricycloDNA (tcDNA) modifications. In some embodiments, the sugar moiety comprises ethylene nucleic acid (ENA) modifications. In some embodiments, the sugar moiety comprises MCE modifications. Modifications are known in the art and described in the literature, e.g., by Jarver, et al., 2014, "A Chemical View of Oligonucleotides for Exon Skipping and Related Drug Applications," Nucleic Acid Therapeutics 24(1): 37-47, incorporated by reference for this purpose herein.

In some examples, each monomer of the ASO is modified in the same way, for example each linkage of the backbone of the ASO comprises a phosphorothioate linkage or each ribose sugar moiety comprises a 2'O-methyl modification. Such modifications that are present on each of the monomer components of an ASO are referred to as "uniform modifications." In some examples, a combination of different modifications may be desired, for example, an ASO may comprise a combination of phosphorodiamidate linkages and sugar moieties comprising morpholine rings (morpholinos). Combinations of different modifications to an ASO are referred to as "mixed modifications" or "mixed chemistries."

In some embodiments, the ASO comprises one or more backbone modification. In some embodiments, the ASO comprises one or more sugar moiety modification. In some embodiments, the ASO comprises one or more backbone modification and one or more sugar moiety modification. In some embodiments, the ASO comprises 2'MOE modifications and a phosphorothioate backbone. In some embodiments, the ASO comprises a phosphorodiamidate morpholino (PMO). In some embodiments, the ASO comprises a peptide nucleic acid (PNA). Any of the ASOs or any component of an ASO (e.g., a nucleobase, sugar moiety, backbone) described herein may be modified in order to achieve desired properties or activities of the ASO or reduce undesired properties or activities of the ASO. For example, an ASO or one or more component of any ASO may be modified to enhance binding affinity to a target sequence on a pre-mRNA transcript; reduce binding to any non-target sequence; reduce degradation by cellular nucleases (i.e., RNase H); improve uptake of the ASO into a cell and/or into the nucleus of a cell; alter the pharmacokinetics or pharmacodynamics of the ASO; and modulate the half-life of the ASO.

In some embodiments, the ASOs are comprised of 2'-O-(2-methoxyethyl) (MOE) phosphorothioate-modified nucleotides. ASOs comprised of such nucleotides are especially well-suited to the methods disclosed herein; oligomers having such modifications have been shown to have significantly enhanced resistance to nuclease degradation and increased bioavailability, making them suitable, for example, for oral delivery in some embodiments described herein. See e.g., Geary et al., J Pharmacol Exp Ther. 2001; 296(3):890-7; Geary et al., J Pharmacol Exp Ther. 2001; 296(3):898-904.

Methods of synthesizing ASOs will be known to one of skill in the art. Alternatively or in addition, ASOs may be obtained from a commercial source.

Unless specified otherwise, the left-hand end of single-stranded nucleic acid (e.g., pre-mRNA transcript, oligonucleotide, ASO, etc.) sequences is the 5' end and the left-hand direction of single or double-stranded nucleic acid sequences is referred to as the 5' direction. Similarly, the right-hand end or direction of a nucleic acid sequence (single or double stranded) is the 3' end or direction. Generally, a region or sequence that is 5' to a reference point in a nucleic acid is referred to as "upstream," and a region or sequence that is 3' to a reference point in a nucleic acid is referred to as "downstream." Generally, the 5' direction or end of an mRNA is where the initiation or start codon is located, while the 3' end or direction is where the termination codon is located. In some aspects, nucleotides that are upstream of a reference point in a nucleic acid may be designated by a negative number, while nucleotides that are downstream of a reference point may be designated by a positive number. For example, a reference point (e.g., an exon-exon junction in mRNA) may be designated as the "zero" site, and a nucleotide that is directly adjacent and upstream of the reference point is designated "minus one," e.g., "−1," while a nucleotide that is directly adjacent and downstream of the reference point is designated "plus one," e.g., "+1."

In other embodiments, the ASOs are complementary to (and bind to) a targeted portion of an AMT, ADA, PPDX, UROD, HMBS, ACADVL, PC, IVD, APOA5, GALT, LDL-RAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA that is downstream (in the 3' direction) of the 5' splice site of the retained intron in an AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA (e.g., the direction designated by positive numbers relative to the 5' splice site) (FIG. 1). In some embodiments, the ASOs are complementary to a targeted portion of the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA that is within the region +6 to +100 relative to the 5' splice site of the retained intron. In some embodiments, the ASO is not complementary to nucleotides +1 to +5 relative to the 5' splice site (the first five nucleotides located downstream of the 5' splice site). In some embodiments, the ASOs may be complementary to a targeted portion of an AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA that is within the region between nucleotides +6 and +50 relative to the 5' splice site of the retained intron. In some aspects, the ASOs are complementary to a targeted portion of the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA that is within the region +6 to +500, +6 to +400, +6 to +300, +6 to +200, or +6 to +90, +6 to +80, +6 to +70, +6 to +60, +6 to +50, +6 to +40, +6 to +30, or +6 to +20 relative to 5' splice site of the retained intron.

In some embodiments, the ASOs are complementary to a targeted region of an AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA that is upstream (5' relative) of the 3' splice site of the retained intron in an AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA (e.g., in the direction designated by negative numbers) (FIG. 1). In some embodiments, the ASOs are complementary to a targeted portion of the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA that is within the region −16 to −500, −16 to −400, −16 to −300, −6 to −200, or −16 to −100 relative to the 3' splice site of the retained intron. In some embodiments, the ASO is not complementary to nucleotides −1 to −15 relative to the 3' splice site (the first 15 nucleotides located upstream of the 3' splice site). In some embodiments, the ASOs are complementary to a targeted portion of the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA that is within the region −16 to −50 relative to the 3' splice site of the retained intron. In some aspects, the ASOs are complementary to a targeted portion of the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA that is within the region −16 to −90, −16 to −80, −16 to −70, −16 to −60, −16 to −50, −16 to −40, or −16 to −30 relative to 3' splice site of the retained intron.

In embodiments, the targeted portion of the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA is within the region +100 relative to the 5' splice site of the retained intron to −100 relative to the 3' splice site of the retained intron.

In some embodiments, the ASOs are complementary to a targeted portion of an AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA that is within the exon flanking the 5' splice site (upstream) of the retained intron (FIG. 1). In some embodiments, the ASOs are complementary to a targeted portion of the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA that is within the region +2e to −4e in the exon flanking the 5' splice site of the retained intron. In some embodiments, the ASOs are not complementary to nucleotides −1e to −3e relative to the 5' splice site of the retained intron. In some embodiments, the ASOs are complementary to a targeted portion of the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA that is within the region −4e to −100e, −4e to −90e, −4e to −80e, −4e to −70e, −4e to −60e, −4e to −50e, −4 to −40e, −4e to −30e, or −4e to −20e relative to the 5' splice site of the retained intron.

In some embodiments, the ASOs are complementary to a targeted portion of an RIC pre-mRNA that is within the exon flanking the 3' splice site (downstream) of the retained intron (FIG. 1). In some embodiments, the ASOs are complementary to a targeted portion to the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA that is within the region +2e to −4e in the exon flanking the 3' splice site of the retained intron. In some embodiments, the ASOs are not complementary to nucleotide +1e relative to the 3' splice site of the retained intron. In some embodiments, the ASOs are complementary to a targeted portion of the AMT, ADA, PPDX, UROD, HMBS, ACADVL, PC, IVD, APOA5, GALT, LDLRAP1, HNF4A, GCK, POGLUT1, PIK3R1, HNF1A, TRIB1, TGFB1, HAMP, THPO, PNPLA3, ATP7B, FAH, ASL, HFE, ALMS1, PPARD, IL6, HSD3B7, CERS2 or NCOA5 RIC pre-mRNA that is within the region +2e to +100e, +2e to +90e, +2e to +80e, +2e to +70e, +2e to +60e, +2e to +50e, +2e to +40e, +2e to +30e, or +2 to +20e relative to the 3' splice site of the retained intron. The ASOs may be of any length suitable for specific binding and effective enhancement of splicing. In some embodiments, the ASOs consist of 8 to 50 nucleobases. For example, the ASO may be 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, or 50 nucleobases in length. In some embodiments, the ASOs consist of more than 50 nucleobases. In some embodiments, the ASO is from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, 12 to 15 nucleobases, 13 to 50 nucleobases, 13 to 40 nucleobases, 13 to 35 nucleobases, 13 to 30 nucleobases, 13 to 25 nucleobases, 13 to 20 nucleobases, 14 to 50 nucleobases, 14 to 40 nucleobases, 14 to 35 nucleobases, 14 to 30 nucleobases, 14 to 25 nucleobases, 14 to 20 nucleobases, 15 to 50 nucleobases, 15 to 40 nucleobases, 15 to 35 nucleobases, 15 to 30 nucleobases, 15 to 25 nucleobases, 15 to 20 nucleobases, 20 to 50 nucleobases, 20 to 40 nucleobases, 20 to 35 nucleobases, 20 to 30 nucleobases, 20 to 25 nucleobases, 25 to 50 nucleobases, 25 to 40 nucleobases, 25 to 35 nucleobases, or 25 to 30 nucleobases in length. In some embodiments, the ASOs are 30 nucleotides in length. In some embodiments, the ASOs are 29 nucleotides in length. In some embodiments, the ASOs are 28 nucleotides in length. In some embodiments, the ASOs are 27 nucleotides in length. In some embodiments, the ASOs are 26 nucleotides in length. In some embodiments, the ASOs are 25 nucleotides in length. In some embodiments, the ASOs are 24 nucleotides in length. In some embodiments, the ASOs are 23 nucleotides in length. In some embodiments, the ASOs are 22 nucleotides in length. In some embodiments, the ASOs are 21 nucleotides in length. In some embodiments, the ASOs are 20 nucleotides in length. In some embodiments, the ASOs are 19 nucleotides in length. In some embodiments, the ASOs are 18 nucleotides in length. In some embodiments, the ASOs are 17 nucleotides in length. In some embodiments, the ASOs are 16 nucleotides in length. In some embodiments, the ASOs are 15 nucleotides in length. In some embodiments, the ASOs are 14 nucleotides in length. In some embodiments, the ASOs are 13 nucleotides in length. In some embodiments, the ASOs are 12 nucleotides in length. In some embodiments, the ASOs are 11 nucleotides in length. In some embodiments, the ASOs are 10 nucleotides in length.

In some embodiments, two or more ASOs with different chemistries but complementary to the same targeted portion of the RIC pre-mRNA are used. In some embodiments, two or more ASOs that are complementary to different targeted portions of the RIC pre-mRNA are used.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties, and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

In some embodiments, the nucleic acid to be targeted by an ASO is an RIC pre-mRNA expressed in a cell, such as a eukaryotic cell. In some embodiments, the term "cell" may refer to a population of cells. In some embodiments, the cell is in a subject. In some embodiments, the cell is isolated from a subject. In some embodiments, the cell is ex vivo. In some embodiments, the cell is a condition or disease-relevant cell or a cell line. In some embodiments, the cell is in vitro (e.g., in cell culture).

Pharmaceutical Compositions

Pharmaceutical compositions or formulations comprising the antisense oligonucleotide of the described compositions and for use in any of the described methods can be prepared according to conventional techniques well known in the pharmaceutical industry and described in the published literature. In embodiments, a pharmaceutical composition or formulation for treating a subject comprises an effective amount of any antisense oligomer as described above, or a pharmaceutically acceptable salt, solvate, hydrate or ester thereof, and a pharmaceutically acceptable diluent. The antisense oligomer of a pharmaceutical formulation may further comprise a pharmaceutically acceptable excipient, diluent or carrier.

Pharmaceutically acceptable salts are suitable for use in contact with the tissues of humans and lower animals without undue toxicity, irritation, allergic response, etc., and are commensurate with a reasonable benefit/risk ratio. (See, e.g., S. M. Berge, et al., J. Pharmaceutical Sciences, 66: 1-19 (1977), incorporated herein by reference for this purpose. The salts can be prepared in situ during the final isolation and purification of the compounds, or separately by reacting the free base function with a suitable organic acid. Examples of pharmaceutically acceptable, nontoxic acid addition salts are salts of an amino group formed with inorganic acids such as hydrochloric acid, hydrobromic acid, phosphoric acid, sulfuric acid and perchloric acid or with organic acids such as acetic acid, oxalic acid, maleic acid, tartaric acid, citric acid, succinic acid or malonic acid or by using other documented methodologies such as ion exchange. Other pharmaceutically acceptable salts include adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, lower alkyl sulfonate and aryl sulfonate.

In embodiments, the compositions are formulated into any of many possible dosage forms such as, but not limited to, tablets, capsules, gel capsules, liquid syrups, soft gels, suppositories, and enemas. In embodiments, the compositions are formulated as suspensions in aqueous, non-aqueous or mixed media. Aqueous suspensions may further contain substances that increase the viscosity of the suspension including, for example, sodium carboxymethylcellulose, sorbitol and/or dextran. The suspension may also contain stabilizers. In embodiments, a pharmaceutical formulation or composition of the present invention includes, but is not limited to, a solution, emulsion, microemulsion, foam or liposome-containing formulation (e.g., cationic or noncationic liposomes).

The pharmaceutical composition or formulation of the present invention may comprise one or more penetration enhancer, carrier, excipients or other active or inactive ingredients as appropriate and well known to those of skill in the art or described in the published literature. In embodiments, liposomes also include sterically stabilized liposomes, e.g., liposomes comprising one or more specialized lipids. These specialized lipids result in liposomes with enhanced circulation lifetimes. In embodiments, a sterically stabilized liposome comprises one or more glycolipids or is derivatized with one or more hydrophilic polymers, such as a polyethylene glycol (PEG) moiety. In embodiments, a surfactant is included in the pharmaceutical formulation or compositions. The use of surfactants in drug products, formulations and emulsions is well known in the art. In embodiments, the present invention employs a penetration enhancer to effect the efficient delivery of the antisense oligonucleotide, e.g., to aid diffusion across cell membranes and/or enhance the permeability of a lipophilic drug. In embodiments, the penetration enhancers is a surfactant, fatty acid, bile salt, chelating agent, or non-chelating nonsurfactant.

In embodiments, the pharmaceutical formulation comprises multiple antisense oligonucleotides. In embodiments, the antisense oligonucleotide is administered in combination with another drug or therapeutic agent. In embodiments, the antisense oligonucleotide is administered with one or more agents capable of promoting penetration of the subject antisense oligonucleotide across the blood-brain barrier by any method known in the art. For example, delivery of agents by administration of an adenovirus vector to motor neurons in muscle tissue is described in U.S. Pat. No. 6,632,427, "Adenoviral-vector-mediated gene transfer into medullary motor neurons," incorporated herein by reference. Delivery of vectors directly to the brain, e.g., the striatum, the thalamus, the hippocampus, or the substantia nigra, is described, e.g., in U.S. Pat. No. 6,756,523, "Adenovirus vectors for the transfer of foreign genes into cells of the central nervous system particularly in brain," incorporated herein by reference.

In embodiments, the antisense oligonucleotides are linked or conjugated with agents that provide desirable pharmaceutical or pharmacodynamic properties. In embodiments, the antisense oligonucleotide is coupled to a substance, known in the art to promote penetration or transport across the blood-brain barrier, e.g., an antibody to the transferrin receptor. In embodiments, the antisense oligonucleotide is linked with a viral vector, e.g., to render the antisense compound more effective or increase transport across the blood-brain barrier. In embodiments, osmotic blood brain barrier disruption is assisted by infusion of sugars, e.g., meso erythritol, xylitol, D(+) galactose, D(+) lactose, D(+) xylose, dulcitol, myo-inositol, L(−) fructose, D(−) mannitol, D(+) glucose, D(+) arabinose, D(−) arabinose, cellobiose, D(+) maltose, D(+) raffinose, L(+) rhamnose, D(+) melibiose, D(−) ribose, adonitol, D(+) arabitol, L(−) arabitol, D(+) fucose, L(−) fucose, D(−) lyxose, L(+) lyxose, and L(−) lyxose, or amino acids, e.g., glutamine, lysine, arginine, asparagine, aspartic acid, cysteine, glutamic acid, glycine, histidine, leucine, methionine, phenylalanine, proline, serine, threonine, tyrosine, valine, and taurine. Methods and materials for enhancing blood brain barrier penetration are described, e.g., in U.S. Pat. No. 4,866,042, "Method for the delivery of genetic material across the blood brain barrier," U.S. Pat. No. 6,294,520, "Material for passage through the blood-brain barrier," and U.S. Pat. No. 6,936,589, "Parenteral delivery systems," each incorporated herein by reference.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties, and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

Treatment of Subjects

Any of the compositions provided herein may be administered to an individual. "Individual" may be used interchangeably with "subject" or "patient." An individual may be a mammal, for example a human or animal such as a non-human primate, a rodent, a rabbit, a rat, a mouse, a horse, a donkey, a goat, a cat, a dog, a cow, a pig, or a sheep. In embodiments, the individual is a human. In embodiments, the individual is a fetus, an embryo, or a child. In other embodiments, the individual may be another eukaryotic organism, such as a plant. In some embodiments, the compositions provided herein are administered to a cell ex vivo.

In some embodiments, the compositions provided herein are administered to an individual as a method of treating a disease or disorder. In some embodiments, the individual has a genetic disease, such as any of the diseases described herein. In some embodiments, the individual is at risk of having the disease, such as any of the diseases described herein. In some embodiments, the individual is at increased risk of having a disease or disorder caused by insufficient amount of a protein or insufficient activity of a protein. If an individual is "at an increased risk" of having a disease or disorder caused insufficient amount of a protein or insufficient activity of a protein, the method involves preventative or prophylactic treatment. For example, an individual may be at an increased risk of having such a disease or disorder because of family history of the disease. Typically, individuals at an increased risk of having such a disease or disorder benefit from prophylactic treatment (e.g., by preventing or delaying the onset or progression of the disease or disorder).

Suitable routes for administration of ASOs of the present invention may vary depending on cell type to which delivery of the ASOs is desired. Multiple tissues and organs can be affected in a condition described herein, with the liver being the most significantly affected tissue. The ASOs of the present invention may be administered to patients parenterally, for example, by intraperitoneal injection, intramuscular injection, subcutaneous injection, or intravenous injection. In embodiments, delivery is to the heart or liver. In embodiments, a fetus is treated in utero, e.g., by administering the ASO composition to the fetus directly or indirectly (e.g., via the mother).

Methods of Identifying Additional ASOs that Enhance Splicing

Also within the scope of the present invention are methods for identifying (determining) additional ASOs that enhance splicing of an RIC pre-mRNA, specifically at the target intron. ASOs that specifically hybridize to different nucleotides within the target region of the pre-mRNA may be screened to identify (determine) ASOs that improve the rate and/or extent of splicing of the target intron. In some embodiments, the ASO may block or interfere with the binding site(s) of a splicing repressor(s)/silencer. Any method known in the art may be used to identify (determine) an ASO that when hybridized to the target region of the intron results in the desired effect (e.g., enhanced splicing, protein or functional RNA production). These methods also can be used for identifying ASOs that enhance splicing of the retained intron by binding to a targeted region in an exon flanking the retained intron, or in a non-retained intron. An example of a method that may be used is provided below.

A round of screening, referred to as an ASO "walk" may be performed using ASOs that have been designed to hybridize to a target region of a pre-mRNA. For example, the ASOs used in the ASO walk can be tiled every 5 nucleotides from approximately 100 nucleotides upstream of the 5' splice site of the retained intron (e.g., a portion of sequence of the exon located upstream of the target/retained intron) to approximately 100 nucleotides downstream of the 5' splice site of the target/retained intron and/or from approximately 100 nucleotides upstream of the 3' splice site of the retained intron to approximately 100 nucleotides downstream of the 3' splice site of the target/retained intron (e.g., a portion of sequence of the exon located downstream of the target/retained intron). For example, a first ASO of 15 nucleotides in length may be designed to specifically hybridize to nucleotides +6 to +20 relative to the 5' splice site of the target/retained intron. A second ASO is designed to specifically hybridize to nucleotides +11 to +25 relative to the 5' splice site of the target/retained intron. ASOs are designed as such spanning the target region of the pre-mRNA. In embodiments, the ASOs can be tiled more closely, e.g., every 1, 2, 3, or 4 nucleotides. Further, the ASOs can be tiled from 100 nucleotides downstream of the 5' splice site, to 100 nucleotides upstream of the 3' splice site.

One or more ASOs, or a control ASO (an ASO with a scrambled sequence, sequence that is not expected to hybridize to the target region) are delivered, for example by transfection, into a disease-relevant cell line that expresses the target pre-mRNA (e.g., the RIC pre-mRNA described elsewhere herein). The splicing-inducing effects of each of the ASOs may be assessed by any method known in the art, for example by reverse transcriptase (RT)-PCR using primers that span the splice junction, as described herein (see "Identification of intron-retention events"). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

A second round of screening, referred to as an ASO "micro-walk" may be performed using ASOs that have been designed to hybridize to a target region of a pre-mRNA. The ASOs used in the ASO micro-walk are tiled every 1 nucleotide to further refine the nucleotide acid sequence of the pre-mRNA that when hybridized with an ASO results in enhanced splicing.

Regions defined by ASOs that promote splicing of the target intron are explored in greater detail by means of an ASO "micro-walk", involving ASOs spaced in 1-nt steps, as well as longer ASOs, typically 18-25 nt.

As described for the ASO walk above, the ASO micro-walk is performed by delivering one or more ASOs, or a control ASO (an ASO with a scrambled sequence, sequence that is not expected to hybridize to the target region), for example by transfection, into a disease-relevant cell line that expresses the target pre-mRNA. The splicing-inducing effects of each of the ASOs may be assessed by any method known in the art, for example by reverse transcriptase (RT)-PCR using primers that span the splice junction, as described herein (see "Identification of intron-retention events"). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

ASOs that when hybridized to a region of a pre-mRNA result in enhanced splicing and increased protein production may be tested in vivo using animal models, for example transgenic mouse models in which the full-length human gene has been knocked-in or in humanized mouse models of disease. Suitable routes for administration of ASOs may vary depending on the disease and/or the cell types to which delivery of the ASOs is desired. ASOs may be administered, for example, by intraperitoneal injection, intramuscular injection, subcutaneous injection, or intravenous injection. Following administration, the cells, tissues, and/or organs of the model animals may be assessed to determine the effect of the ASO treatment by for example evaluating splicing (efficiency, rate, extent) and protein production by methods known in the art and described herein. The animal models may also be any phenotypic or behavioral indication of the disease or disease severity.

Compositions and Methods for Treatment of Kidney Diseases

Kidney failure is a debilitating condition that is estimated to affect more than 600,000 in the United States alone. In many cases, renal dialysis is able to prolong life, with an estimated 400,000 patients receiving renal dialysis according to a 2009 study. Still, the only hope for many afflicted with kidney failure is a kidney transplant, though the donor pool is only sufficient to treat a small portion of those in need. Therefore, the odds of receiving a transplant is low, and there are few treatments available to ameliorate the condition for those unable to receive a transplant. Therefore, there exists a need for compositions and methods for treating kidney diseases.

Individual introns in primary transcripts of protein-coding genes having more than one intron are spliced from the primary transcript with different efficiencies. In most cases only the fully spliced mRNA is exported through nuclear pores for subsequent translation in the cytoplasm. Unspliced and partially spliced transcripts are detectable in the nucleus. It is generally thought that nuclear accumulation of transcripts that are not fully spliced is a mechanism to prevent the accumulation of potentially deleterious mRNAs in the cytoplasm that may be translated to protein. For some genes, splicing of the least efficient intron is a rate-limiting post-transcriptional step in gene expression, prior to translation in the cytoplasm.

Substantial levels of partially-spliced transcripts of the gene, which encodes a protein that is deficient in a subset of kidney diseases, have been discovered in the nucleus of human cells. These pre-mRNA species comprise at least one retained intron. The present invention provides compositions and methods for upregulating splicing of one or more retained introns that are rate-limiting for the nuclear stages of gene expression to increase steady-state production of fully-spliced, mature mRNA, and thus, translated protein levels. These compositions and methods utilize antisense oligomers (ASOs) that promote constitutive splicing at an intron splice site of a retained-intron-containing pre-mRNA that accumulates in the nucleus. Thus, in embodiments, protein is increased using the methods of the invention to treat a condition caused by a protein deficiency.

Kidney diseases that can be treated by the invention described herein are diseases where a subject is deficient in a gene product, where deficiency in a gene product causes the kidney disease.

These CTNS, PAX2, CYP24A1 and PPARD pre-mRNA species comprise at least one retained intron. The present invention provides compositions and methods for upregulating splicing of one or more retained CTNS, PAX2, CYP24A1 or PPARD introns that are rate-limiting for the nuclear stages of gene expression to increase steady-state production of fully-spliced, mature mRNA, and thus, translated CTNS, PAX2, CYP24A1 or PPARD protein levels. These compositions and methods can utilize antisense oligomers (ASOs) that promote constitutive splicing at intron splice sites of a retained-intron-containing CTNS, PAX2, CYP24A1 or PPARD pre-mRNA (RIC pre-mRNA) that accumulates in the nucleus. Thus, in embodiments, CTNS, PAX2, CYP24A1 or PPARD protein can be increased using the methods of the invention to treat a condition caused by CTNS, PAX2, CYP24A1 or PPARD deficiency.

In other embodiments, the methods of the invention can be used to increase CTNS, PAX2, CYP24A1 or PPARD production to treat a condition in a subject in need thereof. In embodiments, the subject has a condition in which CTNS, PAX2, CYP24A1 or PPARD is not necessarily deficient relative to wild-type, but where an increase in CTNS, PAX2, CYP24A1 or PPARD mitigates the condition nonetheless. In embodiments, the condition can be caused by a CTNS, PAX2, CYP24A1 or PPARD haploinsufficiency.

Nephropathic Cystinosis/Late-Onset Cystinosis

In some embodiments, the invention described herein can be used to treat the autosomal recessive kidney disorder infantile nephropathic cystinosis. Infantile nephropathic cystinosis is characterized by the accumulation of cysteine in lysosomes. Clinical manifestations of infantile nephropathic cystinosis include low blood sugar and electrolytes, excessive excretion of proteins in the urine, slow body growth, weak bones, hypothyroidism, blindness, muscle weakness, pulmonary dysfunction and kidney failure. Typically infantile nephropathic cystinosis is diagnosed in infancy.

In some embodiments, the invention described herein can be used to treat the autosomal recessive kidney disorder late-onset cystinosis. Late onset cystinosis has a similar clinical manifestation as the infantile form, though the late onset form typically manifests in either late adolescence or early adulthood.

Deficiency in the protein cystinosin (CTNS) results in the clinical manifestations shown in both infantile nephropathic cystinosis and late-onset cystinosis. The CTNS gene, which is located at 17q13.2 and spans 12 exons, codes for the CTNS protein. Mutations in the CTNS gene resulting in deficient amounts of CTNS protein have been shown to be responsible for the progression of both infantile nephropathic cystinosis and late-onset cystinosis. In one study, a G169D missense mutation was discovered in patients with infantile nephropathic cystinosis. This missense mutation resulted in diminished levels of CTNS, which provided a positive link between deficiency in CTNS and the progression of infantile nephropathic cystinosis.

Focal Segmental Glomerulosclerosis 7/Papillorenal Syndrome

In some embodiments, the invention described herein can be used to treat the autosomal dominant kidney disorder focal segmental glomerulosclerosis 7 (FSGS7). FSGS7 is one of the leading causes of kidney failure in adults. FSGS7 is characterized by edema, hypoalbuminemia, hyperlipidemia and hypertension, which ultimately results in kidney failure.

In some embodiments, the invention described herein can be used to treat the autosomal dominant kidney disorder Papillorenal syndrome (PAPRS). PAPRS is characterized by hypoplastic kidneys, hypodysplasia, multicystic dysplastic kidney, oligomeganephronia, renal insufficiency and vesicoureteral reflux.

Deficiency in the protein paired box gene 2 (PAX2) results in the clinical manifestations shown in both FSGS7 and PAPRS. The PAX2 gene, which is located at 10q24.31 and spans 12 exons, codes for the PAX2 protein. Mutations in the PAX2 gene resulting in deficient amounts of PAX2 protein have been shown to be responsible for the progression of both FSGS7 and PAPRS. In one study, a G76S missense mutation was discovered in 5 generations of a family afflicted with PAPRS. This missense mutation resulted in diminished levels of PAX2 protein, which provided a positive link between deficiency in PAX2 protein and the progression of PAPRS.

Infantile Hypercalcemia

In some embodiments, the invention described herein can be used to treat the autosomal recessive kidney disease infantile hypercalcemia. Infantile hypercalcemia is characterized by elevated calcium levels in the blood, which can result in renal stones, bone pain, abdominal pain, nausea, vomiting, polyuria and psychiatric conditions such as depression, anxiety, cognitive dysfunction, insomnia and coma.

Deficiency in the protein cytochrome P450 family 24, subfamily A, polypeptide 1 (CYP24A1) results in the clinical manifestations shown in infantile hypercalcemia. The CYP24A1 gene, which is located at 20q13.2 and spans 2 exons, codes for the CYP24A1 protein. Mutations in the CYP24A1 gene resulting in deficient amounts of CYP24A1 protein have been shown to be responsible for the progression of infantile hypercalcemia. In one study, a number of children diagnosed with infantile hypercalcemia were examined. Children displaying an R396W or an E322K missense mutation were shown to have complete ablation of CYP24A1 activity, which children displaying an L409S mutation retained small, but measurable levels. This finding provides a positive link between diminished CYP24A1 protein and the clinical manifestations of infantile hypercalcemia.

Lipid Metabolism Dysfunction and Chronic Kidney Disease

In some embodiments, the invention described herein can be used to treat the lipid metabolism deficiency, chronic kidney disease (CKD), end-stage renal disease (ESRD) or cardiovascular disease (CVD) caused by deficiency in the protein peroxisome proliferator activated receptor delta (PPARD). Deficiency in the amount of PPARD protein, which is encoded by the PPARD gene located on chromosome 6 and spans 8 exons, has been shown to be correlated to increased lipid metabolism dysfunction.

Retained Intron Containing Pre-mRNA (RIC Pre-mRNA)

In embodiments, the methods of the present invention exploit the presence of retained-intron-containing pre-mRNA (RIC pre-mRNA) transcribed from a gene and encoding a protein that is found to be deficient in a disease described herein, in the cell nucleus. Splicing of the identified RIC pre-mRNA species to produce mature, fully-spliced, mRNA, is induced using ASOs that stimulate splicing out of the retained introns. The resulting mature mRNA can be exported to the cytoplasm and translated, thereby increasing the amount of protein in the patient's cells and alleviating symptoms of a disease or condition described herein. In embodiments, the methods of the present invention can exploit the presence of retained-intron-containing pre-mRNA (RIC pre-mRNA) transcribed from the CTNS, PAX2, CYP24A1 or PPARD gene and encoding CTNS, PAX2, CYP24A1 or PPARD protein, in the cell nucleus. Splicing of CTNS, PAX2, CYP24A1 or PPARD RIC pre-mRNA species to produce mature, fully-spliced, CTNS, PAX2, CYP24A1 or PPARD mRNA, can be induced using ASOs that stimulate splicing out of the retained introns. The resulting mature CTNS, PAX2, CYP24A1 or PPARD mRNA can be exported to the cytoplasm and translated, thereby increasing the amount of CTNS, PAX2, CYP24A1 or PPARD protein in the patient's cells and alleviating symptoms of the CNS disease or conditions caused by deficiency in CTNS, PAX2, CYP24A1 or PPARD. This method, described further below, is known as Targeted Augmentation of Nuclear Gene Output (TANGO).

In embodiments, a retained intron is an intron that is identified as a retained intron based on a determination of at least about 5%, at least about 10%, at least about 15%, at least about 20%, at least about 25%, at least about 30%, at least about 35%, at least about 40%, at least about 45%, or at least about 50%, retention. In embodiments, a retained intron is an intron that is identified as a retained intron based on a determination of about 5% to about 100%, about 5% to about 95%, about 5% to about 90%, about 5% to about 85%, about 5% to about 80%, about 5% to about 75%, about 5% to about 70%, about 5% to about 65%, about 5% to about 60%, about 5% to about 65%, about 5% to about 60%, about 5% to about 55%, about 5% to about 50%, about 5% to about 45%, about 5% to about 40%, about 5% to about 35%, about 5% to about 30%, about 5% to about 25%, about 5% to about 20%, about 5% to about 15%, about 10% to about 100%, about 10% to about 95%, about 10% to about 90%, about 10% to about 85%, about 10% to about 80%, about 10% to about 75%, about 10% to about 70%, about 10% to about 65%, about 10% to about 60%, about 10% to about 65%, about 10% to about 60%, about 10% to about 55%, about 10% to about 50%, about 10% to about 45%, about 10% to about 40%, about 10% to about 35%, about 10% to about 30%, about 10% to about 25%, about 10% to about 20%, about 15% to about 100%, about 15% to about 95%, about 15% to about 90%, about 15% to about 85%, about 15% to about 80%, about 15% to about 75%, about 15% to about 70%, about 15% to about 65%, about 15% to about 60%, about 15% to about 65%, about 15% to about 60%, about 15% to about 55%, about 15% to about 50%, about 15% to about 45%, about 15% to about 40%, about 15% to about 35%, about 15% to about 30%, about 15% to about 25%, about 20% to about 100%, about 20% to about 95%, about 20% to about 90%, about 20% to about 85%, about 20% to about 80%, about 20% to about 75%, about 20% to about 70%, about 20% to about 65%, about 20% to about 60%, about 20% to about 65%, about 20% to about 60%, about 20% to about 55%, about 20% to about 50%, about 20% to about 45%, about 20% to about 40%, about 20% to about 35%, about 20% to about 30%, about 25% to about 100%, about 25% to about 95%, about 25% to about 90%, about 25% to about 85%, about 25% to about 80%, about 25% to about 75%, about 25% to about 70%, about 25% to about 65%, about 25% to about 60%, about 25% to about 65%, about 25% to about 60%, about 25% to about 55%, about 25% to about 50%, about 25% to about 45%, about 25% to about 40%, or about 25% to about 35%, retention. In embodiments, other ASOs useful for this purpose are identified, using, e.g., methods described herein.

In embodiments, the CTNS intron numbering corresponds to the mRNA sequence at NM_001031681 or NM_001031681. In embodiments, the targeted portion of the CTNS RIC pre-mRNA is in intron 9 and/or 10. In embodiments, the targeted portion of the CTNS RIC pre-mRNA is in intron 10. In embodiments, the percent retained intron can be 18%. In embodiments, the targeted portion of the CTNS RIC pre-mRNA is in intron 9. In embodiments, the percent retained intron can be 10%. In embodiments, hybridization of an ASO to the targeted portion of the RIC pre-mRNA results in enhanced splicing at the splice site (5' splice site or 3' splice site) of retained intron 9 and/or 10 and subsequently increases CTNS protein production. It is understood that the intron numbering may change in reference to a different CTNS isoform sequence. One of skill in the art can determine the corresponding intron number in any isoform based on an intron sequence provided herein or using the number provided in reference to the mRNA sequence at NM_001031681 or NM_001031681. One of skill in the art also can determine the sequences of flanking exons in any CTNS isoform for targeting using the methods of the invention, based on an intron sequence provided herein or using the intron number provided in reference to the mRNA sequence at NM_001031681 or NM_001031681.

In embodiments, the PAX2 intron numbering corresponds to the mRNA sequence at NM_001304569, NM_000278, NM_003990, NM_003988, NM_003987 or NM_003989. In embodiments, the targeted portion of the PAX2 RIC pre-mRNA is in intron 1 or 2. In embodiments, hybridization of an ASO to the targeted portion of the RIC pre-mRNA results in enhanced splicing at the splice site (5' splice site or 3' splice site) of retained intron 1 or 2 and subsequently increases PAX2 protein production. It is understood that the intron numbering may change in reference to a different PAX2 isoform sequence. One of skill in the art can determine the corresponding intron number in any isoform based on an intron sequence provided herein or using the number provided in reference to the mRNA sequence at NM_001304569, NM_000278, NM_003990, NM_003988, NM_003987 or NM_003989. One of skill in the art also can determine the sequences of flanking exons in any PAX2 isoform for targeting using the methods of the invention, based on an intron sequence provided herein or using the intron number provided in reference to the mRNA sequence at NM_001304569, NM_000278, NM_003990, NM_003988, NM_003987 or NM_003989.

In embodiments, the CYP24A1 intron numbering corresponds to the mRNA sequence at NM_000782 or NM_001128915. In embodiments, the targeted portion of the CYP24A1 RIC pre-mRNA is in intron 10 and/or 9 or 11. In embodiments, the targeted portion of the CYP24A1 RIC pre-mRNA is in intron 9. In embodiments, the targeted portion of the CYP24A1 RIC pre-mRNA is in intron 11. In embodiments, the percent retained intron can be 23%. In embodiments, the targeted portion of the CYP24A1 RIC pre-mRNA is in intron 10. In embodiments, the percent retained intron can be 50%. In embodiments, hybridization of an ASO to the targeted portion of the RIC pre-mRNA results in enhanced splicing at the splice site (5' splice site or 3' splice site) of retained intron 10 and/or 9 or 11 and subsequently increases CYP24A1 protein production. It is understood that the intron numbering may change in reference to a different CYP24A1 isoform sequence. One of skill in the art can determine the corresponding intron number in any isoform based on an intron sequence provided herein or using the number provided in reference to the mRNA sequence at NM_000782 or NM_001128915. One of skill in the art also can determine the sequences of flanking exons in any CYP24A1 isoform for targeting using the methods of the invention, based on an intron sequence provided herein or using the intron number provided in reference to the mRNA sequence at NM_000782 or NM_001128915.

In embodiments, the PPARD intron numbering corresponds to the mRNA sequence at NM_006238, NM_177435, NM_001171818, NM_001171819 or NM_001171820. In embodiments, the targeted portion of the PPARD RIC pre-mRNA is in intron 3 or 4 or 5 or 6 or 7 and/or 2 or 3 or 4 or 5 or 6 or 7 or 8. In embodiments, the targeted portion of the PPARD RIC pre-mRNA is in intron 2. In embodiments, the targeted portion of the PPARD RIC pre-mRNA is in intron 3. In embodiments, the targeted portion of the PPARD RIC pre-mRNA is in intron 4. In embodiments, the targeted portion of the PPARD RIC pre-mRNA is in intron 5. In embodiments, the targeted portion of the PPARD RIC pre-mRNA is in intron 6. In embodiments, the targeted portion of the PPARD RIC pre-mRNA is in intron 7. In embodiments, the targeted portion of the PPARD RIC pre-mRNA is in intron 8. In embodiments, hybridization of an ASO to the targeted portion of the RIC pre-mRNA results in enhanced splicing at the splice site (5' splice site or 3' splice site) of a retained intron subsequently increases PPARD protein production. It is understood that the intron numbering may change in reference to a different PPARD isoform sequence. One of skill in the art can determine the corresponding intron number in any isoform based on an intron sequence provided herein or using the number provided in reference to the mRNA sequence at NM_006238, NM_177435, NM_001171818, NM_001171819 or NM_001171820. One of skill in the art also can determine the sequences of flanking exons in any PPARD isoform for targeting using the methods of the invention, based on an intron sequence provided herein or using the intron number provided in reference to the mRNA sequence at NM_006238, NM_177435, NM_001171818, NM_001171819 or NM_001171820.

In some embodiments, the ASOs disclosed herein target a RIC pre-mRNA transcribed from a CTNS, PAX2, CYP24A1 or PPARD genomic sequence. In some embodiments, the ASOs disclosed herein target a CTNS, PAX2, CYP24A1 or PPARD RIC pre-mRNA sequence.

In some embodiments, the ASO targets a sequence of a RIC pre-mRNA transcript encoded by a CTNS genomic sequence. In some embodiments, the ASO targets a RIC pre-mRNA transcript encoded by a CTNS genomic sequence comprising retained intron 9 and/or 10. In some embodiments, the ASO targets a RIC pre-mRNA encoded by SEQ ID NO: 140007. In some embodiments, the ASO targets a RIC pre-mRNA transcript of SEQ ID NO: 140020 or 140021. In some embodiments, the ASO targets a RIC pre-mRNA transcript of SEQ ID NO: 140020 or 140021 comprising a retained intron 9 and/or 10. In some embodiments, the ASOs target SEQ ID NO: 150752 and/or 150738. In some embodiments, the ASO comprises a sequence of any one of SEQ ID NOs: 140024-146956.

In some embodiments, the ASO targets a sequence of a RIC pre-mRNA transcript encoded by a PAX2 genomic sequence. In some embodiments, the ASO targets a RIC pre-mRNA transcript encoded by a PAX2 genomic sequence comprising retained intron 1 or 2. In some embodiments, the ASO targets a RIC pre-mRNA transcript encoded by SEQ ID NO: 140006. In some embodiments, the ASO targets a RIC pre-mRNA transcript of one or more of SEQ ID NO: 140014-140019. In some embodiments, the ASO targets a RIC pre-mRNA transcript of one or more of SEQ ID NO: 140014-140019 comprising a retained intron 1 or 2. In some embodiments, the ASOs target SEQ ID NO: 150744 and/or 150742. In some embodiments, the ASO comprises a sequence of any one of SEQ ID NOs: 146957-148627.

In some embodiments, the ASO targets a sequence of a RIC pre-mRNA transcript encoded by a CYP24A1 genomic sequence. In some embodiments, the ASO targets a RIC pre-mRNA transcript encoded by a CYP24A1 genomic sequence comprising retained intron 10 and/or 9 or 11. In some embodiments, the ASO targets a RIC pre-mRNA transcript encoded by SEQ ID NO: 140008. In some embodiments, the ASO targets a RIC pre-mRNA transcript of SEQ ID NO: 18 or 19. In some embodiments, the ASO targets a RIC pre-mRNA transcript of SEQ ID NO: 140022 or 140023 comprising a retained intron 10 and/or 9 or 11. In some embodiments, the ASOs target SEQ ID NOs: 150752, 150738, 150750, 150749 and/or 150745. In some embodiments, the ASO comprises a sequence of any one of SEQ ID NOs: 149524-150737.

In some embodiments, the ASO targets a sequence of a RIC pre-mRNA transcript encoded by a PPARD genomic sequence. In some embodiments, the ASO targets a RIC pre-mRNA transcript encoded by a PPARD genomic sequence comprising retained intron 3 or 4 or 5 or 6 or 7 and/or 2 or 3 or 4 or 5 or 6 or 7 or 8. In some embodiments, the ASO targets a RIC pre-mRNA transcript encoded by SEQ ID NO: 140005. In some embodiments, the ASO targets a RIC pre-mRNA transcript of one or more of SEQ ID NO: 140009-140013. In some embodiments, the ASO targets a RIC pre-mRNA transcript of one or more of SEQ ID NO: 140009-140013 comprising a retained intron 3 or 4 or 5 or 6 or 7 and/or 2 or 3 or 4 or 5 or 6 or 7 or 8. In some embodiments, the ASOs target SEQ ID NO 150740, 150751, 150743, 150747, 150746, 150741, 150739, and/or 150748.

In some embodiments, the ASO comprises a sequence of any one of SEQ ID NOs: 140024-146956.

In some embodiments, the ASO targets exon 9 and/or 10 of a CTNS RIC pre-mRNA comprising a retained intron 9 and/or 10. In some embodiments, the ASO targets an exon 9 and/or 10 sequence upstream (or 5') from the 5' splice site of a CTNS RIC pre-mRNA comprising a retained intron 9 and/or 10.

In some embodiments, the ASO targets intron 9 and/or 10 in a CTNS RIC pre-mRNA comprising a retained intron 9 and/or 10. In some embodiments, the ASO targets an intron 9 and/or 10 sequence downstream (or 3') from the 5' splice site of a CTNS RIC pre-mRNA comprising a retained intron 9 and/or 10.

In some embodiments, the ASO targets an intron 9 and/or 10 sequence upstream (or 5') from the 3' splice site of a CTNS RIC pre-mRNA comprising a retained intron 9 and/or 10.

In some embodiments, the ASO targets exon 10 and/or 11 in a CTNS RIC pre-mRNA comprising a retained intron 9 and/or 10. In some embodiments, the ASO targets an exon 10 and/or 11 sequence downstream (or 3') from the 3' splice site of a CTNS RIC pre-mRNA comprising a retained intron 9 and/or 10.

In some embodiments, the ASO targets exon 1 or 2 of a PAX2 RIC pre-mRNA comprising a retained intron 1 or 2. In some embodiments, the ASO targets an exon 1 or 2 sequence upstream (or 5') from the 5' splice site of a PAX2 RIC pre-mRNA comprising a retained intron 1 or 2.

In some embodiments, the ASO targets intron 1 or 2 in a PAX2 RIC pre-mRNA comprising a retained intron 1 or 2. In some embodiments, the ASO targets an intron 1 or 2 sequence downstream (or 3') from the 5' splice site of a PAX2 RIC pre-mRNA comprising a retained intron 1 or 2.

In some embodiments, the ASO targets an intron 1 or 2 sequence upstream (or 5') from the 3' splice site of a PAX2 RIC pre-mRNA comprising a retained intron 1 or 2.

In some embodiments, the ASO targets exon 2 or 3 in a PAX2 RIC pre-mRNA comprising a retained intron 1 or 2. In some embodiments, the ASO targets an exon 2 or 3 sequence downstream (or 3') from the 3' splice site of a PAX2 RIC pre-mRNA comprising a retained intron 1 or 2.

In some embodiments, the ASO targets exon 10 and/or 9 or 11 of a CYP24A1 RIC pre-mRNA comprising a retained intron 10 and/or 9 or 11. In some embodiments, the ASO targets an exon 10 and/or 9 or 11 sequence upstream (or 5') from the 5' splice site of a CYP24A1 RIC pre-mRNA comprising a retained intron 10 and/or 9 or 11.

In some embodiments, the ASO targets intron 10 and/or 9 or 11 in a CYP24A1 RIC pre-mRNA comprising a retained intron 10 and/or 9 or 11. In some embodiments, the ASO targets an intron 10 and/or 9 or 11 sequence downstream (or 3') from the 5' splice site of a CYP24A1 RIC pre-mRNA comprising a retained intron 10 and/or 9 or 11.

In some embodiments, the ASO targets an intron 10 and/or 9 or 11 sequence upstream (or 5') from the 3' splice site of a CYP24A1 RIC pre-mRNA comprising a retained intron 10 and/or 9 or 11.

In some embodiments, the ASO targets exon 11 and/or 10 or 12 in a CYP24A1 RIC pre-mRNA comprising a retained intron 10 and/or 9 or 11. In some embodiments, the ASO targets an exon 11 and/or 10 or 12 sequence downstream (or 3') from the 3' splice site of a CYP24A1 RIC pre-mRNA comprising a retained intron 10 and/or 9 or 11.

In some embodiments, the ASO targets exon 3 or 4 or 5 or 6 or 7 and/or 2 or 3 or 4 or 5 or 6 or 7 or 8 of a PPARD RIC pre-mRNA comprising a retained intron 3 or 4 or 5 or 6 or 7 and/or 2 or 3 or 4 or 5 or 6 or 7 or 8. In some embodiments, the ASO targets an exon 3 or 4 or 5 or 6 or 7 and/or 2 or 3 or 4 or 5 or 6 or 7 or 8 sequence upstream (or 5') from the 5' splice site of a PPARD RIC pre-mRNA comprising a retained intron 3 or 4 or 5 or 6 or 7 and/or 2 or 3 or 4 or 5 or 6 or 7 or 8.

In some embodiments, the ASO targets intron 3 or 4 or 5 or 6 or 7 and/or 2 or 3 or 4 or 5 or 6 or 7 or 8 in a PPARD RIC pre-mRNA comprising a retained intron 3 or 4 or 5 or 6 or 7 and/or 2 or 3 or 4 or 5 or 6 or 7 or 8. In some embodiments, the ASO targets an intron 3 or 4 or 5 or 6 or 7 and/or 2 or 3 or 4 or 5 or 6 or 7 or 8 sequence downstream (or 3') from the 5' splice site of a PPARD RIC pre-mRNA comprising a retained intron 3 or 4 or 5 or 6 or 7 and/or 2 or 3 or 4 or 5 or 6 or 7 or 8.

In some embodiments, the ASO targets an intron 3 or 4 or 5 or 6 or 7 and/or 2 or 3 or 4 or 5 or 6 or 7 or 8 sequence upstream (or 5') from the 3' splice site of a PPARD RIC pre-mRNA comprising a retained intron 3 or 4 or 5 or 6 or 7 and/or 2 or 3 or 4 or 5 or 6 or 7 or 8.

In some embodiments, the ASO targets exon 4 or 5 or 6 or 7 or 8 and/or 3 or 4 or 5 or 6 or 7 or 8 or 9 in a PPARD RIC pre-mRNA comprising a retained intron 3 or 4 or 5 or 6 or 7 and/or 2 or 3 or 4 or 5 or 6 or 7 or 8. In some embodiments, the ASO targets an exon 4 or 5 or 6 or 7 or 8 and/or 3 or 4 or 5 or 6 or 7 or 8 or 9 sequence downstream (or 3') from the 3' splice site of a PPARD RIC pre-mRNA comprising a retained intron 3 or 4 or 5 or 6 or 7 and/or 2 or 3 or 4 or 5 or 6 or 7 or 8.

Protein Expression

In embodiments, the methods described herein are used to increase the production of a functional protein. As used herein, the term "functional" refers to the amount of activity or function of a protein that is necessary to eliminate any one or more symptoms of a treated condition. In embodiments, the methods are used to increase the production of a partially functional protein. As used herein, the term "partially functional" refers to any amount of activity or function of the protein that is less than the amount of activity or function that is necessary to eliminate or prevent any one or more symptoms of a disease or condition. In some embodiments, a partially functional protein or RNA will have at least 10%, at least 20%, at least 30%, at least 40%, at least 50%, at least 60%, at least 70%, at least 75%, at least 80%, 85%, at least 90%, or at least 95% less activity relative to the fully functional protein or RNA.

In embodiments, the method is a method of increasing the expression of the protein by cells of a subject having a RIC pre-mRNA encoding the protein, wherein the subject has a condition described herein caused by a deficient amount of activity of a protein described herein. In some embodiments, the deficient amount of the protein is caused by haploinsufficiency of the protein. In such an embodiment, the subject has a first allele encoding a functional protein, and a second allele from which the protein is not produced. In another such embodiment, the subject has a first allele encoding a functional protein, and a second allele encoding a nonfunctional protein. In another such embodiment, the subject has a first allele encoding a functional protein, and a second allele encoding a partially functional protein. In any of these embodiments, the antisense oligomer binds to a targeted portion of the RIC pre-mRNA transcribed from the first allele (encoding functional protein), thereby inducing constitutive splicing of the retained intron from the RIC pre-mRNA, and causing an increase in the level of mature mRNA encoding functional protein, and an increase in the expression of the protein in the cells of the subject.

In embodiments, the subject has a first allele encoding a functional protein, and a second allele encoding a partially functional protein, and the antisense oligomer binds to a targeted portion of the RIC pre-mRNA transcribed from the first allele or a targeted portion of the RIC pre-mRNA transcribed from the second allele (encoding partially functional protein), thereby inducing constitutive splicing of the retained intron from the RIC pre-mRNA, and causing an increase in the level of mature mRNA encoding the protein, and an increase in the expression of functional or partially functional protein in the cells of the subject.

In related embodiments, the method is a method of using an ASO to increase the expression of a protein or functional RNA. In embodiments, an ASO is used to increase the expression of a protein described herein in cells of a subject having a RIC pre-mRNA encoding the protein, wherein the subject has a deficiency in the amount or function of the protein.

In embodiments, the RIC pre-mRNA transcript that encodes the protein that is causative of the disease or condition is targeted by the ASOs described herein. In some embodiments, a RIC pre-mRNA transcript that encodes a protein that is not causative of the disease is targeted by the ASOs. For example, a disease that is the result of a mutation or deficiency of a first protein in a particular pathway may be ameliorated by targeting a RIC pre-mRNA that encodes a second protein, thereby increasing production of the second protein. In some embodiments, the function of the second protein is able to compensate for the mutation or deficiency of the first protein (which is causative of the disease or condition).

In embodiments, the subject has:

a. a first mutant allele from which
  i) the protein is produced at a reduced level compared to production from a wild-type allele,
  ii) the protein is produced in a form having reduced function compared to an equivalent wild-type protein, or
  iii) the protein or functional RNA is not produced; and
b. a second mutant allele from which
  i) the protein is produced at a reduced level compared to production from a wild-type allele,
  ii) the protein is produced in a form having reduced function compared to an equivalent wild-type protein, or
  iii) the protein is not produced, and wherein the RIC pre-mRNA is transcribed from the first allele and/or the second allele. In these embodiments, the ASO binds to a targeted portion of the RIC pre-mRNA transcribed from the first allele or the second allele, thereby inducing constitutive splicing of the retained intron from the RIC pre-mRNA, and causing an increase in the level of mRNA encoding a protein and an increase in the expression of the target protein or functional RNA in the cells of the subject. In these embodiments, the target protein or functional RNA having an increase in expression level resulting from the constitutive splicing of the retained intron from the RIC pre-mRNA is either in a form having reduced function compared to the equivalent wild-type protein (partially-functional), or having full function compared to the equivalent wild-type protein (fully-functional).

In embodiments, the level of mRNA encoding a protein described herein is increased 1.1 to 10-fold, when compared to the amount of mRNA encoding the protein that is produced in a control cell, e.g., one that is not treated with the antisense oligomer or one that is treated with an antisense oligomer that does not bind to the targeted portion of the RIC pre-mRNA.

In embodiments, the condition caused by a deficient amount or activity of a protein is not a condition caused by alternative or aberrant splicing of the retained intron to which the ASO is targeted. In embodiments, the condition caused by a deficient amount or activity of the protein is not a condition caused by alternative or aberrant splicing of any retained intron in a RIC pre-mRNA encoding the protein. In embodiments, alternative or aberrant splicing may occur in a pre-mRNA transcribed from the gene, however the compositions and methods of the invention do not prevent or correct this alternative or aberrant splicing.

In embodiments, a subject treated using the methods of the invention expresses a partially functional protein from one allele, wherein the partially functional protein is caused by a frameshift mutation, a nonsense mutation, a missense mutation, or a partial gene deletion. In embodiments, a subject treated using the methods of the invention expresses a nonfunctional protein from one allele, wherein the nonfunctional protein is caused by a frameshift mutation, a nonsense mutation, a missense mutation, a partial gene deletion, in one allele. In embodiments, a subject treated using the methods of the invention has a whole gene deletion, in one allele.

Use of TANGO for Increasing Protein Expression

As described above, in embodiments, Targeted Augmentation of Nuclear Gene Output (TANGO) is used in the methods of the invention to increase expression of a protein. In these embodiments, a retained-intron-containing pre-mRNA (RIC pre-mRNA) encoding a protein is present in the nucleus of a cell. Cells having a RIC pre-mRNA that comprises a retained intron, an exon flanking the 5' splice site, and an exon flanking the 3' splice site, encoding the protein, are contacted with antisense oligomers (ASOs) that are complementary to a targeted portion of the RIC pre-mRNA. Hybridization of the ASOs to the targeted portion of the RIC pre-mRNA results in enhanced splicing at the splice site (5' splice site or 3' splice site) of the retained intron and subsequently increases target protein production.

The terms "pre-mRNA," and "pre-mRNA transcript" may be used interchangeably and refer to any pre-mRNA species that contains at least one intron. In embodiments, pre-mRNA or pre-mRNA transcripts comprise a 5'-7-methylguanosine cap and/or a poly-A tail. In embodiments, pre-mRNA or pre-mRNA transcripts comprise both a 5'-7-methylguanosine cap and a poly-A tail. In some embodiments, the pre-mRNA transcript does not comprise a 5'-7-methylguanosine cap and/or a poly-A tail. A pre-mRNA transcript is a non-productive messenger RNA (mRNA) molecule if it is not translated into a protein (or transported into the cytoplasm from the nucleus).

As used herein, a "retained-intron-containing pre-mRNA" ("RIC pre-mRNA") is a pre-mRNA transcript that contains at least one retained intron. The RIC pre-mRNA contains a retained intron, an exon flanking the 5' splice site of the retained intron, an exon flanking the 3' splice site of the retained intron, and encodes the target protein. An "RIC pre-mRNA encoding a target protein" is understood to encode the target protein when fully spliced. A "retained intron" is any intron that is present in a pre-mRNA transcript when one or more other introns, such as an adjacent intron, encoded by the same gene have been spliced out of the same pre-mRNA transcript. In some embodiments, the retained intron is the most abundant intron in RIC pre-mRNA encoding the target protein. In embodiments, the retained intron is the most abundant intron in a population of RIC pre-mRNAs transcribed from the gene encoding the target protein in a cell, wherein the population of RIC pre-mRNAs comprises two or more retained introns. In embodiments, an antisense oligomer targeted to the most abundant intron in the population of RIC pre-mRNAs encoding the target protein induces splicing out of two or more retained introns in the population, including the retained intron to which the antisense oligomer is targeted or binds. In embodiments, a mature mRNA encoding the target protein is thereby produced. The terms "mature mRNA," and "fully-spliced mRNA," are used interchangeably herein to describe a fully processed mRNA encoding a target protein (e.g., mRNA that is exported from the nucleus into the cytoplasm and translated into target protein) or a fully processed functional RNA. The term "productive mRNA," also can be used to describe a fully processed mRNA encoding a target protein. In embodiments, the targeted region is in a retained intron that is the most abundant intron in a RIC pre-mRNA encoding the protein.

As used herein, the term "comprise" or variations thereof such as "comprises" or "comprising" are to be read to indicate the inclusion of any recited feature (e.g. in the case of an antisense oligomer, a defined nucleobase sequence) but not the exclusion of any other features. Thus, as used herein, the term "comprising" is inclusive and does not exclude additional, unrecited features (e.g. in the case of an antisense oligomer, the presence of additional, unrecited nucleobases).

In embodiments of any of the compositions and methods provided herein, "comprising" may be replaced with "consisting essentially of" or "consisting of" The phrase "consisting essentially of" is used herein to require the specified feature(s) (e.g. nucleobase sequence) as well as those which do not materially affect the character or function of the claimed invention. As used herein, the term "consisting" is used to indicate the presence of the recited feature (e.g. nucleobase sequence) alone (so that in the case of an antisense oligomer consisting of a specified nucleobase sequence, the presence of additional, unrecited nucleobases is excluded).

In embodiments, the targeted region is in a retained intron that is the second most abundant intron in a RIC pre-mRNA encoding a protein described herein. For example, the second most abundant retained intron may be targeted rather than the most abundant retained intron due to the uniqueness of the nucleotide sequence of the second most abundant retained intron, ease of ASO design to target a particular nucleotide sequence, and/or amount of increase in protein production resulting from targeting the intron with an ASO. In embodiments, the retained intron is the second most abundant intron in a population of RIC pre-mRNAs transcribed from the gene encoding the target protein in a cell, wherein the population of RIC pre-mRNAs comprises two or more retained introns. In embodiments, an antisense oligomer targeted to the second most abundant intron in the population of RIC pre-mRNAs encoding the target protein induces splicing out of two or more retained introns in the population, including the retained intron to which the antisense oligomer is targeted or binds. In embodiments, fully-spliced (mature) RNA encoding the target protein is thereby produced.

In embodiments, an ASO is complementary to a targeted region that is within a non-retained intron in a RIC pre-mRNA. In embodiments, the targeted portion of the RIC pre-mRNA is within: the region +6 to +100 relative to the 5' splice site of the non-retained intron; or the region −16 to −100 relative to the 3' splice site of the non-retained intron.

In embodiments, the targeted portion of the RIC pre-mRNA is within the region +100 relative to the 5' splice site of the non-retained intron to −100 relative to the 3' splice site of the non-retained intron. As used to identify the location of a region or sequence, "within" is understood to include the residues at the positions recited. For example, a region +6 to +100 includes the residues at positions +6 and +100. In embodiments, fully-spliced (mature) RNA encoding the target protein is thereby produced.

In embodiments, the retained intron of the RIC pre-mRNA is an inefficiently spliced intron. As used herein, "inefficiently spliced" may refer to a relatively low frequency of splicing at a splice site adjacent to the retained intron (5' splice site or 3' splice site) as compared to the frequency of splicing at another splice site in the RIC pre-mRNA. The term "inefficiently spliced" may also refer to the relative rate or kinetics of splicing at a splice site, in which an "inefficiently spliced" intron may be spliced or removed at a slower rate as compared to another intron in a RIC pre-mRNA.

In embodiments, the 9-nucleotide sequence at −3e to −1e of the exon flanking the 5' splice site and +1 to +6 of the retained intron is identical to the corresponding wild-type sequence. In embodiments, the 16 nucleotide sequence at −15 to −1 of the retained intron and +1e of the exon flanking the 3' splice site is identical to the corresponding wild-type sequence. As used herein, the "wild-type sequence" refers to the nucleotide sequence for a gene in the published reference genome deposited in the NCBI repository of biological and scientific information (operated by National Center for Biotechnology Information, National Library of Medicine, 8600 Rockville Pike, Bethesda, Md. USA 20894). Also used herein, a nucleotide position denoted with an "e" indicates the nucleotide is present in the sequence of an exon (e.g., the exon flanking the 5' splice site or the exon flanking the 3' splice site).

The methods involve contacting cells with an ASO that is complementary to a portion of a pre-mRNA encoding a protein described herein, resulting in increased expression of the protein. As used herein, "contacting" or administering to cells refers to any method of providing an ASO in immediate proximity with the cells such that the ASO and the cells interact. A cell that is contacted with an ASO will take up or transport the ASO into the cell. The method involves contacting a condition or disease-associated or condition or disease-relevant cell with an ASO. In some embodiments, the ASO may be further modified or attached (e.g., covalently attached) to another molecule to target the ASO to a cell type, enhance contact between the ASO and the condition or disease-associated or condition or disease-relevant cell, or enhance uptake of the ASO.

As used herein, the term "increasing protein production" or "increasing expression of a target protein" means enhancing the amount of protein that is translated from an mRNA in a cell. A "target protein" may be any protein for which increased expression/production is desired.

In embodiments, contacting a cell that expresses a RIC pre-mRNA with an ASO that is complementary to a targeted portion of the RIC pre-mRNA transcript results in a measurable increase in the amount of a protein (e.g., a target protein) encoded by the pre-mRNA. Methods of measuring or detecting production of a protein will be evident to one of skill in the art and include any known method, for example, Western blotting, flow cytometry, immunofluorescence microscopy, and ELISA.

In embodiments, contacting cells with an ASO that is complementary to a targeted portion of an RIC pre-mRNA transcript results in an increase in the amount of a protein produced by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of a protein produced by the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the amount of target protein produced by an control compound. A control compound can be, for example, an oligonucleotide that is not complementary to the targeted portion of the RIC pre-mRNA.

In some embodiments, contacting cells with an ASO that is complementary to a targeted portion of an RIC pre-mRNA transcript results in an increase in the amount of mRNA encoding a protein, including the mature mRNA encoding the target protein. In some embodiments, the amount of mRNA encoding a protein, or the mature mRNA encoding the protein, is increased by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In embodiments, the total amount of the mRNA encoding a protein, or the mature mRNA encoding a protein produced in the cell to which the antisense oligomer was contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold compared to the amount of mature RNA produced in an untreated cell, e.g., an untreated cell or a cell treated with a control compound. A control compound can be, for example, an oligonucleotide that is not complementary to the targeted portion of the RIC pre-mRNA.

Constitutive Splicing of a Retained Intron from a RIC pre-mRNA

The methods and antisense oligonucleotide compositions provided herein are useful for increasing the expression of a protein in cells, for example, in a subject having a condition described herein caused by a deficiency in the amount or activity of a protein described herein, by increasing the level of mRNA encoding the protein, or the mature mRNA encoding the protein. In particular, the methods and compositions as described herein induce the constitutive splicing of a retained intron from an RIC pre-mRNA transcript encoding the protein, thereby increasing the level of mRNA encoding the protein, or the mature mRNA encoding the protein and increasing the expression of the protein.

Constitutive splicing of a retained intron from a RIC pre-mRNA correctly removes the retained intron from the RIC pre-mRNA, wherein the retained intron has wild-type splice sequences. Constitutive splicing, as used herein, does not encompass splicing of a retained intron from a RIC pre-mRNA transcribed from a gene or allele having a mutation that causes alternative splicing or aberrant splicing of a pre-mRNA transcribed from the gene or allele. For example, constitutive splicing of a retained intron, as induced using the methods and antisense oligonucleotides provided herein, does not correct aberrant splicing in or influence alternative splicing of a pre-mRNA to result in an increased expression of a target protein or functional RNA.

In embodiments, constitutive splicing correctly removes a retained intron from an RIC pre-mRNA, wherein the RIC pre-mRNA is transcribed from a wild-type gene or allele, or a polymorphic gene or allele, that encodes a fully-functional target protein or functional RNA, and wherein the gene or allele does not have a mutation that causes alternative splicing or aberrant splicing of the retained intron.

In some embodiments, constitutive splicing of a retained intron from an RIC pre-mRNA encoding a protein correctly removes a retained intron from an RIC pre-mRNA encoding the protein, wherein the RIC pre-mRNA is transcribed from a gene or allele from which the target gene or functional RNA is produced at a reduced level compared to production from a wild-type allele, and wherein the gene or allele does not have a mutation that causes alternative splicing or aberrant splicing of the retained intron. In these embodiments, the correct removal of the constitutively spliced retained intron results in production of target protein or functional RNA that is functional when compared to an equivalent wild-type protein or functional RNA.

In other embodiments, constitutive splicing correctly removes a retained intron from an RIC pre-mRNA, wherein the RIC pre-mRNA is transcribed from a gene or allele that encodes a target protein or functional RNA produced in a form having reduced function compared to an equivalent wild-type protein or functional RNA, and wherein the gene or allele does not have a mutation that causes alternative splicing or aberrant splicing of the retained intron. In these embodiments, the correct removal of the constitutively spliced retained intron results in production of partially functional target protein, or functional RNA that is partially functional when compared to an equivalent wild-type protein or functional RNA.

"Correct removal" of the retained intron by constitutive splicing refers to removal of the entire intron, without removal of any part of an exon.

In embodiments, an antisense oligomer as described herein or used in any method described herein does not increase the amount of mRNA encoding a protein or the amount of a protein by modulating alternative splicing or aberrant splicing of a pre-mRNA transcribed from the gene. Modulation of alternative splicing or aberrant splicing can be measured using any known method for analyzing the sequence and length of RNA species, e.g., by RT-PCR and using methods described elsewhere herein and in the literature. In embodiments, modulation of alternative or aberrant splicing is determined based on an increase or decrease in the amount of the spliced species of interest of at least 10% or 1.1-fold. In embodiments, modulation is determined based on an increase or decrease at a level that is at least 10% to 100% or 1.1 to 10-fold, as described herein regarding determining an increase in mRNA encoding the protein in the methods of the invention.

In embodiments, the method is a method wherein the RIC pre-mRNA was produced by partial splicing of a wild-type pre-mRNA. In embodiments, the method is a method wherein the RIC pre-mRNA was produced by partial splicing of a full-length wild-type pre-mRNA. In embodiments, the RIC pre-mRNA was produced by partial splicing of a full-length pre-mRNA. In these embodiments, a full-length pre-mRNA may have a polymorphism in a splice site of the retained intron that does not impair correct splicing of the retained intron as compared to splicing of the retained intron having the wild-type splice site sequence.

In embodiments, the mRNA encoding a protein is a full-length mature mRNA, or a wild-type mature mRNA. In these embodiments, a full-length mature mRNA may have a polymorphism that does not affect the activity of the target protein or the functional RNA encoded by the mature mRNA, as compared to the activity of the protein encoded by the wild-type mature mRNA.

Antisense Oligomers

One aspect of the present disclosure is a composition comprising antisense oligomers that enhances splicing by binding to a targeted portion of an RIC pre-mRNA. As used herein, the terms "ASO" and "antisense oligomer" are used interchangeably and refer to an oligomer such as a polynucleotide, comprising nucleobases, that hybridizes to a target nucleic acid (e.g., an RIC pre-mRNA) sequence by Watson-Crick base pairing or wobble base pairing (G-U). The ASO may have exact sequence complementary to the target sequence or near complementarity (e.g., sufficient complementarity to bind the target sequence and enhancing splicing at a splice site). ASOs are designed so that they bind (hybridize) to a target nucleic acid (e.g., a targeted portion of a pre-mRNA transcript) and remain hybridized under physiological conditions. Typically, if they hybridize to a site other than the intended (targeted) nucleic acid sequence, they hybridize to a limited number of sequences that are not a target nucleic acid (to a few sites other than a target nucleic acid). Design of an ASO can take into consideration the occurrence of the nucleic acid sequence of the targeted portion of the pre-mRNA transcript or a sufficiently similar nucleic acid sequence in other locations in the genome or cellular pre-mRNA or transcriptome, such that the likelihood the ASO will bind other sites and cause "off-target" effects is limited. Any antisense oligomers known in the art, for example in PCT Application No. PCT/US2014/054151, published as WO 2015/035091, titled "Reducing Nonsense-Mediated mRNA Decay," can be used to practice the methods described herein.

In some embodiments, ASOs "specifically hybridize" to or are "specific" to a target nucleic acid or a targeted portion of a RIC pre-mRNA. Typically such hybridization occurs with a Tm substantially greater than 37° C., preferably at least 50° C., and typically between 60° C. to approximately 90° C. Such hybridization preferably corresponds to stringent hybridization conditions. At a given ionic strength and pH, the Tm is the temperature at which 50% of a target sequence hybridizes to a complementary oligonucleotide.

Oligomers, such as oligonucleotides, are "complementary" to one another when hybridization occurs in an antiparallel configuration between two single-stranded polynucleotides. A double-stranded polynucleotide can be "complementary" to another polynucleotide, if hybridization can occur between one of the strands of the first polynucleotide and the second. Complementarity (the degree to which one polynucleotide is complementary with another) is quantifiable in terms of the proportion (e.g., the percentage) of bases in opposing strands that are expected to form hydrogen bonds with each other, according to generally accepted base-pairing rules. The sequence of an antisense oligomer (ASO) need not be 100% complementary to that of its target nucleic acid to hybridize. In certain embodiments, ASOs can comprise at least 70%, at least 75%, at least 80%, at least 85%, at least 90%, at least 95%, at least 96%, at least 97%, at least 98%, or at least 99% sequence complementarity to a target region within the target nucleic acid sequence to which they are targeted. For example, an ASO in which 18 of 20 nucleobases of the oligomeric compound are complementary to a target region, and would therefore specifically hybridize, would represent 90 percent complementarity. In this example, the remaining non-complementary nucleobases may be clustered together or interspersed with complementary nucleobases and need not be contiguous to each other or to complementary nucleobases. Percent complementarity of an ASO with a region of a target nucleic acid can be determined routinely using BLAST programs (basic local alignment search tools) and PowerBLAST programs known in the art (Altschul et al., J. Mol. Biol., 1990, 215, 403-410; Zhang and Madden, Genome Res., 1997, 7, 649-656).

An ASO need not hybridize to all nucleobases in a target sequence and the nucleobases to which it does hybridize may be contiguous or noncontiguous. ASOs may hybridize over one or more segments of a pre-mRNA transcript, such that intervening or adjacent segments are not involved in the hybridization event (e.g., a loop structure or hairpin structure may be formed). In certain embodiments, an ASO hybridizes to noncontiguous nucleobases in a target pre-mRNA transcript. For example, an ASO can hybridize to nucleobases in a pre-mRNA transcript that are separated by one or more nucleobase(s) to which the ASO does not hybridize.

The ASOs described herein comprise nucleobases that are complementary to nucleobases present in a target portion of a RIC pre-mRNA. The term ASO embodies oligonucleotides and any other oligomeric molecule that comprises nucleobases capable of hybridizing to a complementary nucleobase on a target mRNA but does not comprise a sugar moiety, such as a peptide nucleic acid (PNA). The ASOs may comprise naturally-occurring nucleotides, nucleotide analogs, modified nucleotides, or any combination of two or three of the preceding. The term "naturally occurring nucleotides" includes deoxyribonucleotides and ribonucleotides. The term "modified nucleotides" includes nucleotides with modified or substituted sugar groups and/or having a modified backbone. In some embodiments, all of the nucleotides of the ASO are modified nucleotides. Chemical modifications of ASOs or components of ASOs that are compatible with the methods and compositions described herein will be evident to one of skill in the art and can be found, for example, in U.S. Pat. No. 8,258,109 B2, U.S. Pat. No. 5,656,612, U.S. Patent Publication No. 2012/0190728, and Dias and Stein, Mol. Cancer Ther. 2002, 1, 347-355, herein incorporated by reference in their entirety.

The nucleobase of an ASO may be any naturally occurring, unmodified nucleobase such as adenine, guanine, cytosine, thymine and uracil, or any synthetic or modified nucleobase that is sufficiently similar to an unmodified nucleobase such that it is capable of hydrogen bonding with a nucleobase present on a target pre-mRNA. Examples of modified nucleobases include, without limitation, hypoxanthine, xanthine, 7-methylguanine, 5,6-dihydrouracil, 5-methylcytosine, and 5-hydroxymethoylcytosine.

The ASOs described herein also comprise a backbone structure that connects the components of an oligomer. The term "backbone structure" and "oligomer linkages" may be used interchangeably and refer to the connection between monomers of the ASO. In naturally occurring oligonucleotides, the backbone comprises a 3'-5' phosphodiester linkage connecting sugar moieties of the oligomer. The backbone structure or oligomer linkages of the ASOs described herein may include (but are not limited to) phosphorothioate, phosphorodithioate, phosphoroselenoate, phosphorodiselenoate, phosphoroanilothioate, phosphoraniladate, phosphoramidate, and the like. See e.g., LaPlanche et al., Nucleic Acids Res. 14:9081 (1986); Stec et al., J. Am. Chem. Soc. 106:6077 (1984), Stein et al., Nucleic Acids Res. 16:3209 (1988), Zon et al., Anti Cancer Drug Design 6:539 (1991); Zon et al., Oligonucleotides and Analogues: A Practical Approach, pp. 87-108 (F. Eckstein, Ed., Oxford University Press, Oxford England (1991)); Stec et al., U.S. Pat. No. 5,151,510; Uhlmann and Peyman, Chemical Reviews 90:543 (1990). In some embodiments, the backbone structure of the ASO does not contain phosphorous but rather contains peptide bonds, for example in a peptide nucleic acid (PNA), or linking groups including carbamate, amides, and linear and cyclic hydrocarbon groups. In some embodiments, the backbone modification is a phosphorothioate linkage. In some embodiments, the backbone modification is a phosphoramidate linkage.

In embodiments, the stereochemistry at each of the phosphorus internucleotide linkages of the ASO backbone is random. In embodiments, the stereochemistry at each of the phosphorus internucleotide linkages of the ASO backbone is controlled and is not random. For example, U.S. Pat. App. Pub. No. 2014/0194610, "Methods for the Synthesis of Functionalized Nucleic Acids," incorporated herein by reference, describes methods for independently selecting the handedness of chirality at each phosphorous atom in a nucleic acid oligomer. In embodiments, an ASO used in the methods of the invention comprises an ASO having phosphorus internucleotide linkages that are not random. In embodiments, a composition used in the methods of the invention comprises a pure diastereomeric ASO. In embodiments, a composition used in the methods of the invention comprises an ASO that has diastereomeric purity of at least about 90%, at least about 91%, at least about 92%, at least about 93%, at least about 94%, at least about 95%, at least about 96%, at least about 97%, at least about 98%, at least about 99%, about 100%, about 90% to about 100%, about 91% to about 100%, about 92% to about 100%, about 93% to about 100%, about 94% to about 100%, about 95% to about 100%, about 96% to about 100%, about 97% to about 100%, about 98% to about 100%, or about 99% to about 100%.

In embodiments, the ASO has a nonrandom mixture of Rp and Sp configurations at its phosphorus internucleotide linkages. For example, it has been suggested that a mix of Rp and Sp is required in antisense oligonucleotides to achieve a balance between good activity and nuclease stability (Wan, et al., 2014, "Synthesis, biophysical properties and biological activity of second generation antisense oligonucleotides containing chiral phosphorothioate linkages," Nucleic Acids Research 42(22): 13456-13468, incorporated herein by reference). In embodiments, an ASO used in the methods of the invention comprises about 5-100% Rp, at least about 5% Rp, at least about 10% Rp, at least about 15% Rp, at least about 20% Rp, at least about 25% Rp, at least about 30% Rp, at least about 35% Rp, at least about 40% Rp, at least about 45% Rp, at least about 50% Rp, at least about 55% Rp, at least about 60% Rp, at least about 65% Rp, at least about 70% Rp, at least about 75% Rp, at least about 80% Rp, at least about 85% Rp, at least about 90% Rp, or at least about 95% Rp, with the remainder Sp, or about 100% Rp. In embodiments, an ASO used in the methods of the invention comprises about 10% to about 100% Rp, about 15% to about 100% Rp, about 20% to about 100% Rp, about 25% to about 100% Rp, about 30% to about 100% Rp, about 35% to about 100% Rp, about 40% to about 100% Rp, about 45% to about 100% Rp, about 50% to about 100% Rp, about 55% to about 100% Rp, about 60% to about 100% Rp, about 65% to about 100% Rp, about 70% to about 100% Rp, about 75% to about 100% Rp, about 80% to about 100% Rp, about 85% to about 100% Rp, about 90% to about 100% Rp, or about 95% to about 100% Rp, about 20% to about 80% Rp, about 25% to about 75% Rp, about 30% to about 70% Rp, about 40% to about 60% Rp, or about 45% to about 55% Rp, with the remainder Sp.

In embodiments, an ASO used in the methods of the invention comprises about 5-100% Sp, at least about 5% Sp, at least about 10% Sp, at least about 15% Sp, at least about 20% Sp, at least about 25% Sp, at least about 30% Sp, at least about 35% Sp, at least about 40% Sp, at least about 45% Sp, at least about 50% Sp, at least about 55% Sp, at least about 60% Sp, at least about 65% Sp, at least about 70% Sp, at least about 75% Sp, at least about 80% Sp, at least about 85% Sp, at least about 90% Sp, or at least about 95% Sp, with the remainder Rp, or about 100% Sp. In embodiments, an ASO used in the methods of the invention comprises about 10% to about 100% Sp, about 15% to about 100% Sp, about 20% to about 100% Sp, about 25% to about 100% Sp, about 30% to about 100% Sp, about 35% to about 100% Sp, about 40% to about 100% Sp, about 45% to about 100% Sp, about 50% to about 100% Sp, about 55% to about 100% Sp, about 60% to about 100% Sp, about 65% to about 100% Sp, about 70% to about 100% Sp, about 75% to about 100% Sp, about 80% to about 100% Sp, about 85% to about 100% Sp, about 90% to about 100% Sp, or about 95% to about 100% Sp, about 20% to about 80% Sp, about 25% to about 75% Sp, about 30% to about 70% Sp, about 40% to about 60% Sp, or about 45% to about 55% Sp, with the remainder Rp.

Any of the ASOs described herein may contain a sugar moiety that comprises ribose or deoxyribose, as present in naturally occurring nucleotides, or a modified sugar moiety or sugar analog, including a morpholine ring. Non-limiting examples of modified sugar moieties include 2' substitutions such as 2'-O-methyl (2'-O-Me), 2'-O-methoxyethyl (2'MOE), 2'-O-aminoethyl, 2'F; N3'→P5' phosphoramidate, 2'dimethylaminooxyethoxy, 2'dimethylaminoethoxyethoxy, 2'-guanidinidium, 2'-O-guanidinium ethyl, carbamate modified sugars, and bicyclic modified sugars. In some embodiments, the sugar moiety modification is selected from 2'-O-Me, 2'F, and 2'MOE. In some embodiments, the sugar moiety modification is an extra bridge bond, such as in a locked nucleic acid (LNA). In some embodiments the sugar analog contains a morpholine ring, such as phosphorodiamidate morpholino (PMO). In some embodiments, the sugar moiety comprises a ribofuransyl or 2'deoxyribofuransyl modification. In some embodiments, the sugar moiety comprises 2'4'-constrained 2'O-methyloxyethyl (cMOE) modifications. In some embodiments, the sugar moiety comprises cEt 2', 4' constrained 2'-O ethyl BNA modifications. In some embodiments, the sugar moiety comprises tricycloDNA (tcDNA) modifications. In some embodiments, the sugar moiety comprises ethylene nucleic acid (ENA) modifications. In some embodiments, the sugar moiety comprises MCE modifications. Modifications are known in the art and described in the literature, e.g., by Jarver, et al., 2014, "A Chemical View of Oligonucleotides for Exon Skipping and Related Drug Applications," Nucleic Acid Therapeutics 24(1): 37-47, incorporated by reference for this purpose herein.

In some examples, each monomer of the ASO is modified in the same way, for example each linkage of the backbone of the ASO comprises a phosphorothioate linkage or each ribose sugar moiety comprises a 2'O-methyl modification. Such modifications that are present on each of the monomer components of an ASO are referred to as "uniform modifications." In some examples, a combination of different modifications may be desired, for example, an ASO may comprise a combination of phosphorodiamidate linkages and sugar moieties comprising morpholine rings (morpholinos). Combinations of different modifications to an ASO are referred to as "mixed modifications" or "mixed chemistries."

In some embodiments, the ASO comprises one or more backbone modification. In some embodiments, the ASO comprises one or more sugar moiety modification. In some embodiments, the ASO comprises one or more backbone modification and one or more sugar moiety modification. In some embodiments, the ASO comprises 2'MOE modifications and a phosphorothioate backbone. In some embodiments, the ASO comprises a phosphorodiamidate morpholino (PMO). In some embodiments, the ASO comprises a peptide nucleic acid (PNA). Any of the ASOs or any component of an ASO (e.g., a nucleobase, sugar moiety, backbone) described herein may be modified in order to achieve desired properties or activities of the ASO or reduce undesired properties or activities of the ASO. For example, an ASO or one or more component of any ASO may be modified to enhance binding affinity to a target sequence on a pre-mRNA transcript; reduce binding to any non-target sequence; reduce degradation by cellular nucleases (i.e., RNase H); improve uptake of the ASO into a cell and/or into the nucleus of a cell; alter the pharmacokinetics or pharmacodynamics of the ASO; and modulate the half-life of the ASO.

In some embodiments, the ASOs are comprised of 2'-O-(2-methoxyethyl) (MOE) phosphorothioate-modified nucleotides. ASOs comprised of such nucleotides are especially well-suited to the methods disclosed herein; oligomers having such modifications have been shown to have significantly enhanced resistance to nuclease degradation and increased bioavailability, making them suitable, for example, for oral delivery in some embodiments described herein. See e.g., Geary et al., J Pharmacol Exp Ther. 2001; 296(3):890-7; Geary et al., J Pharmacol Exp Ther. 2001; 296(3):898-904.

Methods of synthesizing ASOs will be known to one of skill in the art. Alternatively or in addition, ASOs may be obtained from a commercial source.

Unless specified otherwise, the left-hand end of single-stranded nucleic acid (e.g., pre-mRNA transcript, oligonucleotide, ASO, etc.) sequences is the 5' end and the left-hand direction of single or double-stranded nucleic acid sequences is referred to as the 5' direction. Similarly, the right-hand end or direction of a nucleic acid sequence (single or double stranded) is the 3' end or direction. Generally, a region or sequence that is 5' to a reference point in a nucleic acid is referred to as "upstream," and a region or sequence that is 3' to a reference point in a nucleic acid is referred to as "downstream." Generally, the 5' direction or end of an mRNA is where the initiation or start codon is located, while the 3' end or direction is where the termination codon is located. In some aspects, nucleotides that are upstream of a reference point in a nucleic acid may be designated by a negative number, while nucleotides that are downstream of a reference point may be designated by a positive number. For example, a reference point (e.g., an exon-exon junction in mRNA) may be designated as the "zero" site, and a nucleotide that is directly adjacent and upstream of the reference point is designated "minus one," e.g., "−1," while a nucleotide that is directly adjacent and downstream of the reference point is designated "plus one," e.g., "+1."

In other embodiments, the ASOs are complementary to (and bind to) a targeted portion of a CTNS, PAX2, CYP24A1 or PPARD RIC pre-mRNA that is downstream (in the 3' direction) of the 5' splice site of the retained intron in a CTNS, PAX2, CYP24A1 or PPARD RIC pre-mRNA (e.g., the direction designated by positive numbers relative to the 5' splice site) (FIG. 1). In some embodiments, the ASOs are complementary to a targeted portion of the CTNS, PAX2, CYP24A1 or PPARD RIC pre-mRNA that is within the region 1 to +4000, 1 to +3500, 1 to +3000, 1 to +2500, 1 to +2000, 1 to +1500, 1 to +1000, 1 to +500, +2 to +4000, +2 to +3500, +2 to +3000, +2 to +2500, +2 to +2000, +2 to +1500, +2 to +1000, +2 to +500, +2 to +400, +2 to +300, +2 to +200, +6 to +4000, +6 to +3500, +6 to +3000, +6 to +2500, +6 to +2000, +6 to +1500, +6 to +1000, +6 to +500, +6 to +400, +6 to +300, +6 to +200, or +6 to +100 relative to the 5' splice site of the retained intron. In some embodiments, the ASO is not complementary to nucleotides +1 to +5 relative to the 5' splice site (the first five nucleotides located downstream of the 5' splice site). In some embodiments, the ASOs may be complementary to a targeted portion of a CTNS, PAX2, CYP24A1 or PPARD RIC pre-mRNA that is within the region between nucleotides +6 and +50 relative to the 5' splice site of the retained intron. In some aspects, the ASOs are complementary to a targeted portion of the CTNS, PAX2, CYP24A1 or PPARD RIC pre-mRNA that is within the region +6 to +90, +6 to +80, +6 to +70, +6 to +60, +6 to +50, +6 to +40, +6 to +30, or +6 to +20 relative to 5' splice site of the retained intron.

In some embodiments, the ASOs are complementary to a targeted region of a CTNS, PAX2, CYP24A1 or PPARD RIC pre-mRNA that is upstream (5' relative) of the 3' splice site of the retained intron in an RIC pre-mRNA (e.g., in the direction designated by negative numbers) (FIG. 1). In some embodiments, the ASOs are complementary to a targeted portion of the CTNS, PAX2, CYP24A1 or PPARD RIC pre-mRNA that is within the region −16 to −4000, −16 to −3000, −16 to −2000, −16 to −1000, −16 to −500, −16 to −400, −16 to −300, −6 to −200, or −16 to −100 relative to the 3' splice site of the retained intron. In some embodiments, the ASO is not complementary to nucleotides −1 to −15 relative to the 3' splice site (the first 15 nucleotides located upstream of the 3' splice site). In some embodiments, the ASOs are complementary to a targeted portion of the CTNS, PAX2, CYP24A1 or PPARD RIC pre-mRNA that is within the region −16 to −50 relative to the 3' splice site of the retained intron. In some aspects, the ASOs are complementary to a targeted portion of the CTNS, PAX2, CYP24A1 or PPARD RIC pre-mRNA that is within the region −16 to −90, −16 to −80, −16 to −70, −16 to −60, −16 to −50, −16 to −40, or −16 to −30 relative to 3' splice site of the retained intron.

In embodiments, the targeted portion of the RIC pre-mRNA is within the region +100 relative to the 5' splice site of the retained intron to −100 relative to the 3' splice site of the retained intron.

In some embodiments, the ASOs are complementary to a targeted portion of a CTNS, PAX2, CYP24A1 or PPARD RIC pre-mRNA that is within the exon flanking the 5' splice site (upstream) of the retained intron (FIG. 1). In some embodiments, the ASOs are complementary to a targeted portion of the RIC pre-mRNA that is within the region +2e to −4e in the exon flanking the 5' splice site of the retained intron. In some embodiments, the ASOs are not complementary to nucleotides −1e to −3e relative to the 5' splice site of the retained intron. In some embodiments, the ASOs are complementary to a targeted portion of the CTNS, PAX2, CYP24A1 or PPARD RIC pre-mRNA that is within the region −4e to −100e, −4e to −90e, −4e to −80e, −4e to −70e, −4e to −60e, −4e to −50e, −4 to −40e, −4e to −30e, or −4e to −20e relative to the 5' splice site of the retained intron.

In some embodiments, the ASOs are complementary to a targeted portion of a CTNS, PAX2, CYP24A1 or PPARD RIC pre-mRNA that is within the exon flanking the 3' splice site (downstream) of the retained intron (FIG. 1). In some embodiments, the ASOs are complementary to a targeted portion to the CTNS, PAX2, CYP24A1 or PPARD RIC pre-mRNA that is within the region +2e to −4e in the exon flanking the 3' splice site of the retained intron. In some embodiments, the ASOs are not complementary to nucleotide +1e relative to the 3' splice site of the retained intron. In some embodiments, the ASOs are complementary to a targeted portion of the CTNS, PAX2, CYP24A1 or PPARD RIC pre-mRNA that is within the region +2e to +100e, +2e to +90e, +2e to +80e, +2e to +70e, +2e to +60e, +2e to +50e, +2e to +40e, +2e to +30e, or +2 to +20e relative to the 3' splice site of the retained intron. The ASOs may be of any length suitable for specific binding and effective enhancement of splicing. In some embodiments, the ASOs consist of 8 to 50 nucleobases. For example, the ASO may be 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, or 50 nucleobases in length. In some embodiments, the ASOs consist of more than 50 nucleobases. In some embodiments, the ASO is from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, 12 to 15 nucleobases, 13 to 50 nucleobases, 13 to 40 nucleobases, 13 to 35 nucleobases, 13 to 30 nucleobases, 13 to 25 nucleobases, 13 to 20 nucleobases, 14 to 50 nucleobases, 14 to 40 nucleobases, 14 to 35 nucleobases, 14 to 30 nucleobases, 14 to 25 nucleobases, 14 to 20 nucleobases, 15 to 50 nucleobases, 15 to 40 nucleobases, 15 to 35 nucleobases, 15 to 30 nucleobases, 15 to 25 nucleobases, 15 to 20 nucleobases, 20 to 50 nucleobases, 20 to 40 nucleobases, 20 to 35 nucleobases, 20 to 30 nucleobases, 20 to 25 nucleobases, 25 to 50 nucleobases, 25 to 40 nucleobases, 25 to 35 nucleobases, or 25 to 30 nucleobases in length. In some embodiments, the ASOs are 30 nucleotides in length. In some embodiments, the ASOs are 29 nucleotides in length. In some embodiments, the ASOs are 28 nucleotides in length. In some embodiments, the ASOs are 27 nucleotides in length. In some embodiments, the ASOs are 26 nucleotides in length. In some embodiments, the ASOs are 25 nucleotides in length. In some embodiments, the ASOs are 24 nucleotides in length. In some embodiments, the ASOs are 23 nucleotides in length. In some embodiments, the ASOs are 22 nucleotides in length. In some embodiments, the ASOs are 21 nucleotides in length. In some embodiments, the ASOs are 20 nucleotides in length. In some embodiments, the ASOs are 19 nucleotides in length. In some embodiments, the ASOs are 18 nucleotides in length. In some embodiments, the ASOs are 17 nucleotides in length. In some embodiments, the ASOs are 16 nucleotides in length. In some embodiments, the ASOs are 15 nucleotides in length. In some embodiments, the ASOs are 14 nucleotides in length. In some embodiments, the ASOs are 13 nucleotides in length. In some embodiments, the ASOs are 12 nucleotides in length. In some embodiments, the ASOs are 11 nucleotides in length. In some embodiments, the ASOs are 10 nucleotides in length.

In some embodiments, two or more ASOs with different chemistries but complementary to the same targeted portion of the RIC pre-mRNA are used. In some embodiments, two or more ASOs that are complementary to different targeted portions of the RIC pre-mRNA are used.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties, and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

In some embodiments, the nucleic acid to be targeted by an ASO is an RIC pre-mRNA expressed in a cell, such as a eukaryotic cell. In some embodiments, the term "cell" may refer to a population of cells. In some embodiments, the cell is in a subject. In some embodiments, the cell is isolated from a subject. In some embodiments, the cell is ex vivo. In some embodiments, the cell is a condition or disease-relevant cell or a cell line. In some embodiments, the cell is in vitro (e.g., in cell culture).

Pharmaceutical Compositions

Pharmaceutical compositions or formulations comprising the antisense oligonucleotide of the described compositions and for use in any of the described methods can be prepared according to conventional techniques well known in the pharmaceutical industry and described in the published literature. In embodiments, a pharmaceutical composition or formulation for treating a subject comprises an effective amount of any antisense oligomer as described above, or a pharmaceutically acceptable salt, solvate, hydrate or ester thereof, and a pharmaceutically acceptable diluent. The antisense oligomer of a pharmaceutical formulation may further comprise a pharmaceutically acceptable excipient, diluent or carrier.

Pharmaceutically acceptable salts are suitable for use in contact with the tissues of humans and lower animals without undue toxicity, irritation, allergic response, etc., and are commensurate with a reasonable benefit/risk ratio. (See, e.g., S. M. Berge, et al., J. Pharmaceutical Sciences, 66: 1-19 (1977), incorporated herein by reference for this purpose. The salts can be prepared in situ during the final isolation and purification of the compounds, or separately by reacting the free base function with a suitable organic acid. Examples of pharmaceutically acceptable, nontoxic acid addition salts are salts of an amino group formed with inorganic acids such as hydrochloric acid, hydrobromic acid, phosphoric acid, sulfuric acid and perchloric acid or with organic acids such as acetic acid, oxalic acid, maleic acid, tartaric acid, citric acid, succinic acid or malonic acid or by using other documented methodologies such as ion exchange. Other pharmaceutically acceptable salts include adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, lower alkyl sulfonate and aryl sulfonate.

In embodiments, the compositions are formulated into any of many possible dosage forms such as, but not limited to, tablets, capsules, gel capsules, liquid syrups, soft gels, suppositories, and enemas. In embodiments, the compositions are formulated as suspensions in aqueous, non-aqueous or mixed media. Aqueous suspensions may further contain substances that increase the viscosity of the suspension including, for example, sodium carboxymethylcellulose, sorbitol and/or dextran. The suspension may also contain stabilizers. In embodiments, a pharmaceutical formulation or composition of the present invention includes, but is not limited to, a solution, emulsion, microemulsion, foam or liposome-containing formulation (e.g., cationic or noncationic liposomes).

The pharmaceutical composition or formulation of the present invention may comprise one or more penetration enhancer, carrier, excipients or other active or inactive ingredients as appropriate and well known to those of skill in the art or described in the published literature. In embodiments, liposomes also include sterically stabilized liposomes, e.g., liposomes comprising one or more specialized lipids. These specialized lipids result in liposomes with enhanced circulation lifetimes. In embodiments, a sterically stabilized liposome comprises one or more glycolipids or is derivatized with one or more hydrophilic polymers, such as a polyethylene glycol (PEG) moiety. In embodiments, a surfactant is included in the pharmaceutical formulation or compositions. The use of surfactants in drug products, formulations and emulsions is well known in the art. In embodiments, the present invention employs a penetration enhancer to effect the efficient delivery of the antisense oligonucleotide, e.g., to aid diffusion across cell membranes and/or enhance the permeability of a lipophilic drug. In embodiments, the penetration enhancers is a surfactant, fatty acid, bile salt, chelating agent, or non-chelating nonsurfactant.

In embodiments, the pharmaceutical formulation comprises multiple antisense oligonucleotides. In embodiments, the antisense oligonucleotide is administered in combination with another drug or therapeutic agent. In embodiments, the antisense oligonucleotide is administered with one or more agents capable of promoting penetration of the subject antisense oligonucleotide across the blood-brain barrier by any method known in the art. For example, delivery of agents by administration of an adenovirus vector to motor neurons in muscle tissue is described in U.S. Pat. No. 6,632,427, "Adenoviral-vector-mediated gene transfer into medullary motor neurons," incorporated herein by reference. Delivery of vectors directly to the brain, e.g., the striatum, the thalamus, the hippocampus, or the substantia nigra, is described, e.g., in U.S. Pat. No. 6,756,523, "Adenovirus vectors for the transfer of foreign genes into cells of the central nervous system particularly in brain," incorporated herein by reference.

In embodiments, the antisense oligonucleotides are linked or conjugated with agents that provide desirable pharmaceutical or pharmacodynamic properties. In embodiments, the antisense oligonucleotide is coupled to a substance, known in the art to promote penetration or transport across the blood-brain barrier, e.g., an antibody to the transferrin receptor. In embodiments, the antisense oligonucleotide is linked with a viral vector, e.g., to render the antisense compound more effective or increase transport across the blood-brain barrier. In embodiments, osmotic blood brain barrier disruption is assisted by infusion of sugars, e.g., meso erythritol, xylitol, D(+) galactose, D(+) lactose, D(+) xylose, dulcitol, myo-inositol, L(−) fructose, D(−) mannitol, D(+) glucose, D(+) arabinose, D(−) arabinose, cellobiose, D(+) maltose, D(+) raffinose, L(+) rhamnose, D(+) melibiose, D(−) ribose, adonitol, D(+) arabitol, L(−) arabitol, D(+) fucose, L(−) fucose, D(−) lyxose, L(+) lyxose, and L(−) lyxose, or amino acids, e.g., glutamine, lysine, arginine, asparagine, aspartic acid, cysteine, glutamic acid, glycine, histidine, leucine, methionine, phenylalanine, proline, serine, threonine, tyrosine, valine, and taurine. Methods and materials for enhancing blood brain barrier penetration are described, e.g., in U.S. Pat. No. 4,866,042, "Method for the delivery of genetic material across the blood brain barrier," U.S. Pat. No. 6,294,520, "Material for passage through the blood-brain barrier," and U.S. Pat. No. 6,936,589, "Parenteral delivery systems," each incorporated herein by reference.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties, and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

Treatment of Subjects

Any of the compositions provided herein may be administered to an individual. "Individual" may be used interchangeably with "subject" or "patient." An individual may be a mammal, for example a human or animal such as a non-human primate, a rodent, a rabbit, a rat, a mouse, a horse, a donkey, a goat, a cat, a dog, a cow, a pig, or a sheep. In embodiments, the individual is a human. In embodiments, the individual is a fetus, an embryo, or a child. In other embodiments, the individual may be another eukaryotic organism, such as a plant. In some embodiments, the compositions provided herein are administered to a cell ex vivo.

In some embodiments, the compositions provided herein are administered to an individual as a method of treating a disease or disorder. In some embodiments, the individual has a genetic disease, such as any of the diseases described herein. In some embodiments, the individual is at risk of having the disease, such as any of the diseases described herein. In some embodiments, the individual is at increased risk of having a disease or disorder caused by insufficient amount of a protein or insufficient activity of a protein. If an individual is "at an increased risk" of having a disease or disorder caused insufficient amount of a protein or insufficient activity of a protein, the method involves preventative or prophylactic treatment. For example, an individual may be at an increased risk of having such a disease or disorder because of family history of the disease. Typically, individuals at an increased risk of having such a disease or disorder benefit from prophylactic treatment (e.g., by preventing or delaying the onset or progression of the disease or disorder).

Suitable routes for administration of ASOs of the present invention may vary depending on cell type to which delivery of the ASOs is desired. Multiple tissues and organs can be affected in a condition described herein, with the kidney being the most significantly affected tissue. The ASOs of the present invention may be administered to patients parenterally, for example, by intraperitoneal injection, intramuscular injection, subcutaneous injection, or intravenous injection. In embodiments, delivery is to the kidney. In embodiments, a fetus is treated in utero, e.g., by administering the ASO composition to the fetus directly or indirectly (e.g., via the mother).

Methods of Identifying Additional ASOs that Enhance Splicing

Also within the scope of the present invention are methods for identifying (determining) additional ASOs that enhance splicing of an RIC pre-mRNA, specifically at the target intron. ASOs that specifically hybridize to different nucleotides within the target region of the pre-mRNA may be screened to identify (determine) ASOs that improve the rate and/or extent of splicing of the target intron. In some embodiments, the ASO may block or interfere with the binding site(s) of a splicing repressor(s)/silencer. Any method known in the art may be used to identify (determine) an ASO that when hybridized to the target region of the intron results in the desired effect (e.g., enhanced splicing, protein or functional RNA production). These methods also can be used for identifying ASOs that enhance splicing of the retained intron by binding to a targeted region in an exon flanking the retained intron, or in a non-retained intron. An example of a method that may be used is provided below.

A round of screening, referred to as an ASO "walk" may be performed using ASOs that have been designed to hybridize to a target region of a pre-mRNA. For example, the ASOs used in the ASO walk can be tiled every 5 nucleotides from approximately 100 nucleotides upstream of the 5' splice site of the retained intron (e.g., a portion of sequence of the exon located upstream of the target/retained intron) to approximately 100 nucleotides downstream of the 5' splice site of the target/retained intron and/or from approximately 100 nucleotides upstream of the 3' splice site of the retained intron to approximately 100 nucleotides downstream of the 3' splice site of the target/retained intron (e.g., a portion of sequence of the exon located downstream of the target/retained intron). For example, a first ASO of 15 nucleotides in length may be designed to specifically hybridize to nucleotides +6 to +20 relative to the 5' splice site of the target/retained intron. A second ASO is designed to specifically hybridize to nucleotides +11 to +25 relative to the 5' splice site of the target/retained intron. ASOs are designed as such spanning the target region of the pre-mRNA. In embodiments, the ASOs can be tiled more closely, e.g., every 1, 2, 3, or 4 nucleotides. Further, the ASOs can be tiled from 100 nucleotides downstream of the 5' splice site, to 100 nucleotides upstream of the 3' splice site.

One or more ASOs, or a control ASO (an ASO with a scrambled sequence, sequence that is not expected to hybridize to the target region) are delivered, for example by transfection, into a disease-relevant cell line that expresses the target pre-mRNA (e.g., the RIC pre-mRNA described elsewhere herein). The splicing-inducing effects of each of the ASOs may be assessed by any method known in the art, for example by reverse transcriptase (RT)-PCR using primers that span the splice junction, as described herein (see "Identification of intron-retention events"). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

A second round of screening, referred to as an ASO "micro-walk" may be performed using ASOs that have been designed to hybridize to a target region of a pre-mRNA. The ASOs used in the ASO micro-walk are tiled every 1 nucleotide to further refine the nucleotide acid sequence of the pre-mRNA that when hybridized with an ASO results in enhanced splicing.

Regions defined by ASOs that promote splicing of the target intron are explored in greater detail by means of an ASO "micro-walk", involving ASOs spaced in 1-nt steps, as well as longer ASOs, typically 18-25 nt.

As described for the ASO walk above, the ASO micro-walk is performed by delivering one or more ASOs, or a control ASO (an ASO with a scrambled sequence, sequence that is not expected to hybridize to the target region), for example by transfection, into a disease-relevant cell line that expresses the target pre-mRNA. The splicing-inducing effects of each of the ASOs may be assessed by any method known in the art, for example by reverse transcriptase (RT)-PCR using primers that span the splice junction, as described herein (see "Identification of intron-retention events"). A reduction or absence of the RT-PCR product produced using the primers spanning the splice junction in ASO-treated cells as compared to in control ASO-treated cells indicates that splicing of the target intron has been enhanced. In some embodiments, the splicing efficiency, the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced protein production). Any method known in the art for assessing and/or quantifying protein production, such as Western blotting, flow cytometry, immunofluorescence microscopy, and ELISA, can be used.

ASOs that when hybridized to a region of a pre-mRNA result in enhanced splicing and increased protein production may be tested in vivo using animal models, for example transgenic mouse models in which the full-length human gene has been knocked-in or in humanized mouse models of disease. Suitable routes for administration of ASOs may vary depending on the disease and/or the cell types to which delivery of the ASOs is desired. ASOs may be administered, for example, by intraperitoneal injection, intramuscular injection, subcutaneous injection, or intravenous injection. Following administration, the cells, tissues, and/or organs of the model animals may be assessed to determine the effect of the ASO treatment by for example evaluating splicing (efficiency, rate, extent) and protein production by methods known in the art and described herein. The animal models may also be any phenotypic or behavioral indication of the disease or disease severity.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

EXAMPLES

The present invention will be more specifically illustrated by the following Examples. However, it should be understood that the present invention is not limited by these examples in any manner.

Figure 3:
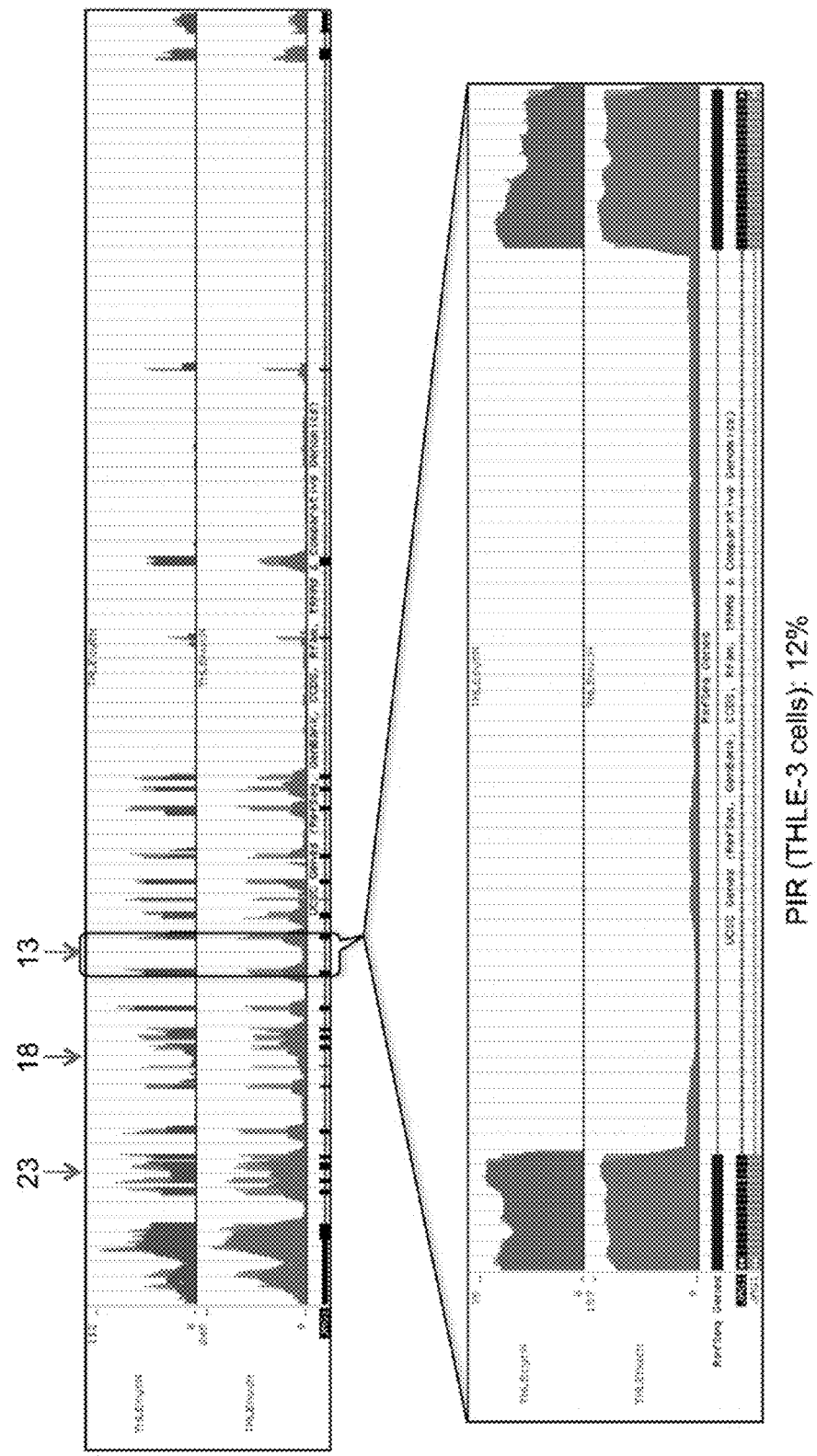
FIG. 3 shows intron-retention in the JAG1 gene with intron 13 detail. The identification of intron-retention events in the JAG1 gene using RNA sequencing (RNAseq) is shown, visualized in the UCSC genome browser. The upper panel shows the read density corresponding to the JAG1 transcript expressed in THLE-3 (human liver epithelial) cells and localized in either the cytoplasmic (top) or nuclear fraction (bottom). At the bottom of this panel, a graphic representation of the JAG1 gene is shown to scale. The read density is shown as peaks. The highest read density corresponds to exons (black boxes), while no reads are observed for the majority of the introns (lines with arrow heads) in either cellular fraction. Higher read density is detected for introns 13, 18, and 23 (pointed by the arrows) in the nuclear fraction compared to the cytoplasmic fraction indicating that splicing efficiency of introns 13, 18, and 23 is low, resulting in intron retention. The retained-intron containing pre-mRNA transcripts accumulate primarily in the nucleus and are not translated into the JAG1 protein. The read density for intron 13 in THLE-3 cells is shown in detail in the lower panel indicating 12% intron retention as calculated by bioinformatic analysis.
Figure 7:
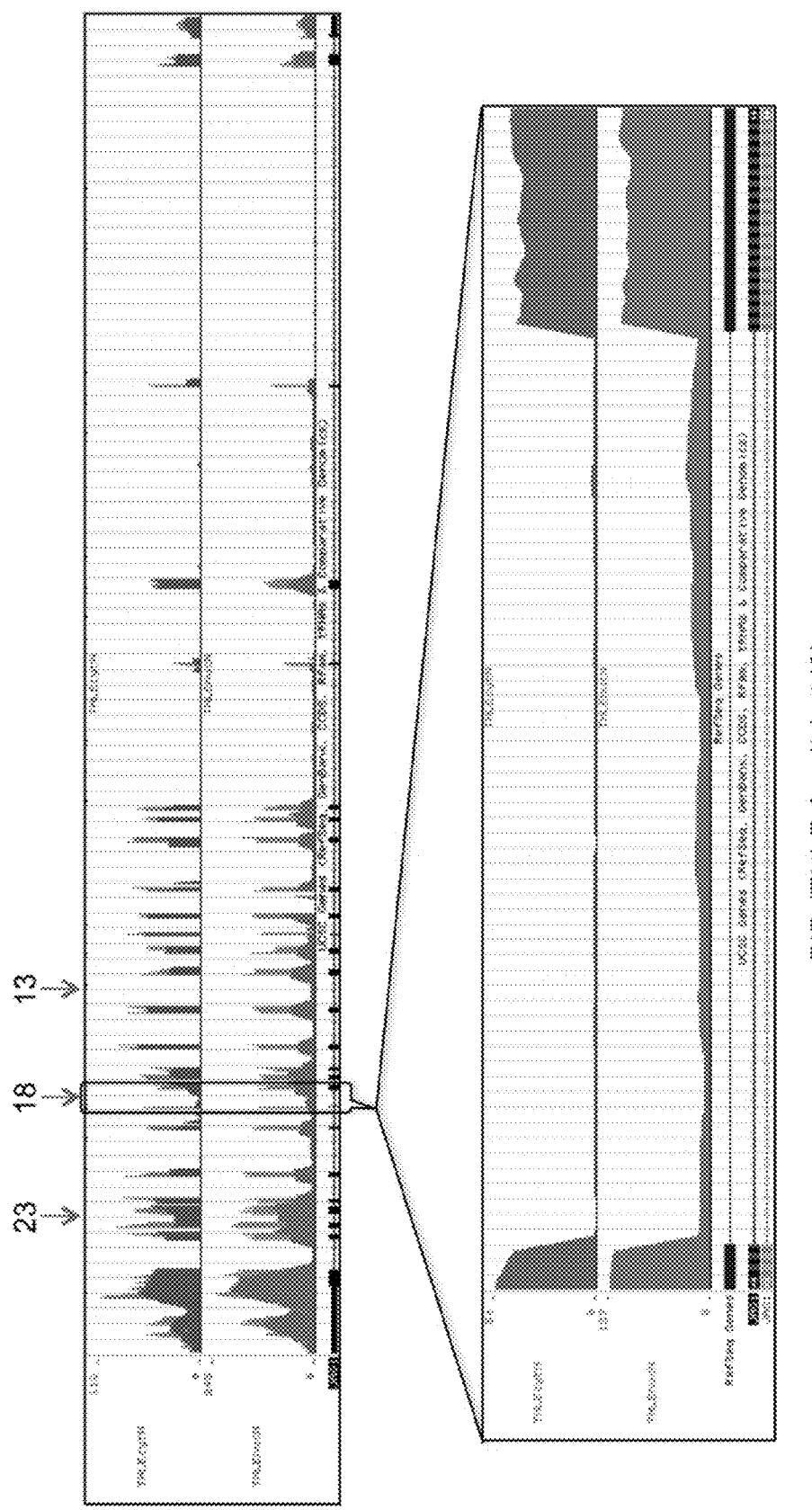
FIG. 7 shows intron-retention in the JAG1 gene with intron 18 detail. Intron retention in the JAG1 gene was identified by RNA sequencing (RNAseq), visualized in the UCSC genome browser, as described herein in the Examples. The read density for intron 18 in THLE-3 cells is shown in detail in the lower panel, indicating 14% intron retention as calculated by bioinformatic analysis.
Figure 11:
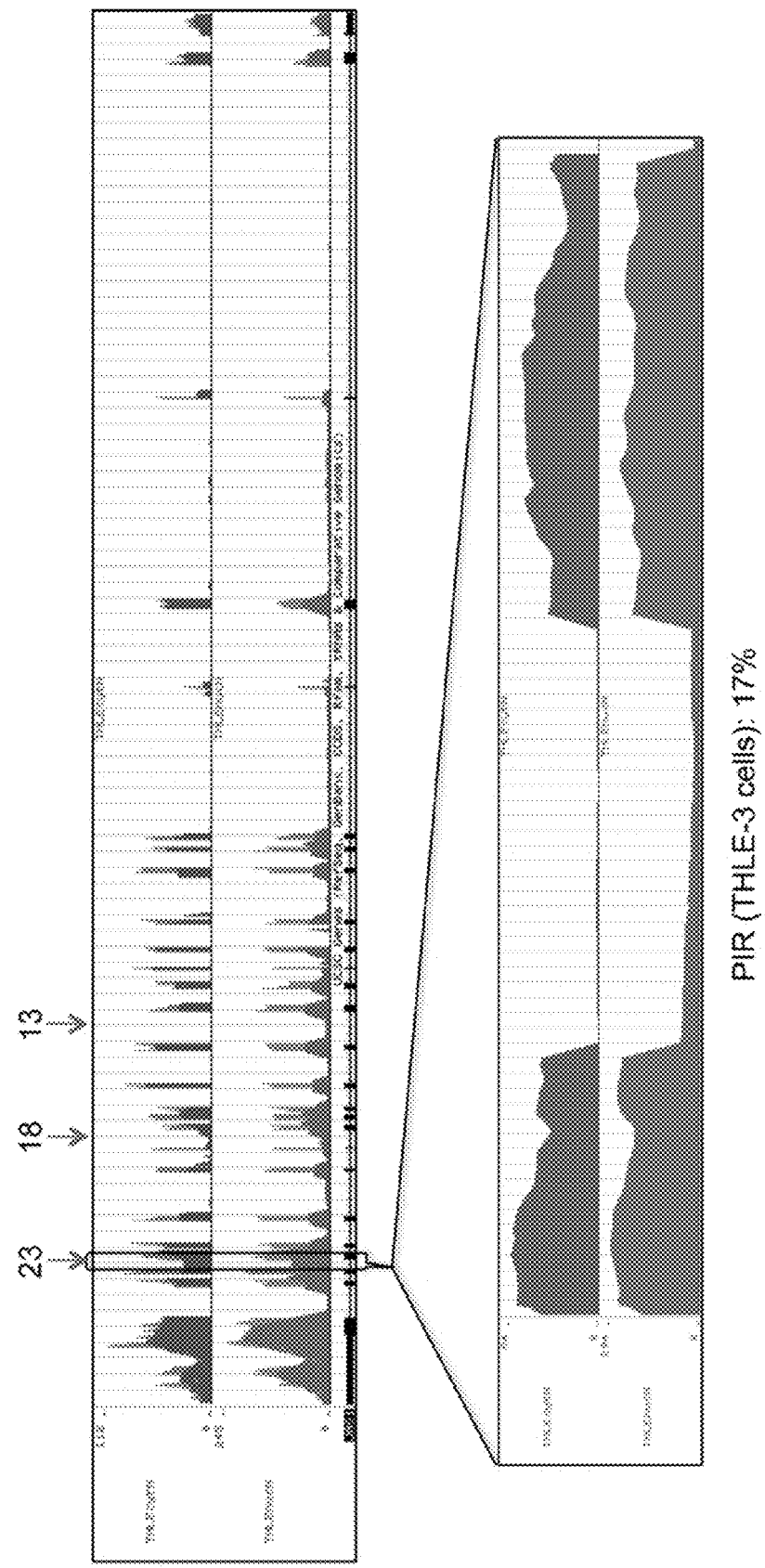
FIG. 11 shows intron-retention in the JAG1 gene with intron 23 detail. Intron retention in the JAG1 gene was identified by RNA sequencing (RNAseq), visualized in the UCSC genome browser, as described herein in the Examples and in the description of FIG. 1. The read density for intron 23 in THLE-3 cells is shown in detail in the lower panel, indicating 17% intron retention as calculated by bioinformatic analysis.

Example 1: Identification of Intron Retention Events in JAG1 Transcripts by RNAseq Using Next Generation Sequencing Whole transcriptome shotgun sequencing was carried out using next generation sequencing to reveal a snapshot of transcripts produced by the JAG1 gene to identify intron-retention events. For this purpose, polyA+ RNA from nuclear and cytoplasmic fractions of THLE-3 (human liver epithelial) cells was isolated cDNA libraries constructed using Illumina's TruSeq Stranded mRNA library Prep Kit. The libraries were pair-end sequenced resulting in 100-nucleotide reads that were mapped to the human genome (February 2009, GRCh37/hg19 assembly). The sequencing results for JAG1 are shown in FIG. 3. Briefly, FIG. 3 shows the mapped reads visualized using the UCSC genome browser (operated by the UCSC Genome Informatics Group (Center for Biomolecular Science & Engineering, University of California, Santa Cruz, 1156 High Street, Santa Cruz, Calif. 95064) and described by, e.g., Rosenbloom, et al., 2015, "The UCSC Genome Browser database: 2015 update," Nucleic Acids Research 43, Database Issue, doi: 10.1093/nar/gku1177) and the coverage and number of reads can be inferred by the peak signals. The height of the peaks indicates the level of expression given by the density of the reads in a particular region. A schematic representation of JAG1 (drawn to scale) is provided by the UCSC genome browser (below the read signals) so that peaks can be matched to JAG1 exonic and intronic regions. Based on this display, we identified three introns (13, 18, and 23, indicated by arrows) that have high read density in the nuclear fraction of THLE-3 cells, but have very low to no reads in the cytoplasmic fraction of these cells (as shown for intron 13 in the bottom diagram of FIG. 3, for intron 18 in the bottom diagram of FIG. 7, and for intron 23 in the bottom diagram of FIG. 11). This indicates that these introns are retained and that the intron-13, intron-18, and intron-23 containing transcripts remain in the nucleus, and suggests that these retained JAG1 RIC pre-mRNAs are non-productive, as they are not exported out to the cytoplasm.

Example 2: Design of ASO-Walk Targeting Intron 13 of JAG1

Figure 4:
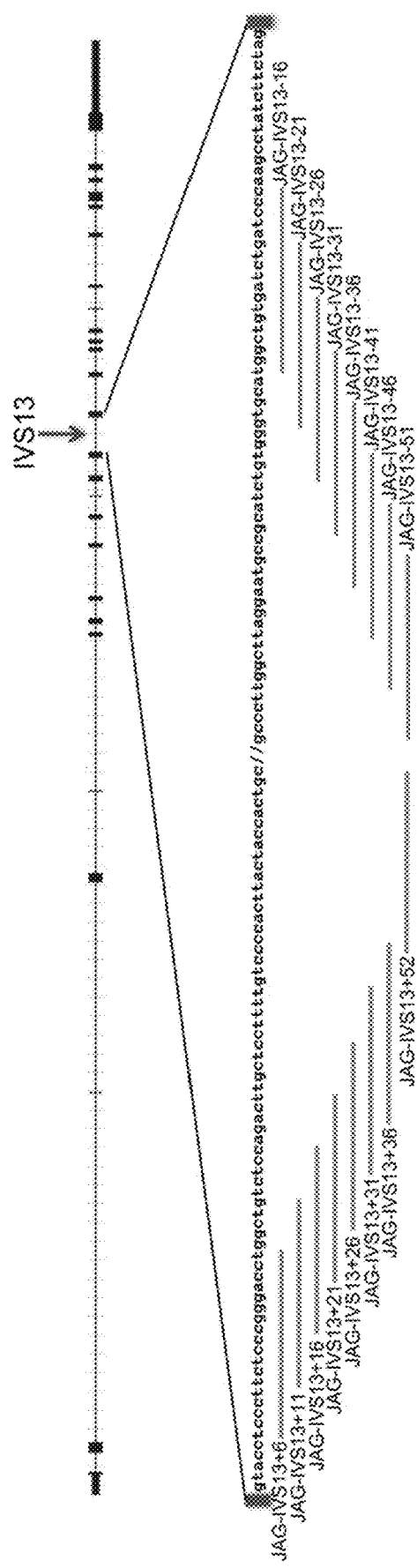
FIG. 4 shows JAG1 gene IVS 13 ASO walk. A graphic representation of the ASO walk performed for JAG1 IVS 13 targeting sequences immediately downstream of the 5' splice site or upstream of the 3' splice site using 2'-O-Me ASOs, PS backbone, is shown. ASOs were designed to cover these regions by shifting 5 nucleotides at a time. The JAG1 exon-intron structure is drawn to scale.

An ASO walk was designed to target intron 13 using the method described herein (FIG. 4; Table 2). A region immediately downstream of the intron 13 5' splice site spanning nucleotides +6 to +69 and a region immediately upstream of intron 13 3' splice site spanning nucleotides −16 to −68 of the intron were targeted with 2'-O-Me RNA, PS backbone, 18-mer ASOs shifted by 5-nucleotide intervals (with the exception of 1 ASO, JAG1-IVS13+52) (FIG. 4; Table 2).

Figure 5:
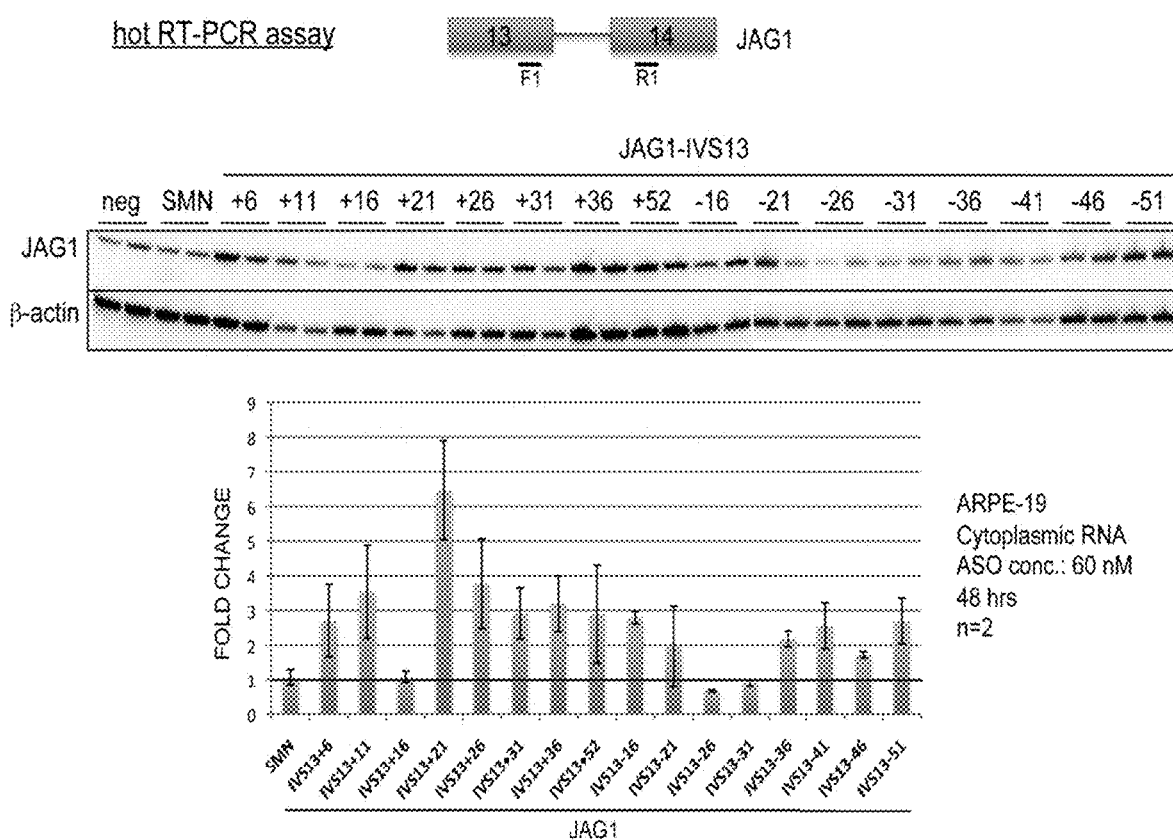
FIG. 5 shows JAG1 intron 13 ASO walk evaluated by radioactive RT-PCR. At the top, a schematic drawing (not to scale) of exon 13-intron 13-exon 14 shows the primers Forward 1 (F1) and Reverse 1 (R1) used for the RT-PCR assay. In the middle panel, a representative gel shows radioactive RT-PCR products of JAG1 mock-treated (neg, RNAiMAX only), SMN-control ASO treated, or treated with a 2'-O-Me ASO targeting intron 13 as described in FIG. 2, at 60 nM concentration in ARPE-19 cells. In the lower panel, quantification of the bands corresponding to JAG1 radioactive RT-PCR products normalized to Beta actin from two independent experiments is plotted in the bar graph as fold-change with respect to the mock-treated products. The black line labeled 1 on the Y-axis indicates a ratio of 1 (no change).
Figure 6:
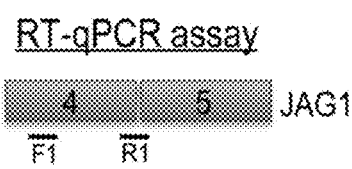
FIG. 6 shows JAG1 intron 13 ASO walk evaluated by RT-qPCR. At the top left, a schematic representation of the RT-qPCR assay shows the primer recognition sites. RT-qPCR amplification results, obtained using the same ASO transfection experiment that were evaluated by radioactive RT-PCR as shown in FIG. 3, are plotted relative to mock-treated products normalized to Beta actin (upper bar graph) or normalized to RPL32 (lower bar graph) confirming the radioactive RT-PCR results. The black line labeled 1 on the Y-axis indicates a ratio of 1 (no change).
Figure 6:
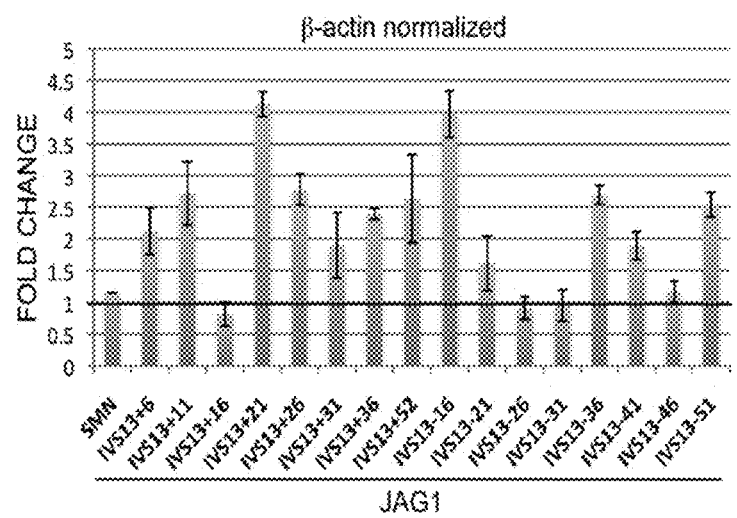
Figure 6:
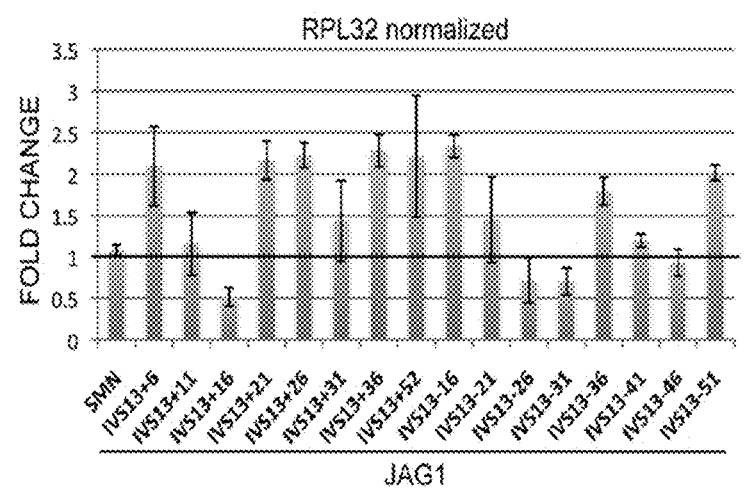

Example 3: Improved Splicing Efficiency Via ASO-Targeting of JAG1 Intron 13 Increases Transcript Levels To determine whether we can achieve an increase in JAG1 expression by improving splicing efficiency of JAG1 intron 13 using ASOs we used the method described herein (FIG. 5). To this end, ARPE-19 cells were mock-transfected, or transfected with each of the targeting ASOs described in FIG. 4 and Table 2, or a non-targeting SMN-ASO control, independently, using RNAiMAX (RiM) (Invitrogen) delivery reagents. Experiments were performed using 60 nM ASOs (as indicated in FIG. 5) for 48 hrs. Radioactive RT-PCR results show that several targeting ASOs (+6, SEQ ID NO: 135; +11, SEQ ID NO: 136; +21, SEQ ID NO: 138; +26, SEQ ID NO: 139; +31, SEQ ID NO: 140; +36, SEQ ID NO: 141; +52; −16, SEQ ID NO: 301; −36, SEQ ID NO: 297; −41, SEQ ID NO: 296; −46, SEQ ID NO: 295; and −51 SEQ ID NO: 294) increase JAG1 transcript level compared to the mock-transfected or non-targeting ASO (FIG. 5). Intensities of the bands corresponding to the JAG1 PCR products from targeting-ASO-transfected cells were normalized to Beta actin and plotted relative to the normalized JAG1 PCR product from mock-treated cells. Results of this analysis indicate that several targeting ASOs increase JAG1 transcript level 2-6 fold (FIG. 5). These results were confirmed by RT-qPCR using primers elsewhere in the JAG1 transcript, showing the same trend of JAG1 upregulation evidenced by the fold-change plots in FIG. 6 (top, normalized to Beta actin, bottom normalized to RPL32). Altogether, these results confirm that improving the splicing efficiency of a rate limiting intron in the JAG1 gene using ASOs leads to an increase in gene expression.

Example 4: Design of an ASO-Walk Targeting Intron 18 of JAG1

Figure 8:
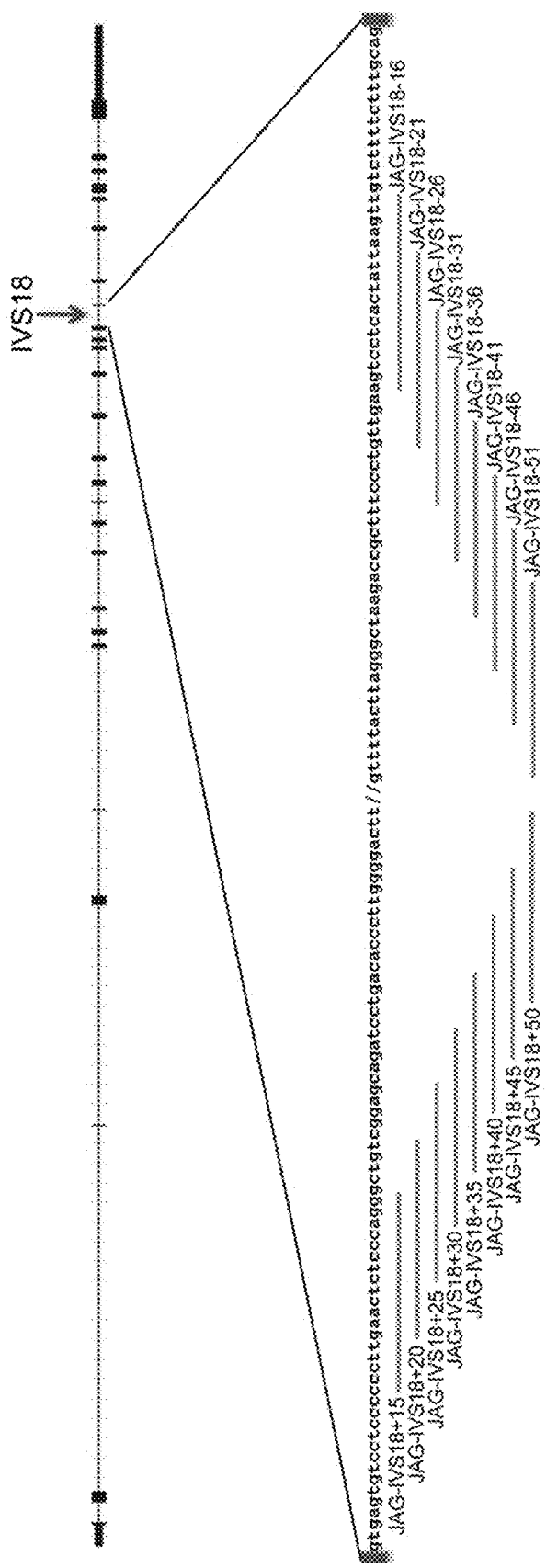
FIG. 8 shows JAG1 gene IVS 18 ASO walk. A graphic representation of the ASO walk performed for JAG1 IVS 18 targeting sequences immediately downstream of the 5' splice site or upstream of the 3' splice site using 2'-O-Me ASOs, PS backbone, is shown. ASOs were designed to cover these regions by shifting 5 nucleotides at a time. The JAG1 exon-intron structure is drawn to scale.

An ASO walk was designed to target intron 18 using the method described herein (FIG. 8, Table 2). A region immediately downstream of intron 18 5' splice site spanning nucleotides +15 to +67 and a region immediately upstream of intron 18 3' splice site spanning nucleotides −16 to −68 of the intron were targeted with 2'-O-Me RNA, PS backbone, 18-mer ASOs shifted by 5-nucleotide intervals (FIG. 8, Table 2).

Figure 9:
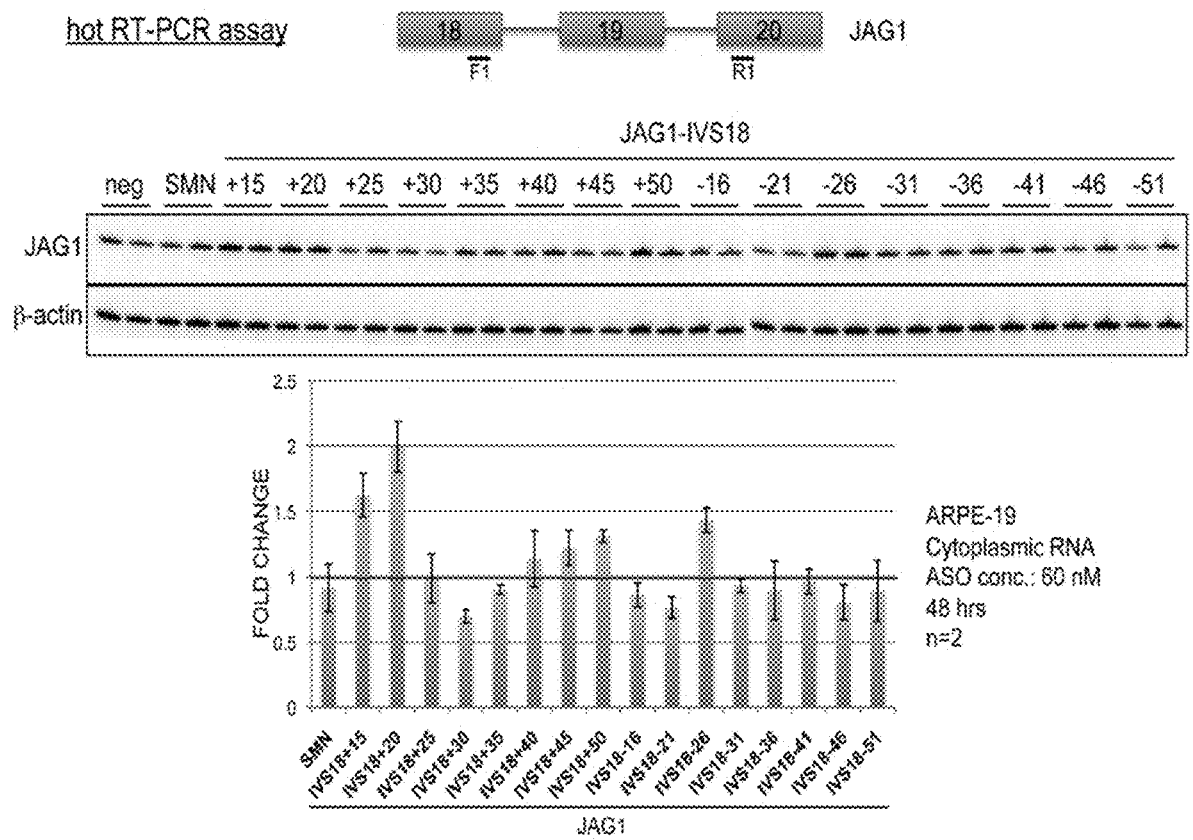
FIG. 9 shows JAG1 intron 18 ASO walk evaluated by radioactive RT-PCR. At the top, a schematic drawing (not to scale) of exon 18 to exon 20 shows the primers Forward 1 (F1) and Reverse 1 (R1) used for the RT-PCR assay. In the middle panel, a representative gel shows radioactive RT-PCR products of JAG1 mock-treated (neg, RNAiMAX only), SMN-control ASO treated, or treated with a 2'-O-Me ASO targeting intron 18 as described herein in the Examples and in the description of FIG. 6, at 60 nM concentration in ARPE-19 cells. Quantification of the bands corresponding to JAG1 radioactive RT-PCR products normalized to Beta actin from 2 independent experiments is plotted in the bar graph below as fold change with respect to the mock-treated products. The black line labeled 1 on the Y-axis indicates a ratio of 1 (no change).
Figure 10:
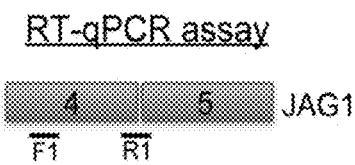
FIG. 10 shows JAG1 intron 18 ASO walk evaluated by RT-qPCR. At the top left, a schematic representation of the RT-qPCR assay shows the primer recognition sites. RTqPCR amplification results, obtained using the same ASO transfection experiment that were evaluated by radioactive RT-PCR as shown in FIG. 7, are plotted relative to mock-treated products normalized to Beta actin (upper bar graph) or normalized to RPL32 (lower bar graph) confirming the radioactive RT-PCR results. The black line labeled 1 on the Y-axis indicates a ratio of 1 (no change).
Figure 10:
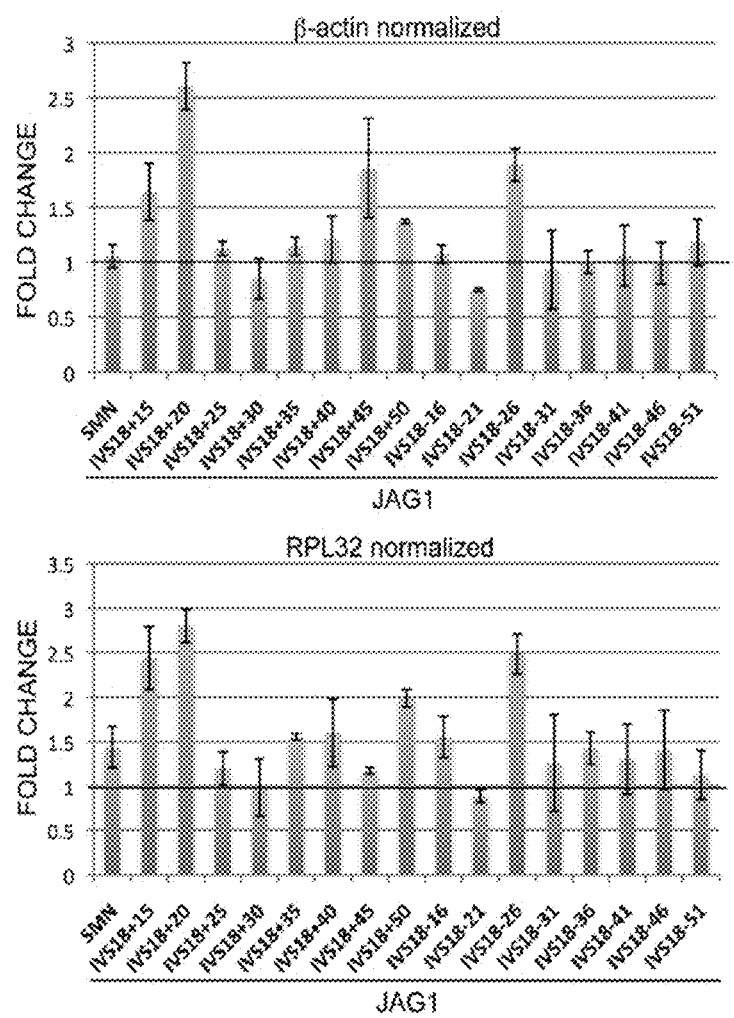

Example 5: Improved Splicing Efficiency Via ASO-Targeting of JAG1 Intron 18 Increases Transcript Levels To determine whether an increase in JAG1 expression could be achieved by improving splicing efficiency of JAG1 intron 18 using ASOs, the method described herein (FIG. 9) was used. To this end, ARPE-19 cells were mock-transfected, transfected with each of the targeting ASOs described in FIG. 8 and Table 2, or transfected with a non-targeting SMN-ASO control, independently, using RNAiMAX (RiM) (Invitrogen) delivery reagents. Experiments were performed using 60 nM ASOs (as indicated in FIG. 5) for 48 hrs. Radioactive RT-PCR results show that several targeting ASOs (+15; +20; and −26, SEQ ID NO: 107) increase JAG1 transcript level compared to the mock-transfected or non-targeting ASO (FIG. 9). Intensities of the bands corresponding to the JAG1 PCR products from targeting-ASO-transfected cells were normalized to Beta actin and plotted relative to the normalized JAG1 PCR product from mock-treated cells. Results of this analysis indicate that three targeting ASOs increase JAG1 transcript level at least 1.5 fold (FIG. 9). These results were confirmed by RT-qPCR using primers elsewhere in the JAG1 transcript, showing the same trend of JAG1 upregulation evidenced by the fold-change plots in FIG. 10 (top, normalized to Beta actin, bottom normalized to RPL32). Altogether, these results confirm that improving the splicing efficiency of a rate limiting intron in the JAG1 gene using ASOs leads to an increase in gene expression.

A second method can be used to determine whether an increase in JAG1 target gene intron splicing efficiency can be achieved with ASOs. In brief, ARPE-19 cells, a human retinal epithelium cell line (American Type Culture Collection (ATCC), USA), or Huh-7, a human hepatoma cell line (NIBIOHN, Japan), or SK-N-AS, a human neuroblastoma cell line (ATCC) are mock-transfected, or transfected with the targeting ASOs described in Tables 1 and 2. Cells are transfected using Lipofectamine RNAiMax transfection reagent (Thermo Fisher) according to vendor's specifications. ASOs are plated in 96-well tissue culture plates and combined with RNAiMax diluted in Opti-MEM. Cells are detached using trypsin and resuspended in full medium, and approximately 25,000 cells are added the ASO-transfection mixture. Transfection experiments are carried out in triplicate plate replicates. Final ASO concentration is 80 nM. Media is changed 6h post-transfection, and cells harvested at 24h, using the Cells-to-Ct lysis reagent, supplemented with DNAse (Thermo Fisher), according to vendor's specifications. cDNA is generated with Cells-to-Ct RT reagents (Thermo Fisher) according to vendor's specifications. To quantify the amount of splicing at the intron of interest, quantitative PCR is carried out using Taqman assays with probes spanning the corresponding exon-exon junction (Thermo Fisher). Taqman assays are carried out according to vendor's specifications, on a QuantStudio 7 Flex Real-Time PCR system (Thermo Fisher). Target gene assay values are normalized to RPL32 (deltaCt) and plate-matched mock transfected samples (delta-delta Ct), generating fold-change over mock quantitation (2^-(delta-deltaCt).

Example 6: Design of ASO-Walk Targeting Intron 23 of JAG1

Figure 12:
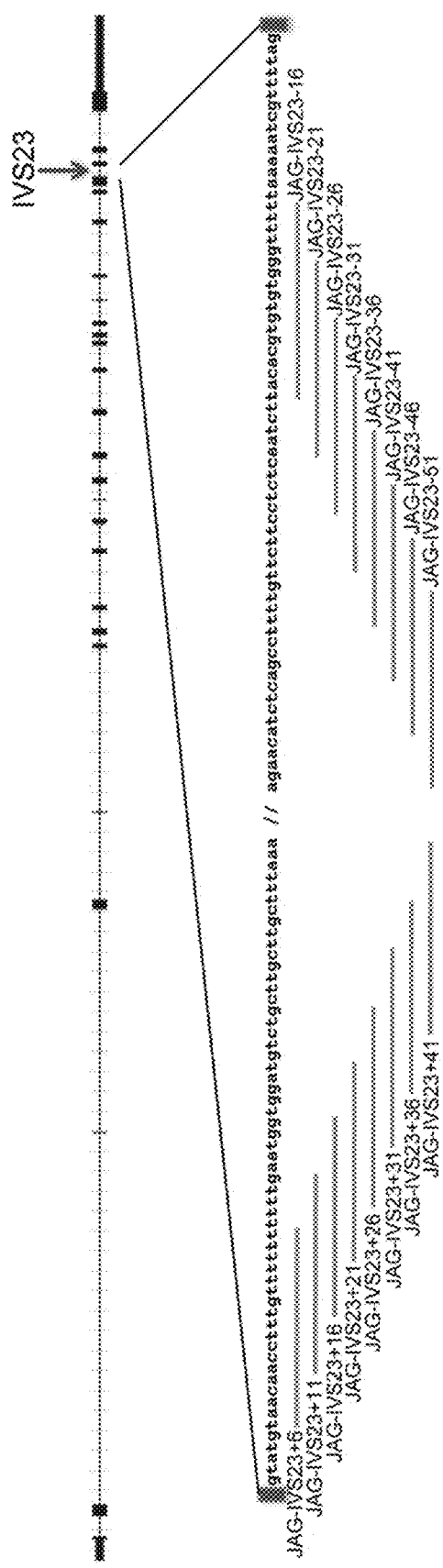
FIG. 12 shows JAG1 gene IVS 23 ASO walk. A graphic representation of the ASO walk performed for JAG1 IVS 23 targeting sequences immediately downstream of the 5' splice site or upstream of the 3' splice site using 2'-O-Me ASOs, PS backbone, is shown. ASOs were designed to cover these regions by shifting 5 nucleotides at a time. The JAG1 exon-intron structure is drawn to scale.

An ASO walk was designed to target intron 23 using the method described herein (FIG. 12, Table 2). A region immediately downstream of intron 23 5' splice site spanning nucleotides +6 to +58 and a region immediately upstream of intron 23 3' splice site spanning nucleotides −16 to −68 of the intron were targeted with 2'-O-Me RNA, PS backbone, 18-mer ASOs shifted by 5-nucleotide intervals (FIG. 12; Table 2).

TABLE 2

ASOs targeting the JAG1 Gene

| SEQ ID NO | ASO Name | Sequence 5' to 3' | Intron |
|---|---|---|---|
| 135 | JAG-IVS13 + 6 | agguccgggagaaggga | 13 |
| 136 | JAG-IVS13 + 11 | cagccaggucccgggaga | 13 |
| 137 | JAG-IVS13 + 16 | ggagacagccaggucccg | 13 |
| 138 | JAG-IVS13 + 21 | agucuggagacagccagg | 13 |
| 139 | JAG-IVS13 + 26 | gagcaagucuggagacag | 13 |

TABLE 2-continued

ASOs targeting the JAG1 Gene

| SEQ ID NO | ASO Name | Sequence 5' to 3' | Intron |
|---|---|---|---|
| 140 | JAG-IVS13 + 31 | aaaaggagcaagucugga | 13 |
| 141 | JAG-IVS13 + 36 | gggacaaaaggagcaagu | 13 |
| 150753 | JAG-IVS13 + 52 | gcaguggguaguaaguggg | 13 |
| 301 | JAG-IVS13 - 16 | gggaucagaucacagcca | 13 |
| 300 | JAG-IVS13 - 21 | cagaucacagccaugcac | 13 |
| 299 | JAG-IVS13 - 26 | cacagccaugcacccaca | 13 |
| 298 | JAG-IVS13 - 31 | ccaugcacccacagaugc | 13 |
| 297 | JAG-IVS13 - 36 | cacccacagaugcggcau | 13 |
| 296 | JAG-IVS13 - 41 | acagaugcggcauuccua | 13 |
| 295 | JAG-IVS13 - 46 | ugcggcauuccuaagcca | 13 |
| 294 | JAG-IVS13 - 51 | cauuccuaagccaagggc | 13 |
| 150754 | JAG-IVS18 + 15 | ccugggagaguucaaggg | 18 |
| 150755 | JAG-IVS18 + 20 | acagcccugggagaguuc | 18 |
| 150756 | JAG-IVS18 + 25 | cuccgacagcccugggag | 18 |
| 150757 | JAG-IVS18 + 30 | aucugcuccgacagcccu | 18 |
| 150758 | JAG-IVS18 + 35 | ucaggaucugcuccgaca | 18 |
| 150759 | JAG-IVS18 + 40 | gggugucaggaucugcuc | 18 |
| 150760 | JAG-IVS18 + 45 | cccaagggugucaggauc | 18 |
| 150761 | JAG-IVS18 + 50 | aagucccaagggguguca | 18 |
| 109 | JAG-IVS18 - 16 | aacuuaauagugaggacu | 18 |
| 108 | JAG-IVS18 - 21 | aauagugaggacuucaac | 18 |
| 107 | JAG-IVS18 - 26 | ugaggacuucaacaggga | 18 |
| 106 | JAG-IVS18 - 31 | acuucaacagggaaagcg | 18 |
| 105 | JAG-IVS18 - 36 | aacagggaaagcggucuu | 18 |
| 104 | JAG-IVS18 - 41 | ggaaagcggucuuagccc | 18 |
| 103 | JAG-IVS18 - 46 | gcggucuuagcccuaagu | 18 |
| 102 | JAG-IVS18 - 51 | cuuagcccuaaguaaaac | 18 |
| 369 | JAG-IVS23 + 6 | aaaaaacaaagguuguua | 23 |
| 370 | JAG-IVS23 + 11 | caaaaaaaaaacaaaggu | 23 |
| 371 | JAG-IVS 3 + 16 | ccauucaaaaaaaaaaca | 23 |
| 372 | JAG-IVS23 + 21 | auccaccauucaaaaaaa | 23 |
| 373 | JAG-IVS23 + 26 | cagacauccaccauucaa | 23 |
| 374 | JAG-IVS23 + 31 | gcaagcagacauccacca | 23 |
| 375 | JAG-IVS23 + 36 | agcaagcaagcagacauc | 23 |
| 376 | JAG-IVS23 + 41 | uuuaaagcaagcaagcag | 23 |
| 414 | JAG-IVS23 - 16 | aaaacccacacacgugua | 23 |
| 413 | JAG-IVS23 - 21 | ccacacacguguaagauu | 23 |
| 412 | JAG-IVS23 - 26 | cacguguaagauugagag | 23 |
| 411 | JAG-IVS23 - 31 | guaagauugagaggaaga | 23 |
| 410 | JAG-IVS23 - 36 | auugagaggaagaacaaa | 23 |
| 409 | JAG-IVS23 - 41 | gaggaagaacaaaaggcu | 23 |
| 408 | JAG-IVS23 - 46 | agaacaaaaggcugagau | 23 |
| 407 | JAG-IVS23 - 51 | aaaaggcugagauguucu | 23 |

Figure 13:
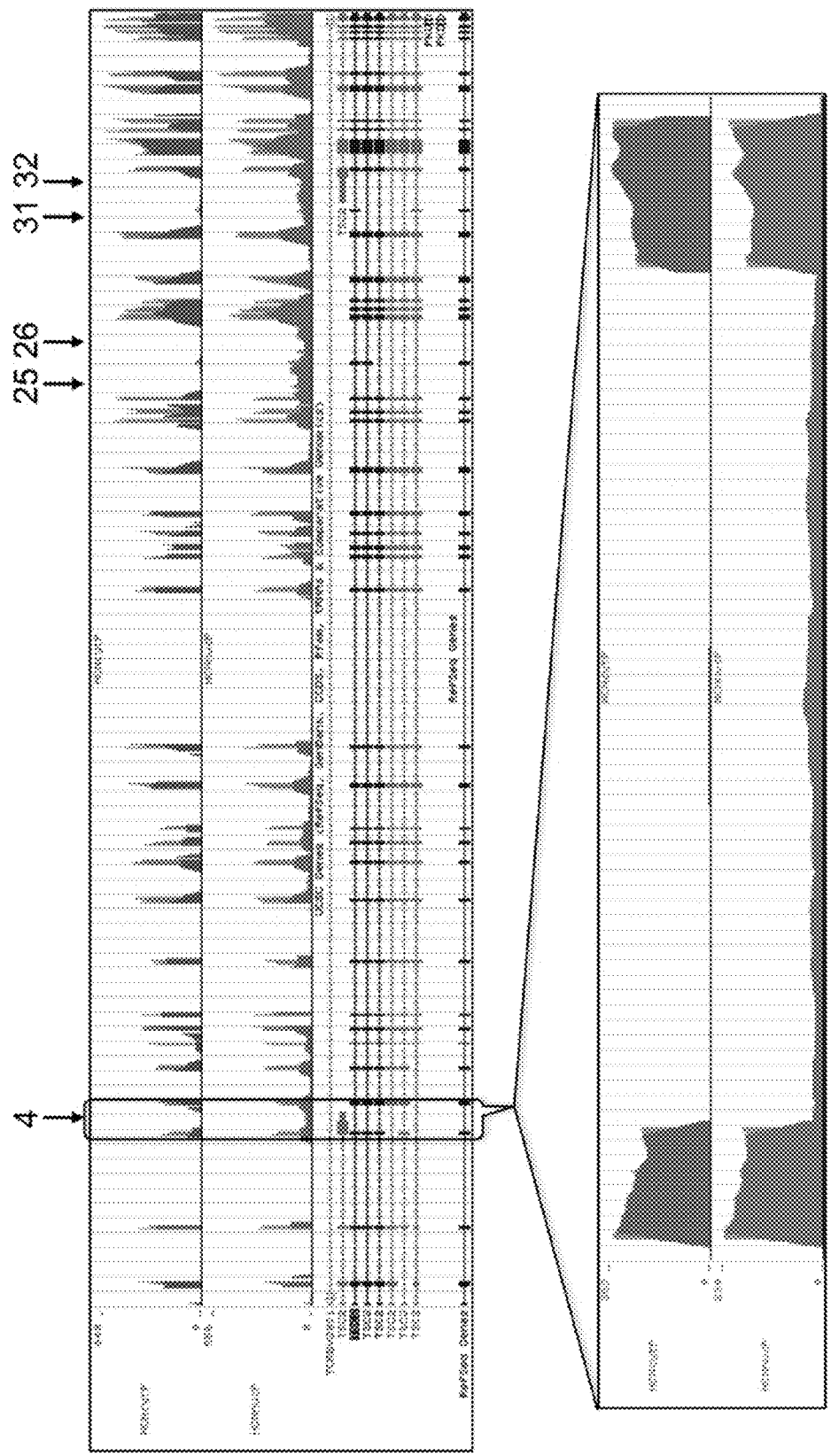
FIG. 13 shows intron-retention in the TSC2 gene with intron 4 detail. The identification of intron-retention events in the TSC2 gene using RNA sequencing (RNAseq) is shown, visualized in the UCSC genome browser. The upper panel shows the read density corresponding to the TSC2 transcript expressed in HCN (human cortical neurons) and localized in either the cytoplasmic (top) or nuclear fraction (bottom). At the bottom of this panel, a graphic representation of the TSC2 gene is shown to scale. The read density is shown as peaks. The highest read density corresponds to exons (black boxes), while no reads are observed for the majority of the introns (lines with arrow heads) in either cellular fraction. Higher read density is detected for introns 4, 25/26, and 31/32 (indicated by the arrows) in the nuclear fraction compared to the cytoplasmic fraction indicating that splicing efficiency of introns 4, 25/26, and 31/32 is low, resulting in intron retention. The retained-intron containing pre-mRNA transcripts are retained in the nucleus and are not exported out to the cytoplasm. The read density for intron 4 in HCN is shown in detail in the lower panel.
Figure 15:
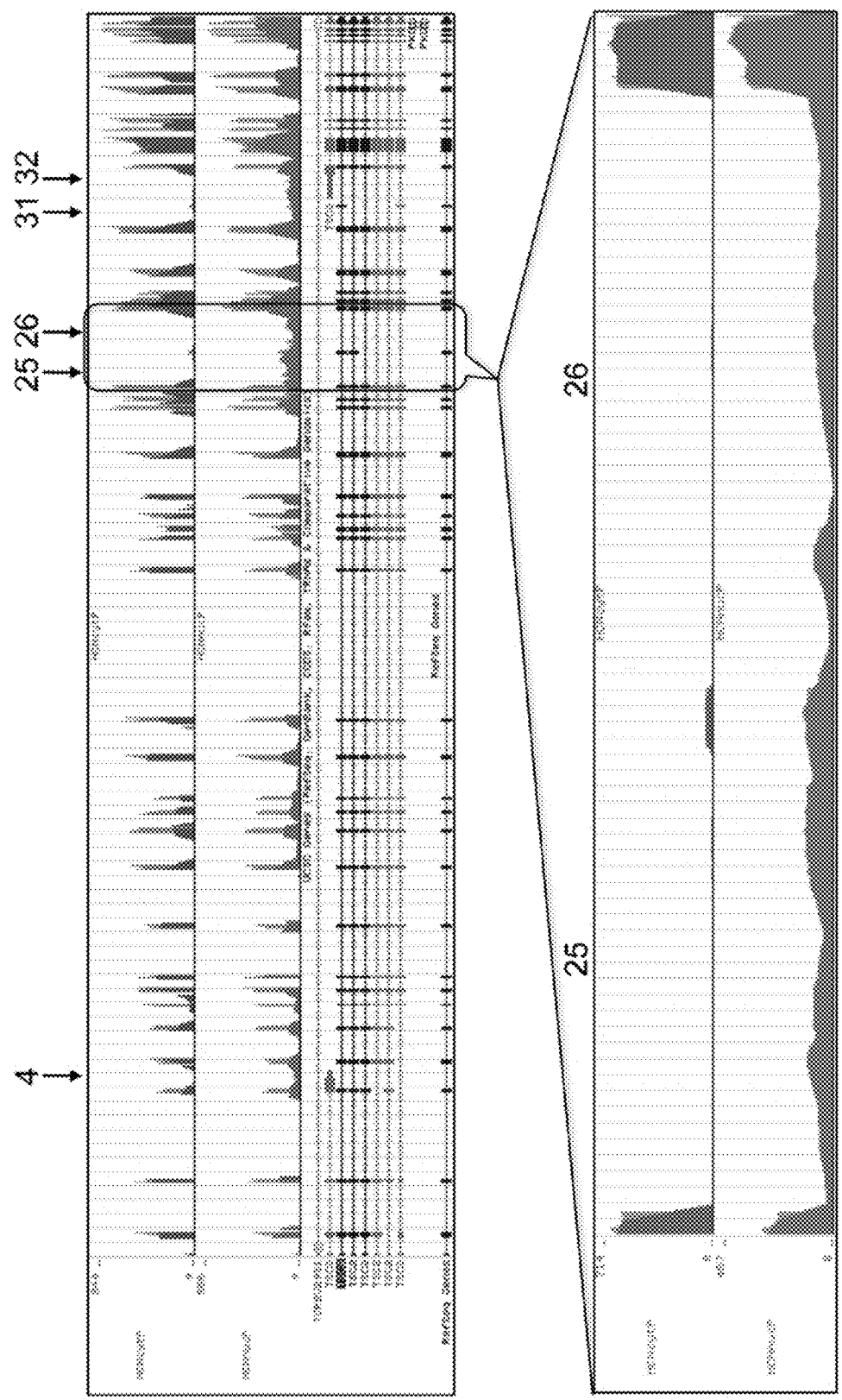
FIG. 15 shows intron-retention in the TSC2 gene with introns 25 and 26 detail. Intron retention in the TSC2 gene was identified by RNA sequencing (RNAseq), visualized in the UCSC genome browser, as described herein in the Examples. The read density for introns 25 and 26 in HCN is shown in detail in the lower panel. Introns 25 and 26 flank exon 26, an alternatively spliced exon. This is evidenced in the graphic representations of the TSC2 transcripts and the RNAseq data, such that the rectangle depicting exon 26 is present in some transcripts while absent in others, and the read density corresponding to exon 26 in the cytoplasmic fraction is significantly lower than that of the constitutively spliced exons in TSC2. The read density for intron 26 is shown in detail in the lower panel indicating 51% intron retention as calculated by bioinformatic analysis.
Figure 17:
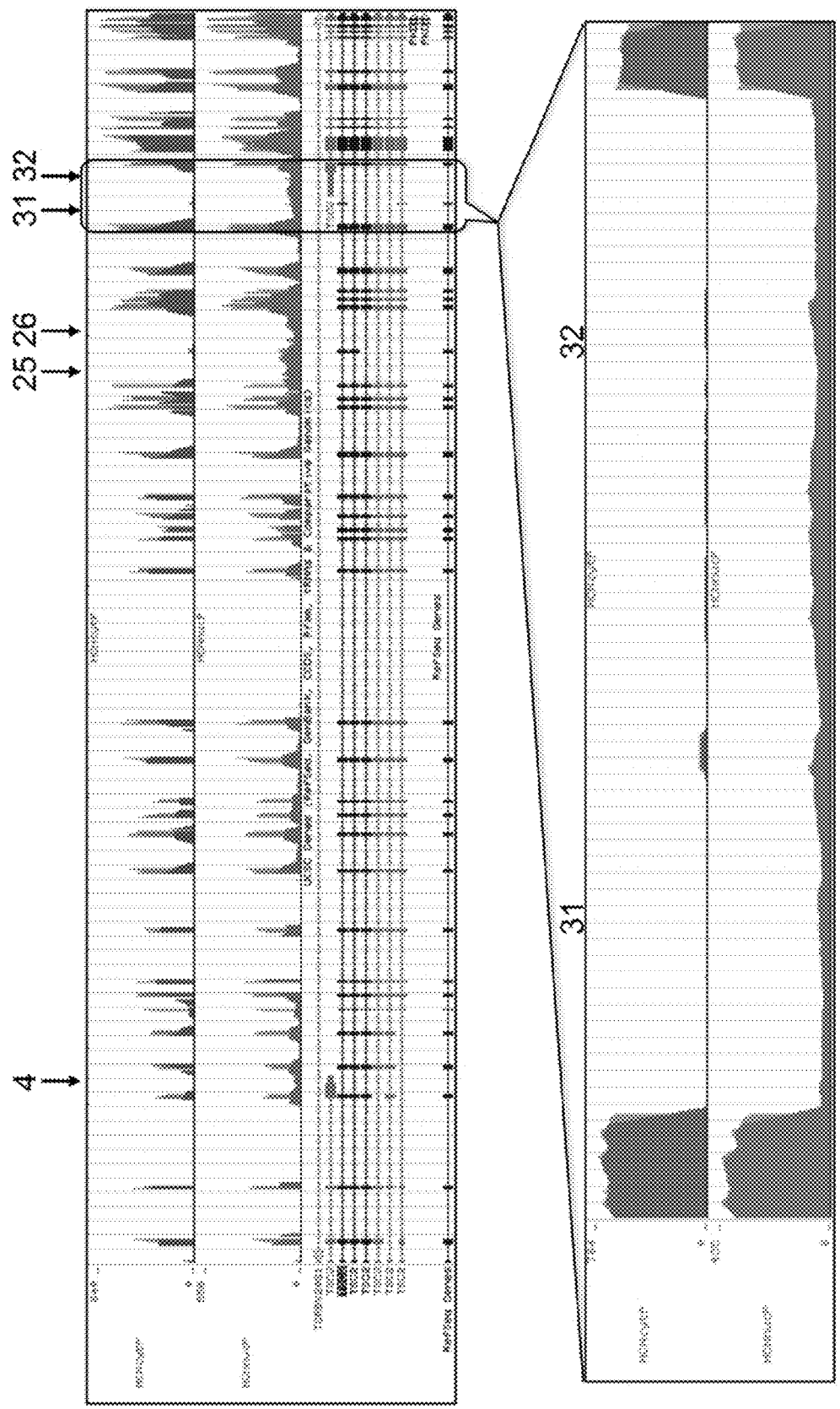
FIG. 17 shows intron-retention in the TSC2 gene with introns 31 and 32 detail. Intron retention in the TSC2 gene was identified by RNA sequencing (RNAseq), visualized in the UCSC genome browser, as described herein in the Examples. The read density for introns 31 and 32 is shown in detail in the lower panel. Introns 31 and 32 flank exon 32, an alternatively spliced exon. This is evidenced in the graphic representations of the TSC2 transcripts and the RNAseq data, such that the rectangle depicting exon 32 is present in some transcripts while absent in others, and the read density corresponding to exon 32 in the cytoplasmic fraction is significantly lower than that of the constitutively spliced exons in TSC2. The read density for intron 31 is shown in detail in the lower panel indicating 43% intron retention as calculated by bioinformatic analysis.

Example 7: Identification of Intron Retention Events in TSC2 Transcripts by RNAseq Using Next Generation Sequencing Whole transcriptome shotgun sequencing was carried out using next generation sequencing to reveal a snapshot of transcripts produced by the TSC2 gene to identify intron-retention events. For this purpose, polyA+ RNA from nuclear and cytoplasmic fractions of HCN (human cortical neurons), renal epithelial cells, bronchial epithelial cells, and THLE-3 (human liver epithelial) cells was isolated and cDNA libraries constructed using Illumina's TruSeq Stranded mRNA library Prep Kit. The libraries were pair-end sequenced resulting in 100-nucleotide reads that were mapped to the human genome (February 2009, GRCh37/hg19 assembly). The sequencing results for TSC2 are shown in FIG. 13. Briefly, FIG. 13 shows the mapped reads visualized using the UCSC genome browser (operated by the UCSC Genome Informatics Group (Center for Biomolecular Science & Engineering, University of California, Santa Cruz, 1156 High Street, Santa Cruz, Calif. 95064) and described by, e.g., Rosenbloom, et al., 2015, "The UCSC Genome Browser database: 2015 update," Nucleic Acids Research 43, Database Issue, doi: 10.1093/nar/gku1177) and the coverage and number of reads can be inferred by the peak signals. The height of the peaks indicates the level of expression given by the density of the reads in a particular region. A schematic representation of TSC2 (drawn to scale) is provided by the UCSC genome browser (below the read signals) so that peaks can be matched to TSC2 exonic and intronic regions. Based on this display, we identified five introns (4, 25, 26, 31, and 32, indicated by arrows) that have high read density in the nuclear fraction of HCN, but have very low to no reads in the cytoplasmic fraction of these cells (as shown for intron 4 in the bottom diagram of FIG. 13, for introns 25 and 26 in the bottom diagram of FIG. 15, and for introns 31 and 32 in the bottom diagram of FIG. 17). This indicates that these introns are retained and that the intron-4, intron-25, intron-26, intron-31, and intron-32 containing transcripts remain in the nucleus, and suggests that these retained TSC2 RIC pre-mRNAs are non-productive, as they are not exported out to the cytoplasm.

Example 8: Design of ASO-Walk Targeting Intron 4 of TSC2

Figure 14:
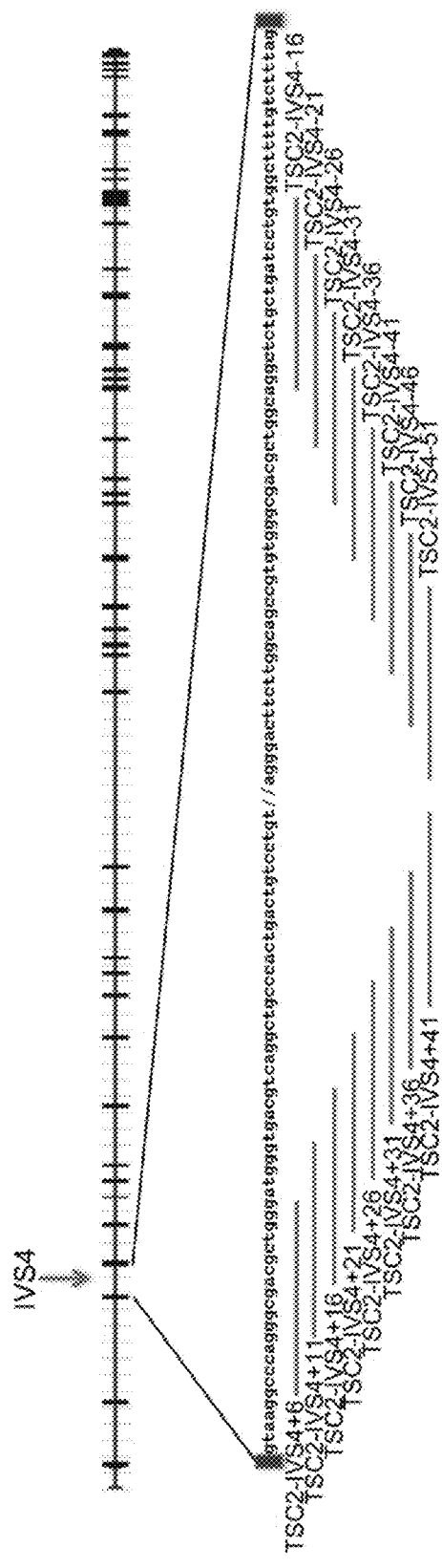
FIG. 14 shows TSC2 gene IVS 4 ASO walk. A graphic representation of the ASO walk performed for TSC2 IVS 4 targeting sequences immediately downstream of the 5' splice site or upstream of the 3' splice site using 2'-O-Me ASOs, PS backbone, is shown. ASOs were designed to cover these regions by shifting 5 nucleotides at a time. The TSC2 exon-intron structure is drawn to scale.

An ASO walk was designed to target intron 4 using the method described herein (FIG. 14; Table 4). A region immediately downstream of the 5' splice site of intron 4 spanning nucleotides +6 to +58 and a region immediately upstream of the 3' splice site of intron 4 spanning nucleotides −16 to −68 of the intron were targeted with 2'-O-Me RNA, PS backbone, 18-mer ASOs shifted by 5-nucleotide intervals.

Example 9: Design of ASO-Walk Targeting Intron 25 and 26 of TSC2

Figure 16:
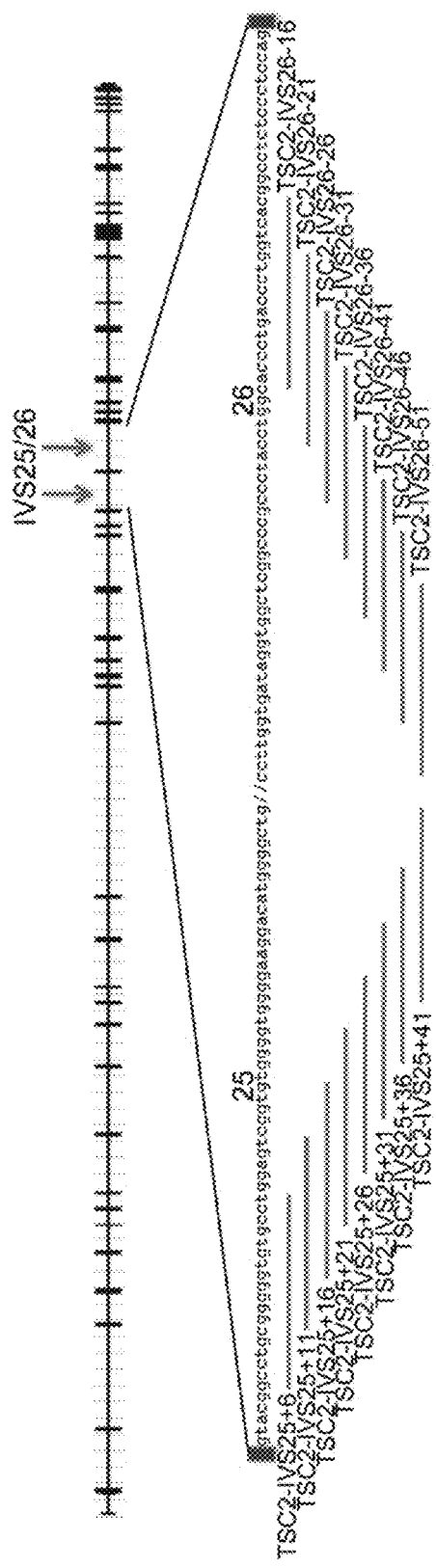
FIG. 16 shows TSC2 gene IVS 25 and 26 ASO walk. A graphic representation of the ASO walk performed for TSC2 IVS 25 and 26 targeting sequences immediately downstream of the 5' splice site of intron 25 or upstream of the 3' splice site of intron 26 using 2'-O-Me ASOs, PS backbone, is shown. The splice site intronic regions flanking alternative exon 26 are not targeted to avoid affecting the inclusion level of exon 26. ASOs were designed to cover these regions by shifting 5 nucleotides at a time. The TSC2 exon-intron structure is drawn to scale.

An ASO walk was designed to target introns 25 and 26 using the method described herein (FIG. 16; Table 4). A region immediately downstream of the intron 25 5' splice site spanning nucleotides +6 to +58 and a region immediately upstream of intron 26 3' splice site spanning nucleotides −16 to −68 of the intron were targeted with 2'-O-Me RNA, PS backbone, 18-mer ASOs shifted by 5-nucleotide intervals. The splice site intronic regions flanking alternative exon 26 are not targeted to avoid affecting the inclusion level of exon 26.

Example 10: Design of ASO-Walk Targeting Intron 31 and 32 of TSC2

Figure 18:
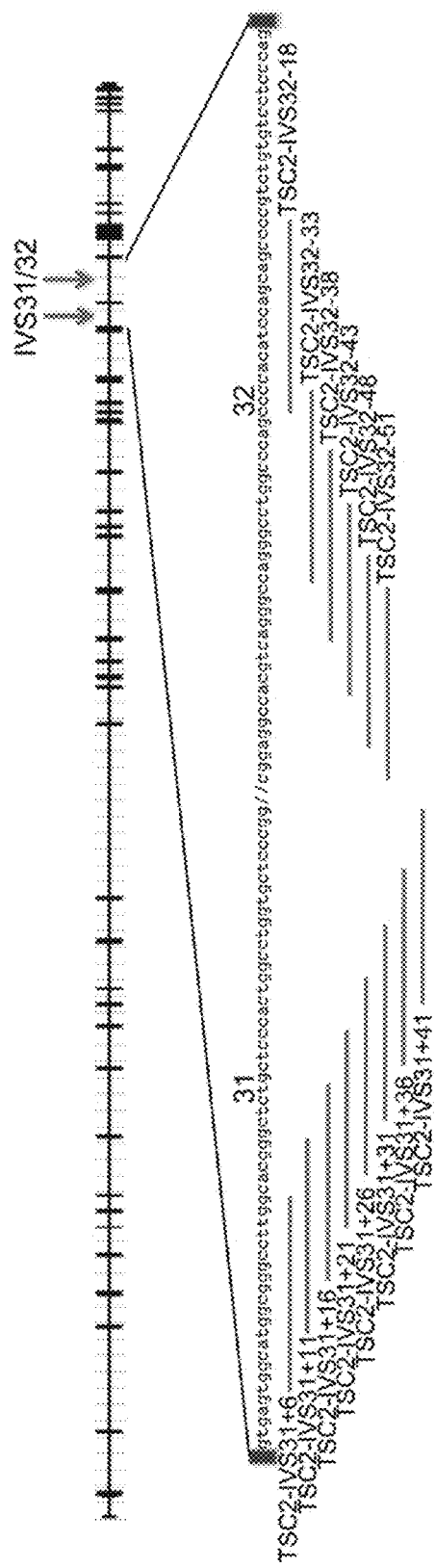
FIG. 18 shows TSC2 gene IVS 31 and 32 ASO walk. A graphic representation of the ASO walk performed for TSC2 IVS 31 and 32 targeting sequences immediately downstream of the 5' splice site of intron 31 or upstream of the 3' splice site of intron 32 using 2'-O-Me ASOs, PS backbone, is shown. The splice site intronic regions flanking alternative exon 32 are not targeted to avoid affecting the inclusion level of exon 32. ASOs were designed to cover these regions by shifting 5 nucleotides at a time with the exception of TSC2-IVS32-33 and TSC2-IVS32-51. The TSC2 exon-intron structure is drawn to scale.
Figure 19:
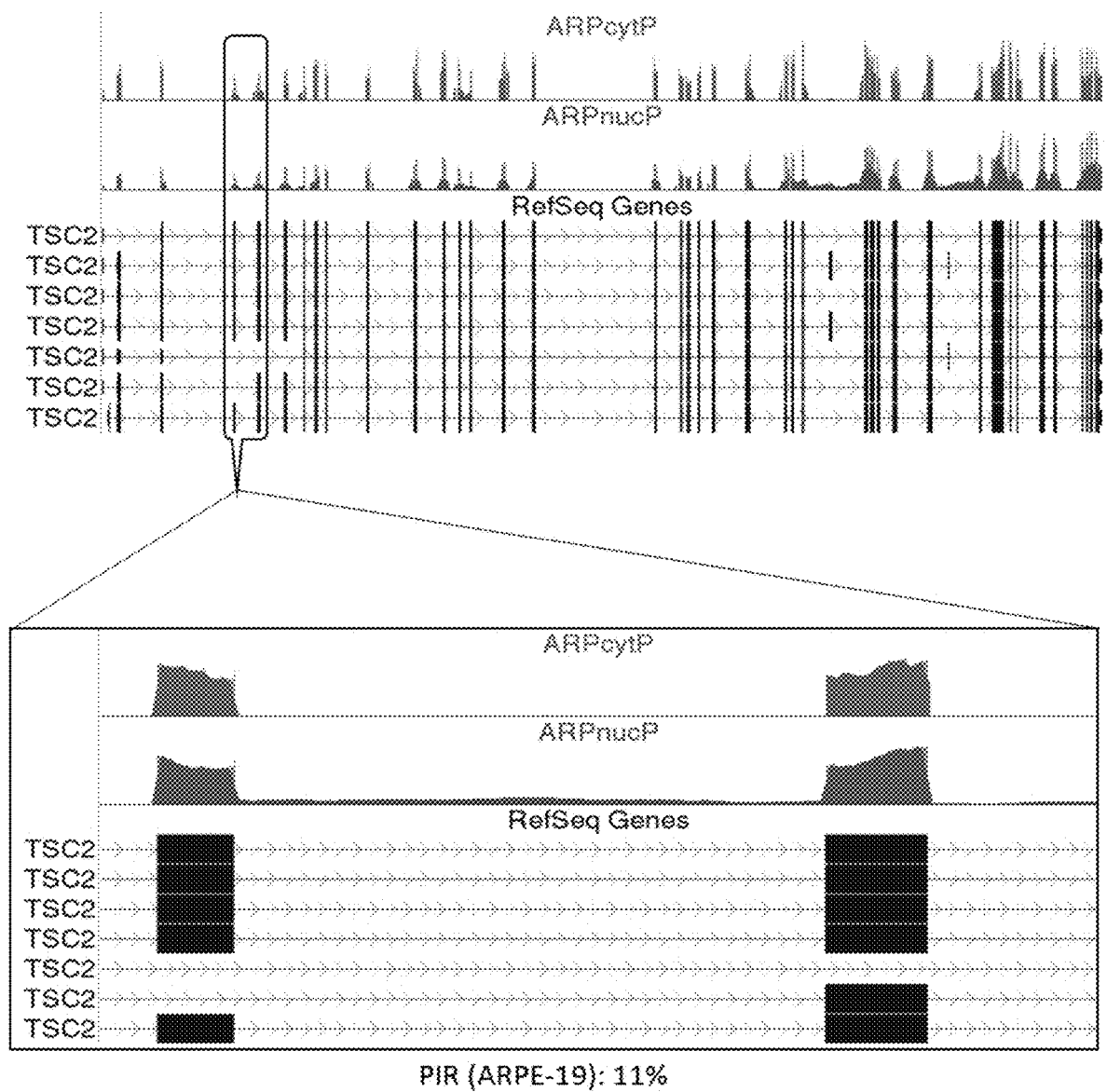
FIG. 19 depicts a schematic of the RefSeq Genes for TSC2 intron 4 corresponding to NM_000548. The Percent Intron Retention (PIR) of the circled intron is shown.

An ASO walk was designed to target introns 31 and 32 using the method described herein (FIG. 18; Table 4). A region immediately downstream of the 5' splice site of intron 31 spanning nucleotides +6 to +58 and a region immediately upstream 3' splice site of intron 32 spanning nucleotides −18 to −68 were targeted with 2'-O-Me RNA, PS backbone, 18-mer ASOs shifted by 5-nucleotide intervals (with the exception of 2 ASOs, TSC2-IVS32-33 and TSC2-IVS32-51). The splice site intronic regions flanking alternative exon 32 are not targeted to avoid affecting the inclusion level of exon 32.

Figure 20:
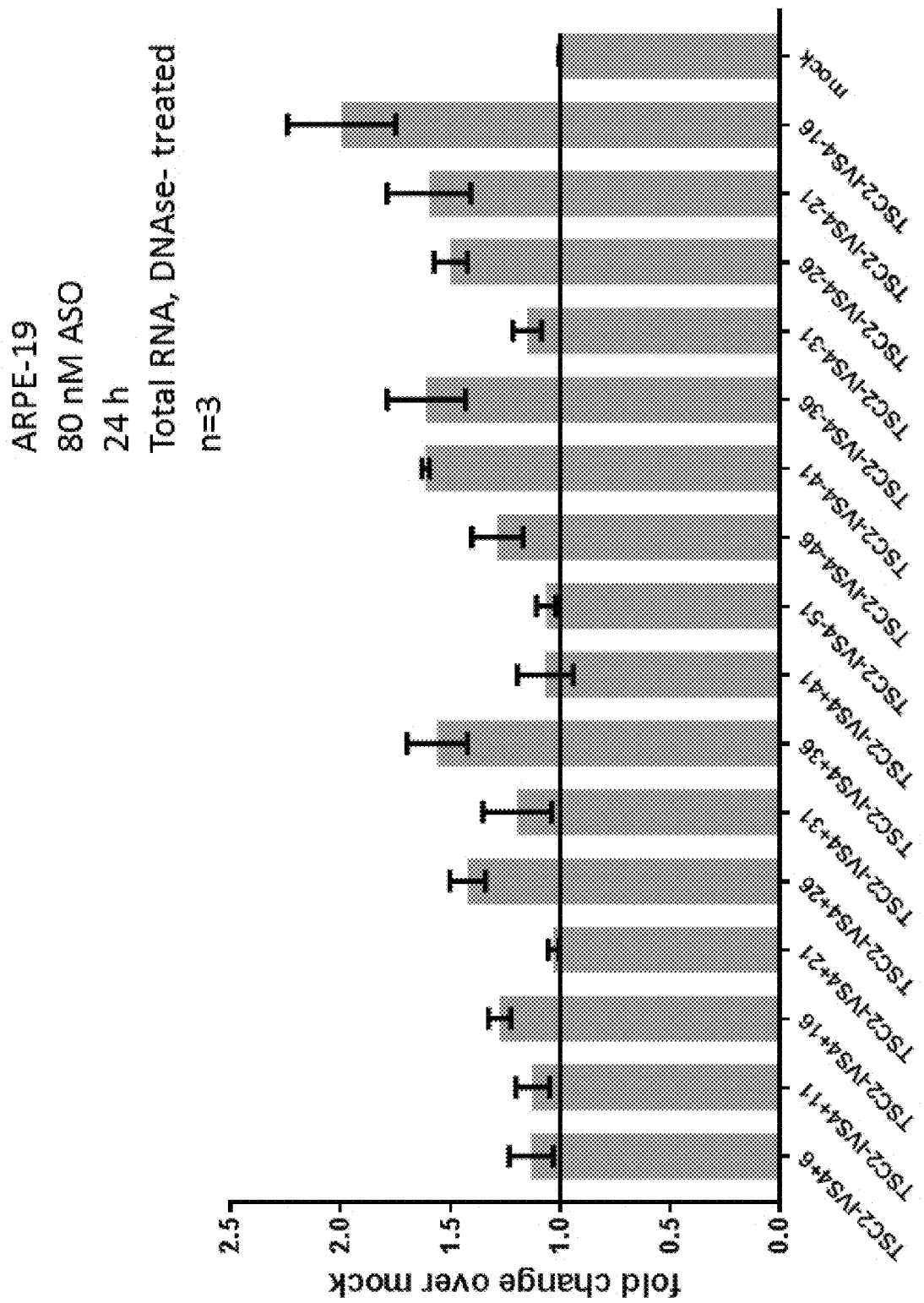
FIG. 20 depicts an exemplary graph showing the average (n=3) fold change in expression levels of TSC2 mRNA without intron 4 in ARPE-19 cells treated for 24 hrs with 80 nM of the indicated ASOs over mock treated cells. Data is normalized to RPL32 expression.
Figure 21:
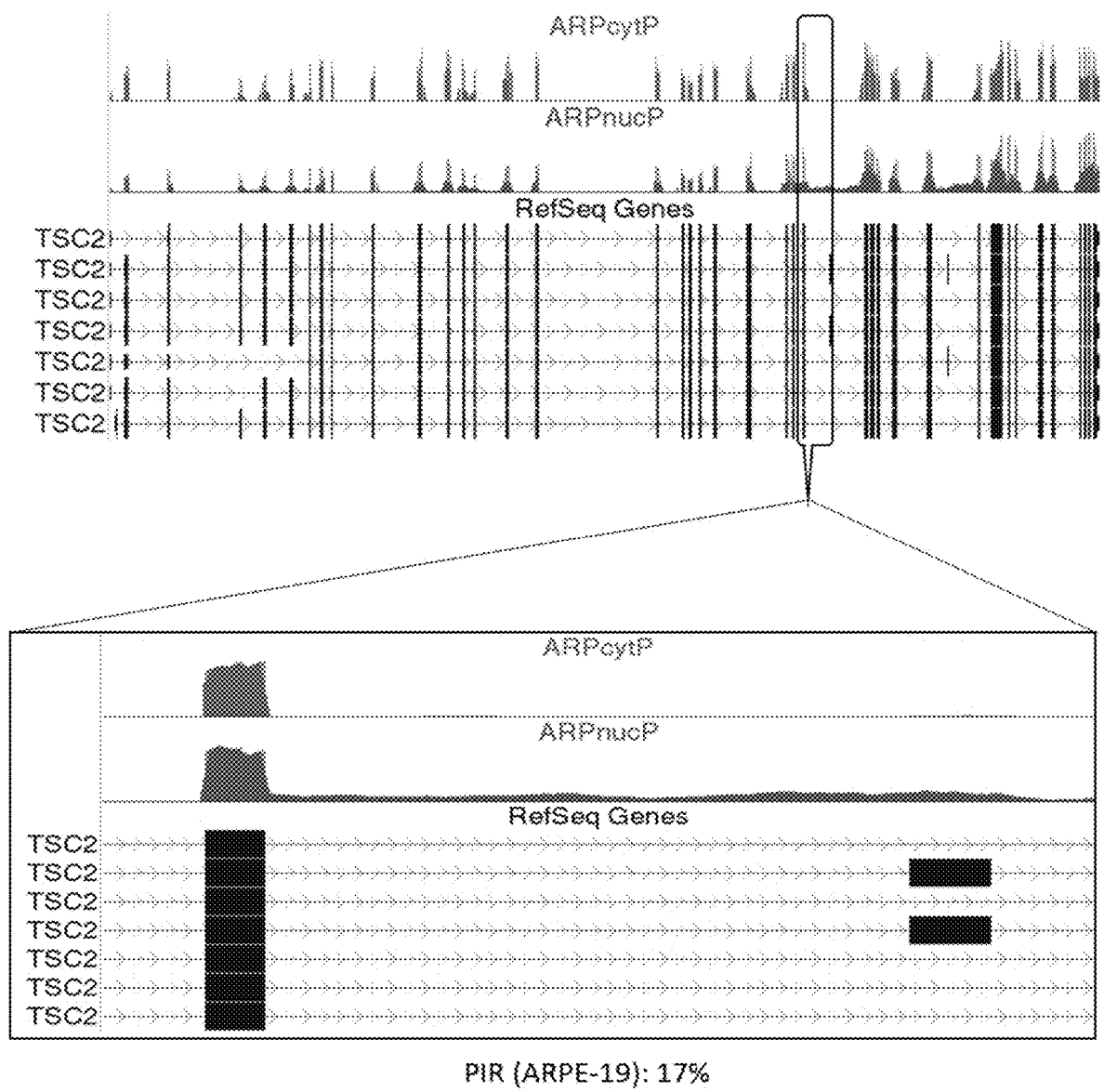
FIG. 21 depicts a schematic of the RefSeq Genes for TSC2 intron 25 corresponding to NM_000548. The Percent Intron Retention (PIR) of the circled intron is shown.
Figure 22:
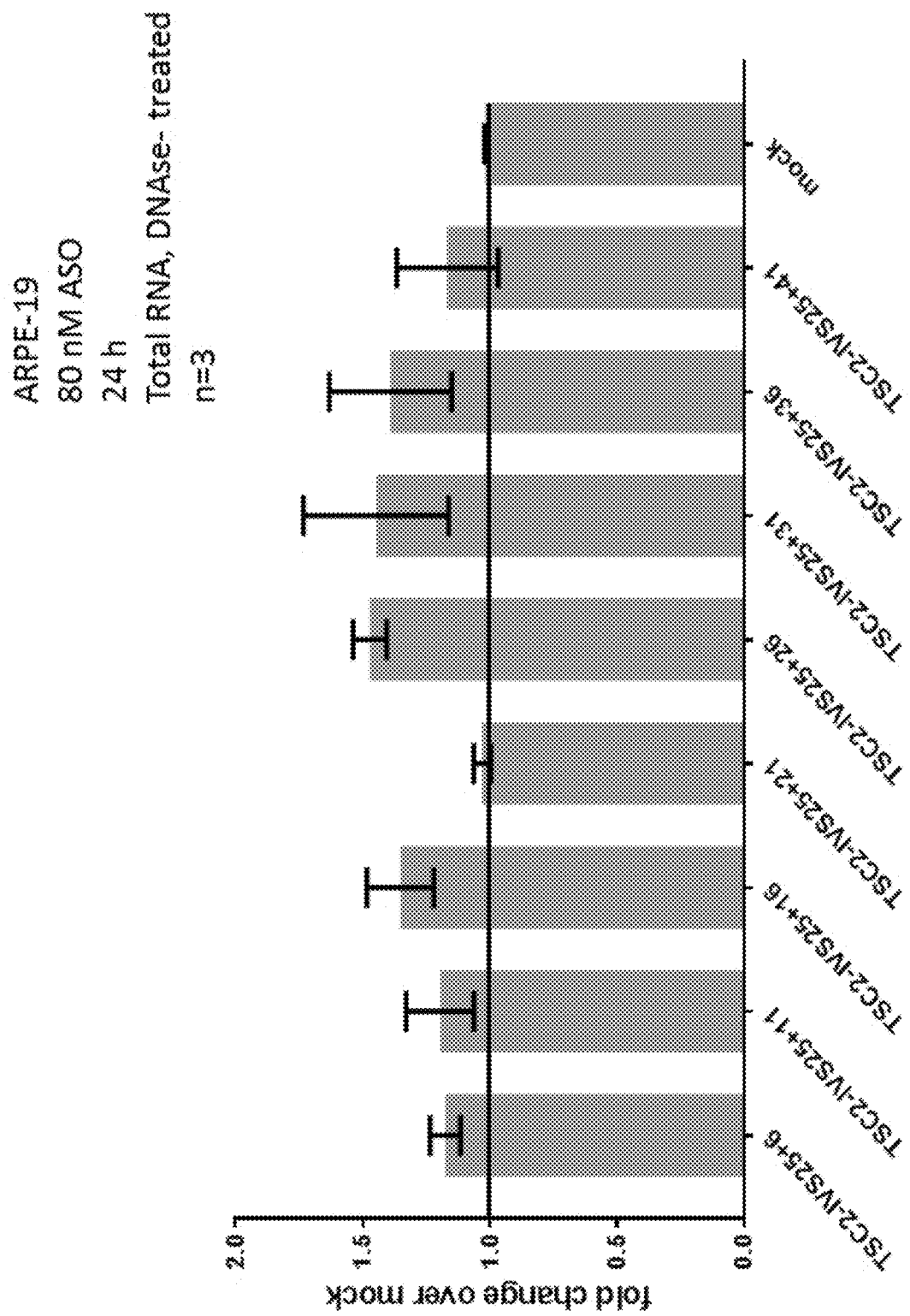
FIG. 22 depicts an exemplary graph showing the average (n=3) fold change in expression levels of TSC2 mRNA without intron 25 in ARPE-19 cells treated for 24 hrs with 80 nM of the indicated ASOs over mock treated cells. Data is normalized to RPL32 expression.
Figure 23:
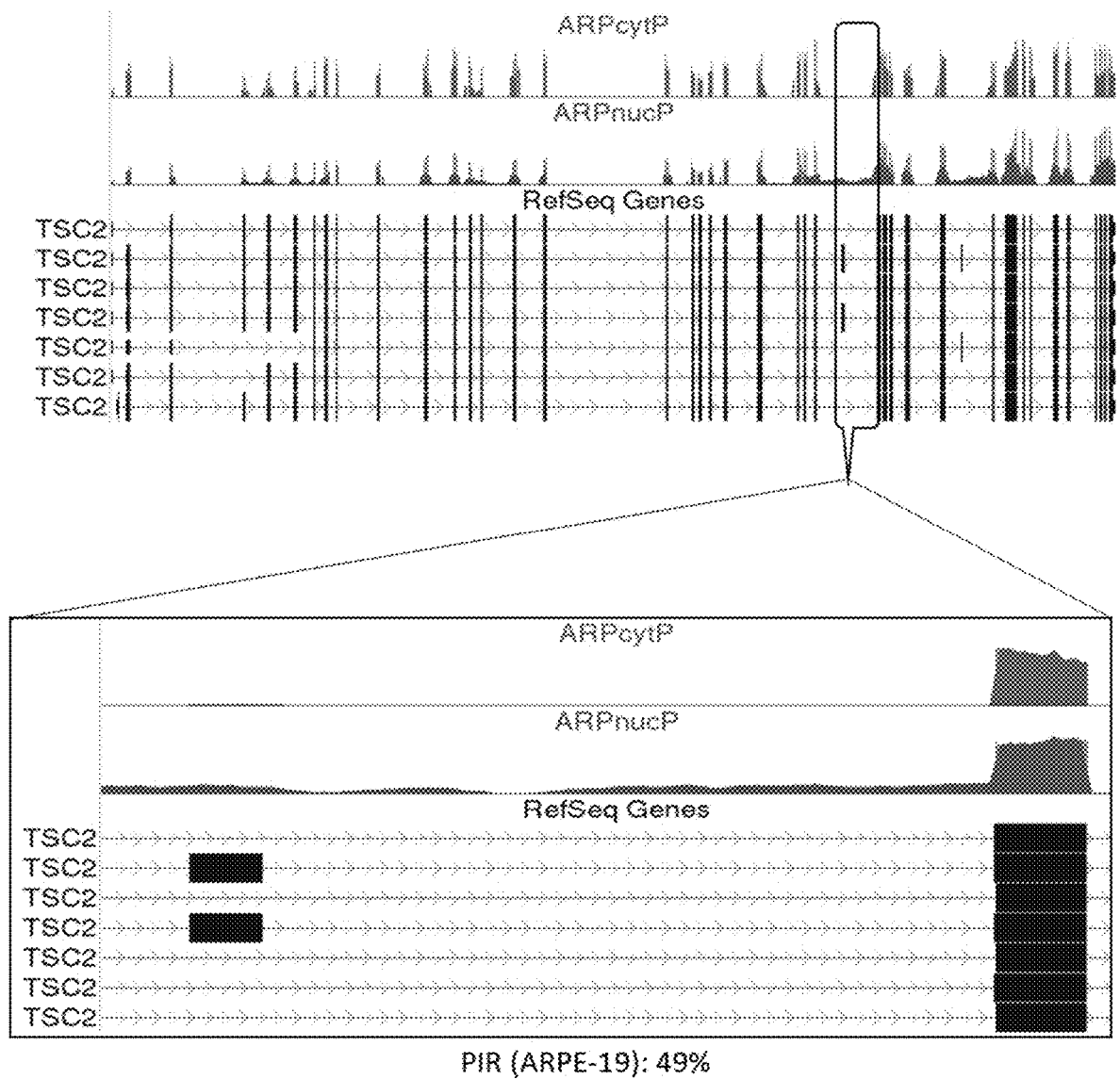
FIG. 23 depicts a schematic of the RefSeq Genes for TSC2 intron 26 corresponding to NM_000548. The Percent Intron Retention (PIR) of the circled intron is shown.
Figure 24:
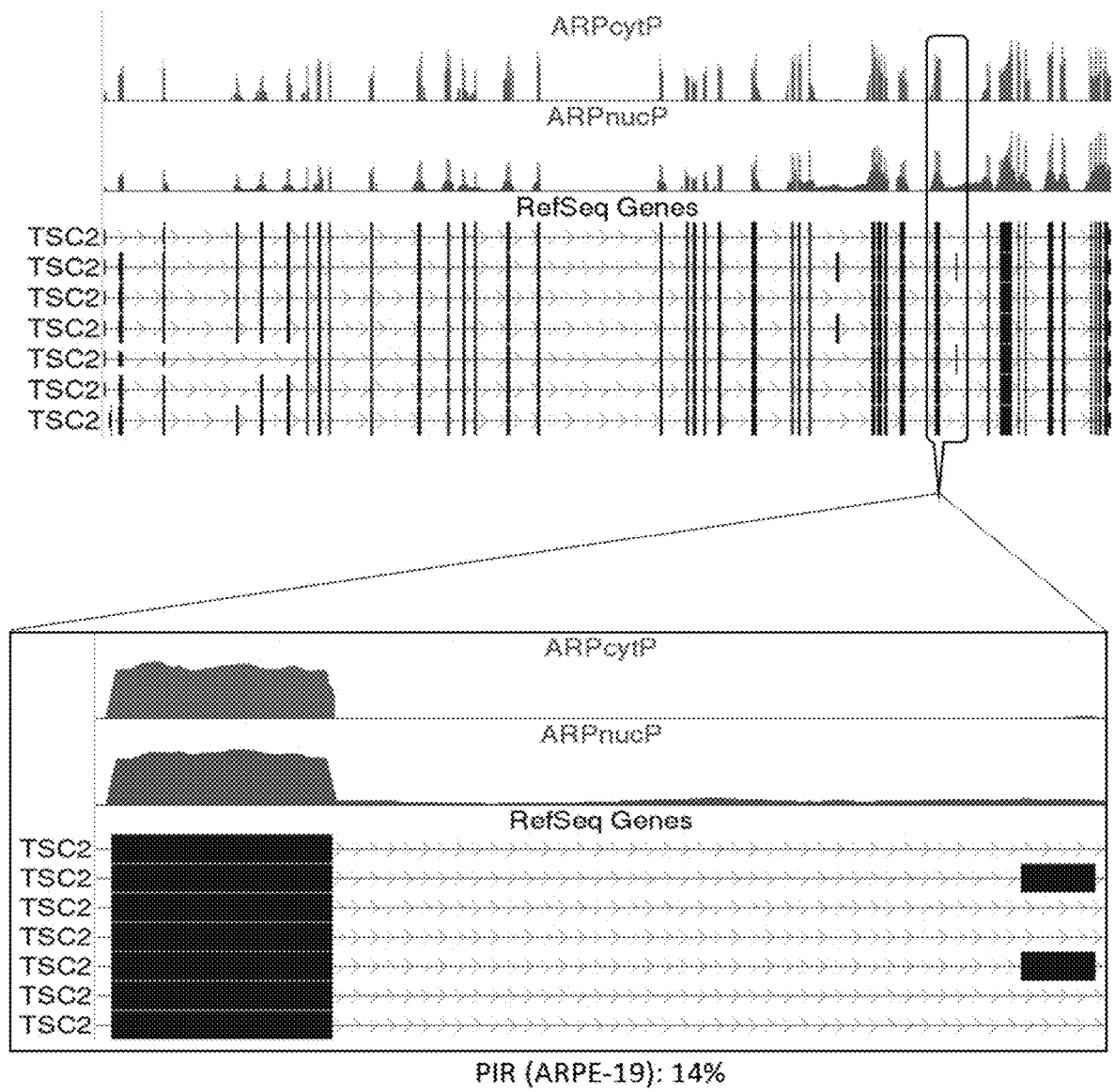
FIG. 24 depicts a schematic of the RefSeq Genes for TSC2 intron 31 corresponding to NM_000548. The Percent Intron Retention (PIR) of the circled intron is shown.
Figure 25:
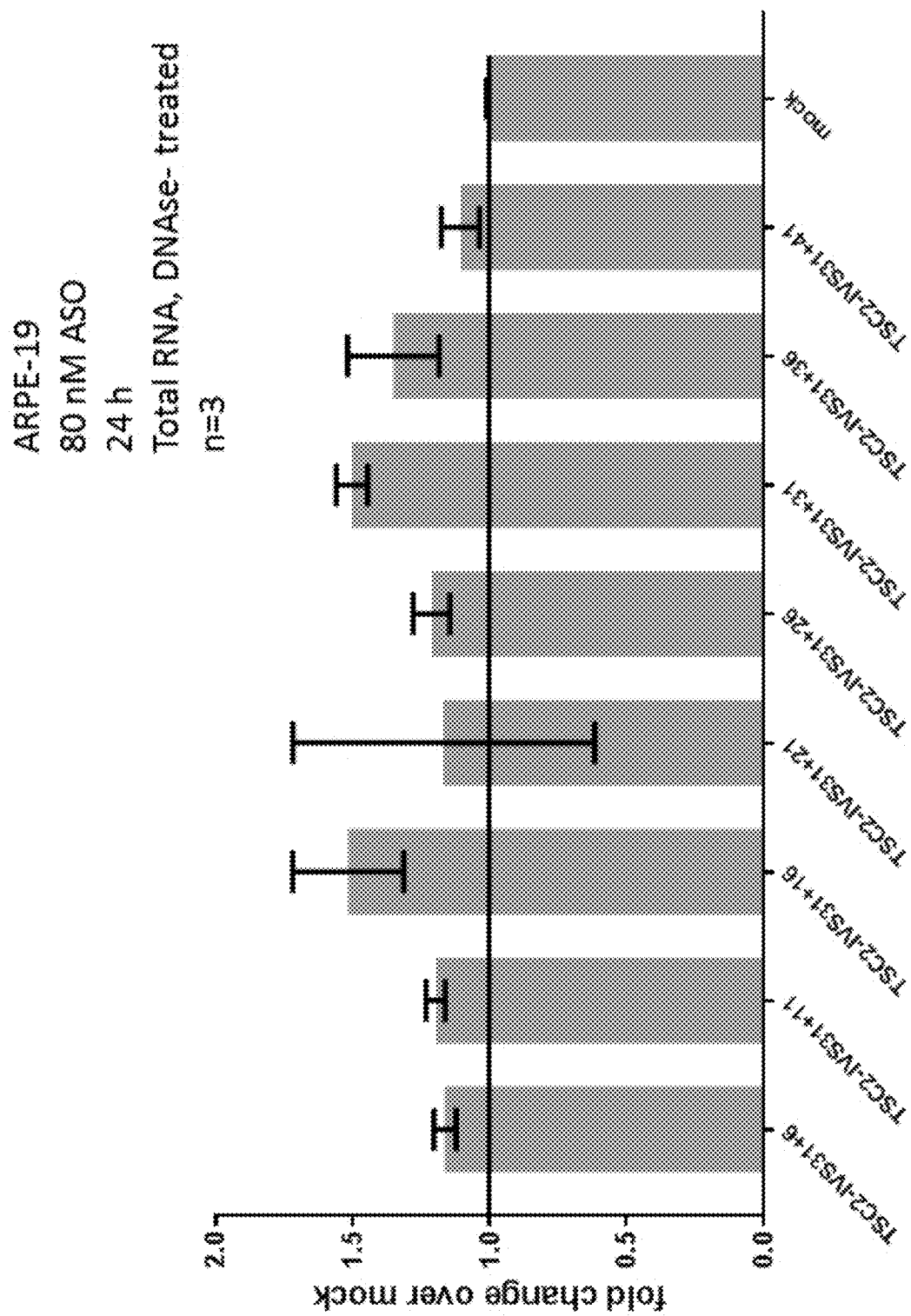
FIG. 25 depicts an exemplary graph showing the average (n=3) fold change in expression levels of TSC2 mRNA without intron 31 in ARPE-19 cells treated for 24 hrs with 80 nM of the indicated ASOs over mock treated cells. Data is normalized to RPL32 expression.
Figure 26:
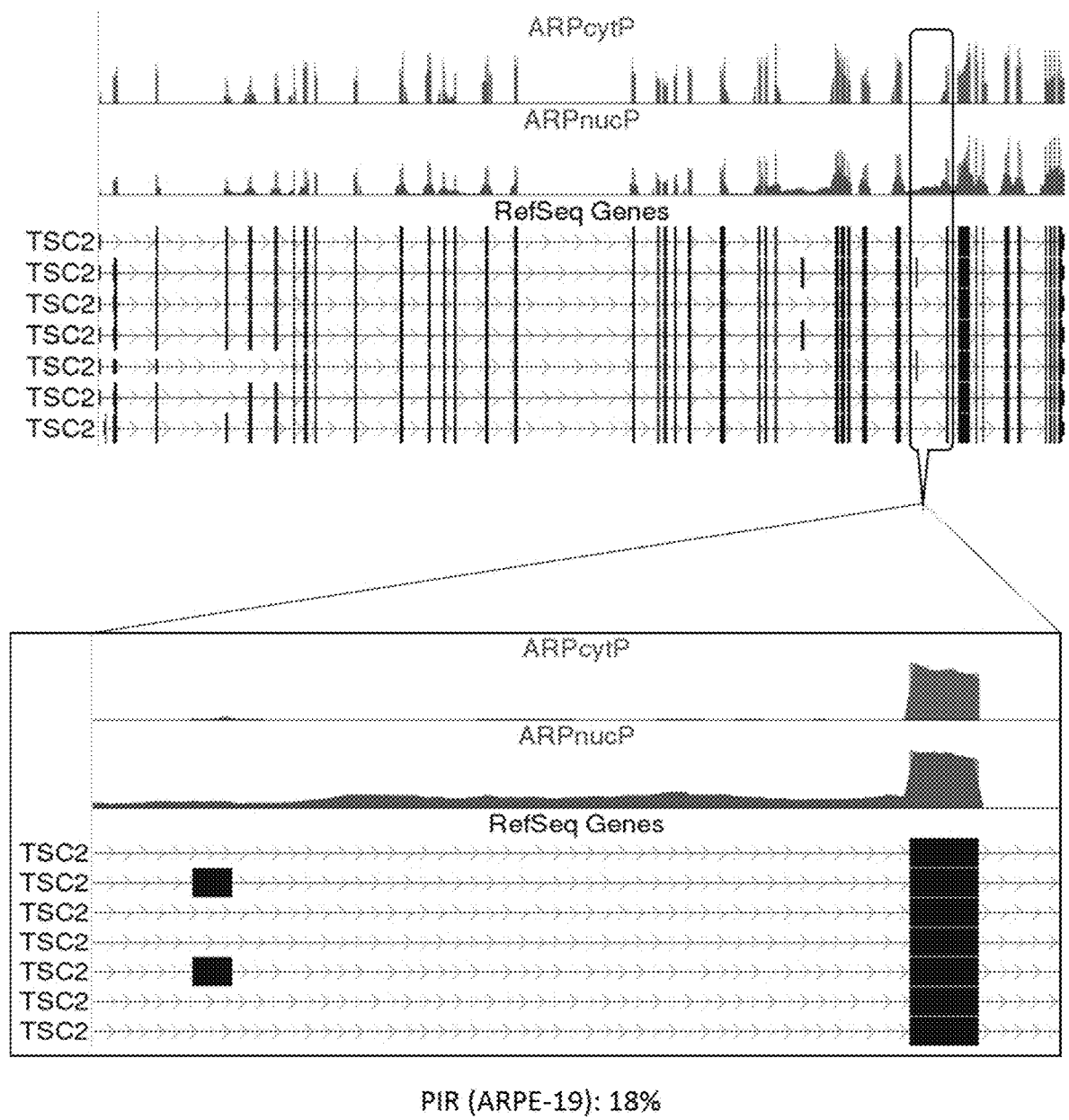
FIG. 26 depicts a schematic of the RefSeq Genes for TSC2 intron 32 corresponding to NM_000548. The Percent Intron Retention (PIR) of the circled intron is shown.

Example 11: Improved Splicing Efficiency Via ASO-Targeting of TSC2 Intron 4, 25, 26, 31 or 32 Increases Transcript Levels To determine whether an increase in TSC2 expression could be achieved by improving splicing efficiency of TSC2 intron 4, 25, 26, 31 or 32 using ASOs, RT-PCR products were evaluated using radioactive RT-PCR and RT-qPCR. ARPE-19 cells, a human retinal epithelium cell line (American Type Culture Collection (ATCC), USA), or Huh-7, a human hepatoma cell line (NIBIOHN, Japan), or SK-N-AS, a human neuroblastoma cell line (ATCC) were mock-transfected, or transfected with the targeting ASOs described in FIG. 20, FIG. 22, FIG. 25 and Tables 1-2. Cells were transfected using Lipofectamine RNAiMax transfection reagent (Thermo Fisher) according to vendor's specifications. Briefly, ASOs were plated in 96-well tissue culture plates and combined with RNAiMax diluted in Opti-MEM. Cells were detached using trypsin and resuspended in full medium, and approximately 25,000 cells were added the ASO-transfection mixture. Transfection experiments were carried out in triplicate plate replicates. Final ASO concentration was 80 nM. Media was changed 6h post-transfection, and cells harvested at 24h, using the Cells-to-Ct lysis reagent, supplemented with DNAse (Thermo Fisher), according to vendor's specifications. cDNA was generated with Cells-to-Ct RT reagents (Thermo Fisher) according to vendor's specifications. To quantify the amount of splicing at the intron of interest, quantitative PCR was carried out using Taqman assays with probes spanning the corresponding exon-exon junction (Thermo Fisher), listed in Tables 1-2. Taqman assays were carried out according to vendor's specifications, on a QuantStudio 7 Flex Real-Time PCR system (Thermo Fisher). Target gene assay values were normalized to RPL32 (deltaCt) and plate-matched mock transfected samples (delta-delta Ct), generating fold-change over mock quantitation (2^-(delta-deltaCt). Average fold-change over mock of the three plate replicates was plotted (FIG. 20, FIG. 22 and FIG. 25). In FIG. 20, FIG. 22 and FIG. 25, several ASOs were identified to increase the target gene expression, indicating an increase in splicing at the respective target intron.

TABLE 4

ASOs targeting the TSC2 Gene

| SEQ ID NO | ASO Name | Sequence 5' to 3' | Intron |
|---|---|---|---|
| 689, 1760, 2343, 3210, 4452 | TSC2-IVS4 + 6 | cccagcgucgcccugggc | 4 |
| 690, 1761, 2344, 3211, 4453 | TSC2-IVS4 + 11 | cccaucccagcgucgccc | 4 |
| 691, 1762, 2345, 3212, 4454 | TSC2-IVS4 + 16 | cgucacccaucccagcgu | 4 |
| 692, 1763, 2346, 3213, 4455 | TSC2-IVS4 + 21 | ccugacgucacccauccc | 4 |
| 693, 1764, 2347, 3214, 4456 | TSC2-IVS4 + 26 | ggcagccugacgucaccc | 4 |
| 694, 1765, 2348, 3215, 4457 | TSC2-IVS4 + 31 | cagugggcagccugacgu | 4 |
| 695, 1766, 2349, 3216, 4458 | TSC2-IVS4 + 36 | acagucagugggcagccu | 4 |
| 696, 1767, 2350, 3217, 4459 | TSC2-IVS4 + 41 | acaggacagucagugggc | 4 |
| 840, 1911, 2494, 3361, 4603, 5276 | TSC2-IVS4 − 16 | acaggaucagcagagccu | 4 |
| 839, 1910, 2493, 3360, 4602, 5275 | TSC2-IVS4 − 21 | aucagcagagccugccag | 4 |
| 838, 1909, 2492, 3359, 4601, 5274 | TSC2-IVS4 − 26 | cagagccugccagcgucg | 4 |
| 837, 1908, 2491, 3358, 4600, 5273 | TSC2-IVS4 − 31 | ccugccagcgucgcccac | 4 |
| 836, 1907, 2490, 3357, 4599, 5272 | TSC2-IVS4 − 36 | cagcgucgcccacacggc | 4 |
| 835, 1906, 2489, 3356, 4598, 5271 | TSC2-IVS4 − 41 | ucgcccacacggcugcca | 4 |
| 834, 1905, 2488, 3355, 4597, 5270 | TSC2-IVS4 − 46 | cacacggcugccaagaag | 4 |

TABLE 4-continued

ASOs targeting the TSC2 Gene

| SEQ ID NO | ASO Name | Sequence 5' to 3' | Intron |
|---|---|---|---|
| 833, 1904, 2487, 3354, 4596, 5269 | TSC2-IVS4 - 51 | ggcugccaagaagucccu | 4 |
| 460, 1316, 2114, 2766, 4001, 4223, 4875 | TSC2-IVS25 + 6 | aggcacaccccgcaggc | 25 |
| 461, 1317, 2115, 2767, 4002, 4224, 4876 | TSC2-IVS25 + 11 | acuccaggcacacccccg | 25 |
| 462, 1318, 2116, 2768, 4003, 4225, 4877 | TSC2-IVS25 + 16 | caccgacuccaggcacac | 25 |
| 463, 1319, 2117, 2769, 4004, 4226, 4878 | TSC2-IVS25 + 21 | ccccacaccgacuccagg | 25 |
| 464, 1320, 2118, 2770, 4005, 4227, 4879 | TSC2-IVS25 + 26 | ccccaccccacaccgacu | 25 |
| 465, 1321, 2119, 2771, 4006, 4228, 4880 | TSC2-IVS25 + 31 | uccuuccccaccccacac | 25 |
| 466, 1322, 2120, 2772, 4007, 4229, 4881 | TSC2-IVS25 + 36 | ccauguccuuccccaccc | 25 |
| 467, 1323, 2121, 2773, 4008, 4230, 4882 | TSC2-IVS25 + 41 | cagccccauguccuuccc | 25 |
| 639, 1710, 3160, 5054 | TSC2-IVS26 - 16 | gugaccagggucagggug | 26 |
| 638, 1709, 3159, 5053 | TSC2-IVS26 - 21 | cagggucagggugccagg | 26 |
| 637, 1708, 3158, 5052 | TSC2-IVS26 - 26 | ucagggugccagguaggg | 26 |
| 636, 1707, 3157, 5051 | TSC2-IVS26 - 31 | gugccagguagggcgggc | 26 |
| 635, 1706, 3156, 5050 | TSC2-IVS26 - 36 | agguagggcgggccgagc | 26 |
| 634, 1705, 3155, 5049 | TSC2-IVS26 - 41 | gggcgggccgagccaccu | 26 |
| 633, 1704, 3154, 5048 | TSC2-IVS26 - 46 | ggccgagccaccuaucac | 26 |
| 632, 1703, 3153, 5047 | TSC2-IVS26 - 51 | agccaccuaucaccaagg | 26 |
| 899, 1970, 2553, 3420, 3653, 4662, 5335 | TSC2-IVS31 + 6 | ccaaggcccgccaugcca | 31 |
| 900, 1971, 2554, 3421, 3654, 4663, 5336 | TSC2-IVS31 + 11 | ccgugccaaggcccgcca | 31 |
| 901, 1872, 2555, 3422, 3655, 4664, 5337 | TSC2-IVS31 + 16 | agagcccgugccaaggcc | 31 |
| 902, 1973, 2556, 3423, 3656, 4665, 5338 | TSC2-IVS31 + 21 | ggagcagagcccgugcca | 31 |
| 903, 1974, 2557, 3424, 3657, 4666, 5339 | TSC2-IVS31 + 26 | cagugggagcagagcccg | 31 |
| 904, 1975, 2558, 3425, 3658, 4667, 5340 | TSC2-IVS31 + 31 | caggccagugggagcaga | 31 |
| 905, 1976, 2559, 3426, 3659, 4668, 5341 | TSC2-IVS31 + 36 | agcaccaggccaguggga | 31 |
| 906, 1977, 2560, 3427, 3660, 4669, 5342 | TSC2-IVS31 + 41 | ccgggagcaccaggccag | 31 |
| 150762 | TSC2-IVS32 - 18 | gggcugcuggauguggg | 32 |
| 150763 | TSC2-IVS32 - 33 | gggcugggccaggcccug | 32 |
| 150764 | TSC2-IVS32 - 38 | gggccaggcccuggcccu | 32 |
| 150765 | TSC2-IVS32 - 43 | aggcccuggcccugacgu | 32 |
| 150766 | TSC2-IVS32 - 48 | cuggcccugacguggccu | 32 |
| 1078, 1282, 2732, 3599, 3967, 4841, 5514 | TSC2-IVS32 - 51 | gcccugacguggccuccg | 32 |

Figure 27:
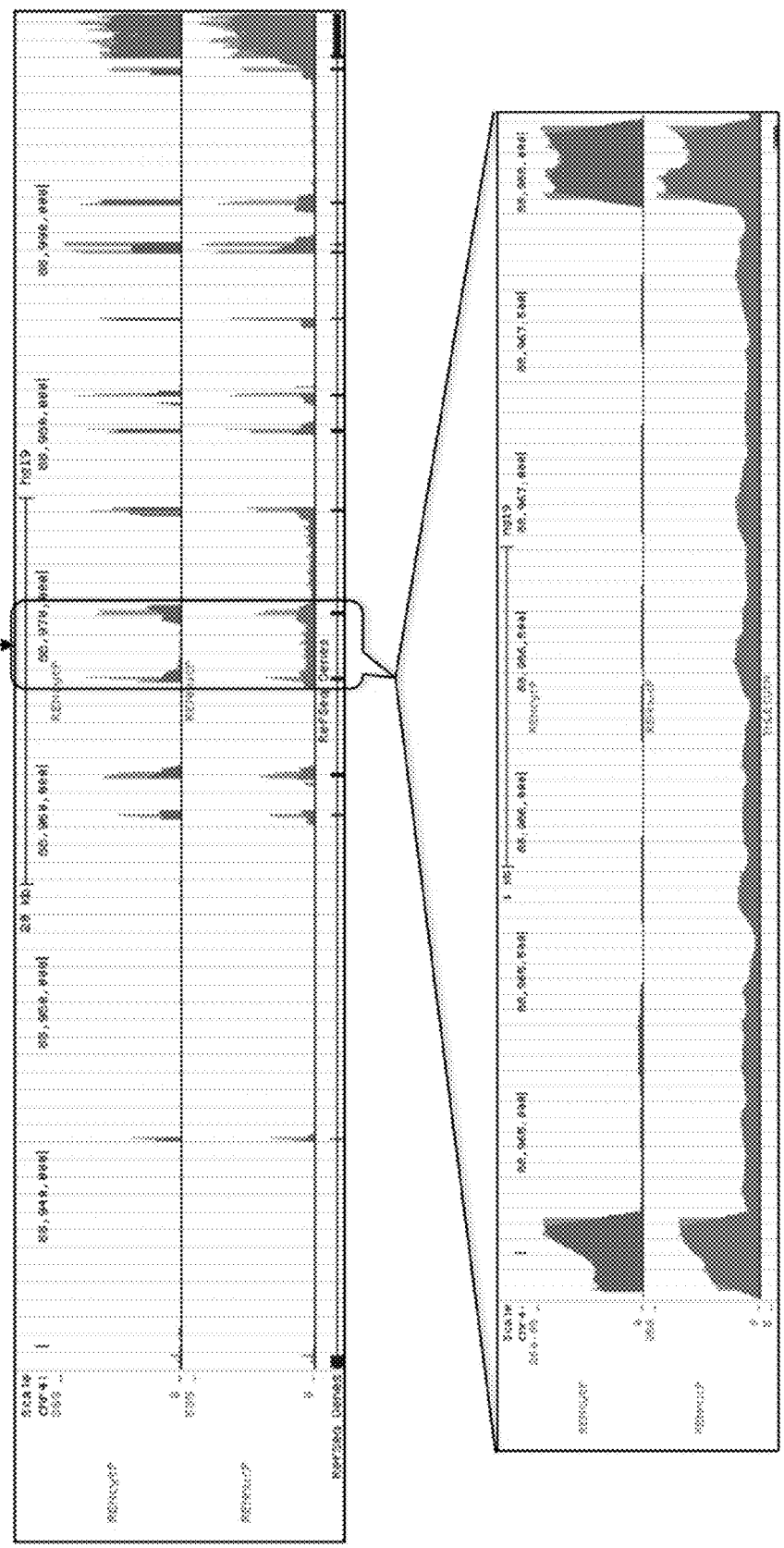
FIG. 27 depicts intron-retention in the PKD2 gene with intron 5 shown in detail. The identification of intron-retention events in the PKD2 gene using RNA sequencing (RNAseq) is shown, visualized in the UCSC genome browser. The upper panel shows the read density corresponding to the PKD2 transcript expressed in renal epithelial cells and localized in either the cytoplasmic (top) or nuclear fraction (bottom). At the bottom of this panel, a graphic representation of the PKD2 gene is shown to scale. The read density is shown as peaks. The highest read density corresponds to exons (black boxes), while no reads are observed for the majority of the introns in either cellular fraction. Higher read density is detected for intron 5 (pointed by the arrow) in the nuclear fraction compared to the cytoplasmic fraction indicating that splicing efficiency of intron 5 is low, resulting in intron retention. The retained-intron containing pre-mRNA transcripts are retained in the nucleus and are not exported out to the cytoplasm. The read density for intron 5 in renal epithelial cells is shown in detail in the lower panel.

Example 12: Identification of Intron Retention Events in PKD2 Transcripts by RNAseq Using Next Generation Sequencing Whole transcriptome shotgun sequencing was carried out using next generation sequencing to reveal a snapshot of transcripts produced by the PKD2 gene to identify intron-retention events. For this purpose, polyA+ RNA from nuclear and cytoplasmic fractions of renal epithelial cells was isolated and cDNA libraries constructed using Illumina's TruSeq Stranded mRNA library Prep Kit. The libraries were pair-end sequenced resulting in 100-nucleotide reads that were mapped to the human genome (February 2009, GRCh37/hg19 assembly). The sequencing results for PKD2 are shown in FIG. 27. Briefly, FIG. 27 shows the mapped reads visualized using the UCSC genome browser (operated by the UCSC Genome Informatics Group (Center for Biomolecular Science & Engineering, University of California, Santa Cruz, 1156 High Street, Santa Cruz, Calif. 95064) and described by, e.g., Rosenbloom, et al., 2015, "The UCSC Genome Browser database: 2015 update," Nucleic Acids Research 43, Database Issue, doi: 10.1093/nar/gku1177) and the coverage and number of reads can be inferred by the peak signals. The height of the peaks indicates the level of expression given by the density of the reads in a particular region. A schematic representation of PKD2 (drawn to scale) is provided by the UCSC genome browser (below the read signals) so that peaks can be matched to PKD2 exonic and intronic regions. Based on this display, we identified one intron (intron 5, as indicated) that has high read density in the nuclear fraction of HCN, but very low to no reads in the cytoplasmic fraction of these cells (as shown for intron 5 in the bottom diagram of FIG. 27). This indicates that intron 5 is retained and that the intron-5 containing transcripts remain in the nucleus, suggesting that this retained PKD2 RIC pre-mRNAs is non-productive, as it is not exported out to the cytoplasm.

Example 13: Design of ASO-Walk Targeting Intron 5 of PKD2

Figure 28:
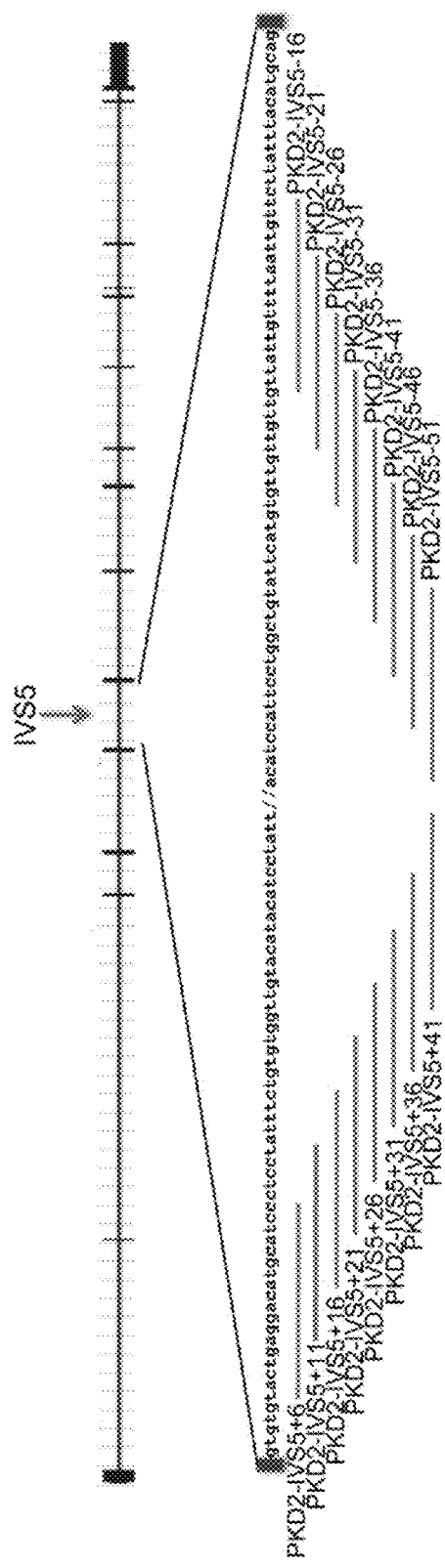
FIG. 28 depicts an exemplary PKD2 gene intron 5 (IVS 5) ASO walk. A graphic representation of the ASO walk performed for PKD2 IVS 5 targeting sequences immediately downstream of the 5' splice site or upstream of the 3' splice site using 2'-O-Me ASOs, PS backbone, is shown. ASOs were designed to cover these regions by shifting 5 nucleotides at a time. The PKD2 exon-intron structure is drawn to scale.

An ASO walk was designed to target intron 5 using the method described herein (FIG. 28; Table 5, SEQ ID NOS: 5547-5824). A region immediately upstream and downstream of the 5' splice site of intron 5, spanning nucleotides +497 to −204e, and a region immediately upstream and downstream of the 3' splice site of intron 5, spanning nucleotides −496 to +212e were utilized to design ASOs to target retained intron 5 PKD2 RIC pre-mRNAs. Table 5 lists exemplary ASOs that were designed and their target sequences. From this design, 2'-O-Me RNA, PS backbone, 18-mer ASOs shifted by 5-nucleotide intervals can be produced and utilized to target PKD2 RIC pre-mRNAs to increase PC-2 protein production.

TABLE 5

List of ASOs targeting the PKD2 gene

| Gene SEQ ID NO: | Pre-mRNA SEQ ID NO: | ASOs | Retained Intron | Target Sequence SEQ ID NO: |
| --- | --- | --- | --- | --- |
| PKD2 SEQ ID NO: 5545 | PKD2: NM_000297 SEQ ID NO: 5546 | SEQ ID NOs: 5547-5824 | Intron 5 | SEQ ID NO: 5825 |

Example 14: Improved Splicing Efficiency Via ASO-Targeting of PKD2 Intron 5 Increases Transcript Levels To determine whether an increase in PKD2 expression could be achieved by improving splicing efficiency of PKD2 intron 5 using ASOs, the method described herein can be used. Cell lines of interest (e.g., ARPE-19 cells, a human retinal epithelium cell line (American Type Culture Collection (ATCC), USA), or Huh-7, a human hepatoma cell line (NIBIOHN, Japan), or SK-N-AS, a human neuroblastoma cell line (ATCC)) are mock-transfected, or transfected with the targeting ASOs described in Table 5. Cells are transfected using Lipofectamine RNAiMax transfection reagent (Thermo Fisher) according to manufacturer's specifications. Briefly, ASOs are plated in 96-well tissue culture plates and combined with RNAiMax diluted in Opti-MEM. Cells are detached using trypsin, resuspended in full medium, and approximately 25,000 cells are added to the ASO-transfection mixture. Transfection experiments are carried out in triplicate plate replicates. Final ASO concentration is 80 nM. Media is changed 6h post-transfection, and cells are harvested at 24h, using the Cells-to-Ct lysis reagent, supplemented with DNAse (Thermo Fisher), according to manufacturer's specifications. cDNA is generated with Cells-to-Ct RT reagents (Thermo Fisher) according to manufacturer's specifications. To quantify the amount of splicing at the intron of interest, quantitative PCR is carried out using Taqman assays with probes spanning the corresponding exon-exon junction (Thermo Fisher), listed in Table 5. Taqman assays are carried out according to manufacturer's specifications, on a QuantStudio 7 Flex Real-Time PCR system (Thermo Fisher). Target gene assay values are normalized to RPL32 (deltaCt) and plate-matched mock transfected samples (delta-delta Ct), generating fold-change over mock quantitation (2^-(delta-deltaCt). Average fold-change over mock of the three plate replicates is plotted. ASOs identified as increasing the target gene expression by a threshold amount imply an increase in splicing at that target intron. Together with whole transcriptome data confirming retention of the target intron (FIG. 27), these results confirm that ASOs can improve the splicing efficiency of a rate limiting intron.

Example 15: Identification of Intron Retention Events in PRPF3 Transcripts by RNAseq Using Next Generation Sequencing Whole transcriptome shotgun sequencing was carried out using next generation sequencing to reveal a snapshot of transcripts produced by the PRPF3 gene to identify intron-retention events. For this purpose, polyA+ RNA from nuclear and cytoplasmic fractions of ARPE-19 (retinal epithelial) cells was isolated and cDNA libraries constructed using Illumina's TruSeq Stranded mRNA library Prep Kit. The libraries were pair-end sequenced resulting in 100-nucleotide reads that were mapped to the human genome (February 2009, GRCh37/hg19 assembly). The sequencing results for PRPF3 are shown in FIG. 3. Briefly, FIG. 3 shows the mapped reads visualized using the UCSC genome browser (operated by the UCSC Genome Informatics Group (Center for Biomolecular Science & Engineering, University of California, Santa Cruz, 1156 High Street, Santa Cruz, Calif. 95064) and described by, e.g., Rosenbloom, et al., 2015, "The UCSC Genome Browser database: 2015 update," Nucleic Acids Research 43, Database Issue, doi: 10.1093/nar/gku1177) and the coverage and number of reads can be inferred by the peak signals. The height of the peaks indicates the level of expression given by the density of the reads in a particular region. A schematic representation of PRPF3 (drawn to scale) is provided by the UCSC genome browser (below the read signals) so that peaks can be matched to PRPF3 exonic and intronic regions. Based on this display, we identified 2 introns in PRPF3 (12 and 13, indicated by arrows, corresponding to NM_004698: intron 12, and NM_004698; intron 13, respectively) and 1 intron in PRPF8 (31, indicated by the arrow, corresponding to NM_006445, intron 31) (FIG. 7) that have high read density in the nuclear fraction of ARPE-19 cells, but have very low to no reads in the cytoplasmic fraction of these cells (as shown for intron 12 in the bottom diagram of FIG. 3, 13 in the bottom diagram of FIG. 5, and for introns 31 in the bottom diagram of FIG. 5). This indicates that these introns are retained and that the intron-12 and intron-13, and, intron-31 containing transcripts remain in the nucleus, and suggests that these retained PRPF3 and PRPF8 RIC premRNAs, respectively are non-productive, as they are not exported out to the cytoplasm.

Example 16: Design of ASO-Walk Targeting a Retained Intron

Figure 31:
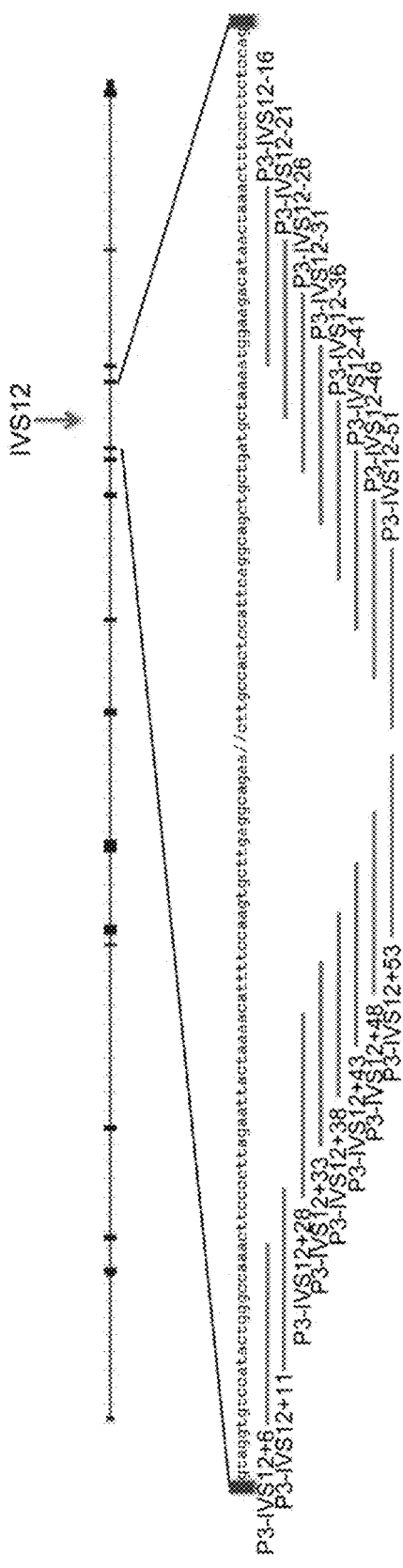
FIG. 31 illustrates a graphic representation of the ASO walk performed for PRPF3 IVS 12 targeting sequences immediately downstream of the 5' splice site or upstream of the 3' splice site using 2'-O-Me ASOs, PS backbone, is shown. ASOs were designed to cover these regions by shifting 5 nucleotides at a time (with the exception of ASO P3-IVS12+28). The PRPF3 exon-intron structure is drawn to scale.
Figure 32:
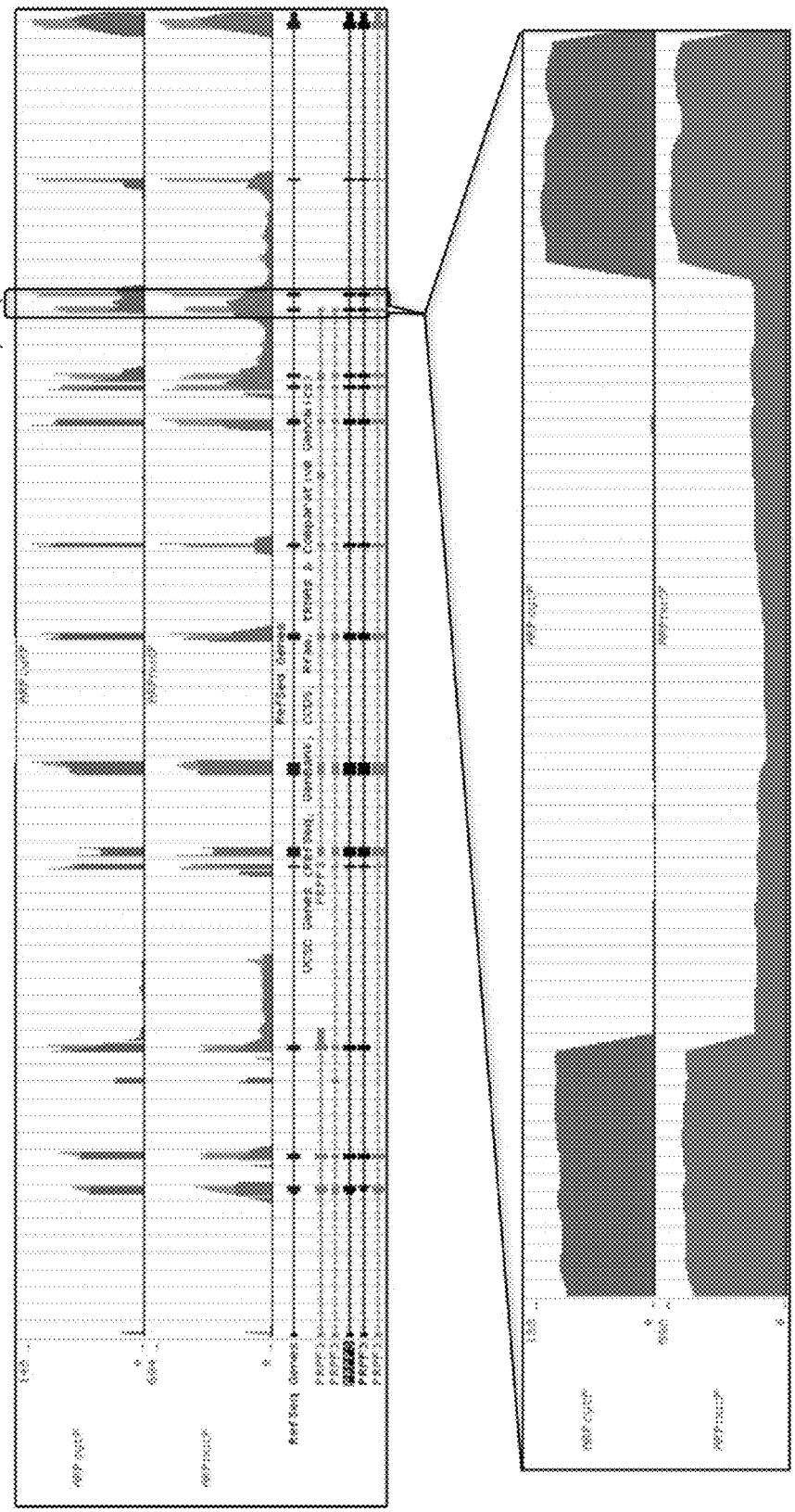
FIG. 32 depicts intron-retention in the PRPF3 gene with intron 13. Intron retention in the PRPF3 gene was identified by RNA sequencing (RNAseq), visualized in the UCSC genome browser, as described herein in the Examples. The read density for intron 13 in ARPE-19 cells is shown in detail in the lower panel.

An ASO walk was designed to target intron 12 of PRPF3 using the method described herein (FIG. 31). A region immediately downstream of the intron 12 5' splice site spanning nucleotides +6 to +498 and a region immediately upstream of intron 12 3' splice site spanning nucleotides −16 to −496 of the intron were targeted with 2'-O-Me RNA, PS backbone, 18-mer ASOs shifted by 5-nucleotide intervals (with the exception of ASO P3-IVS12+28).

Figure 33:
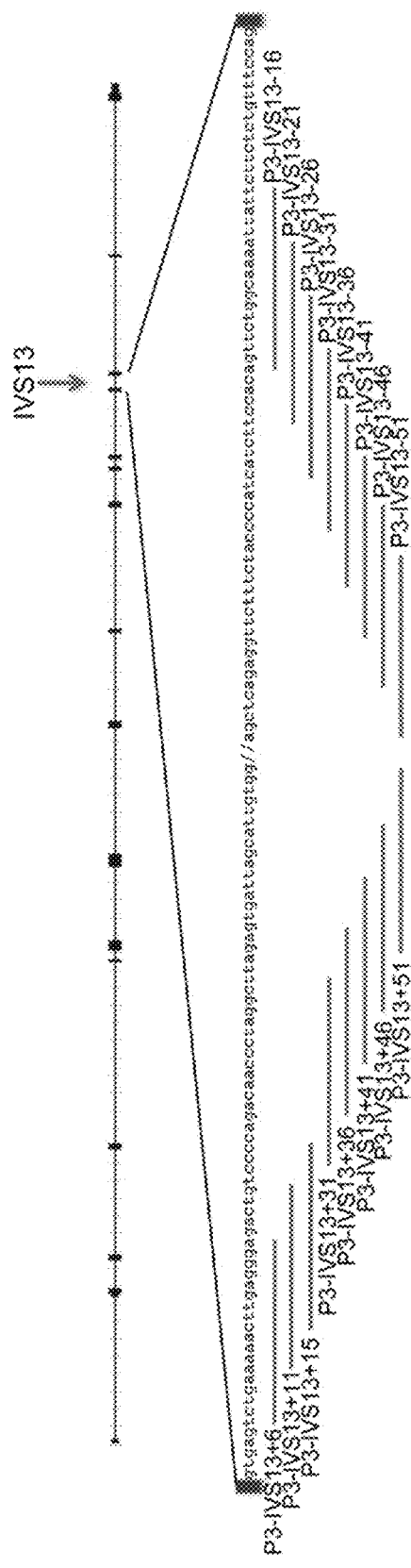
FIG. 33 illustrates a graphic representation of the ASO walk performed for PRPF3 IVS 13 targeting sequences immediately downstream of the 5' splice site or upstream of the 3' splice site using 2'-O-Me ASOs, PS backbone, is shown. ASOs were designed to cover these regions by shifting 5 nucleotides at a time (with the exception of ASO P3-IVS13+15, P3-IVS13+31, and P3-IVS13-47). The PRPF3 exon-intron structure is drawn to scale.
Figure 34:
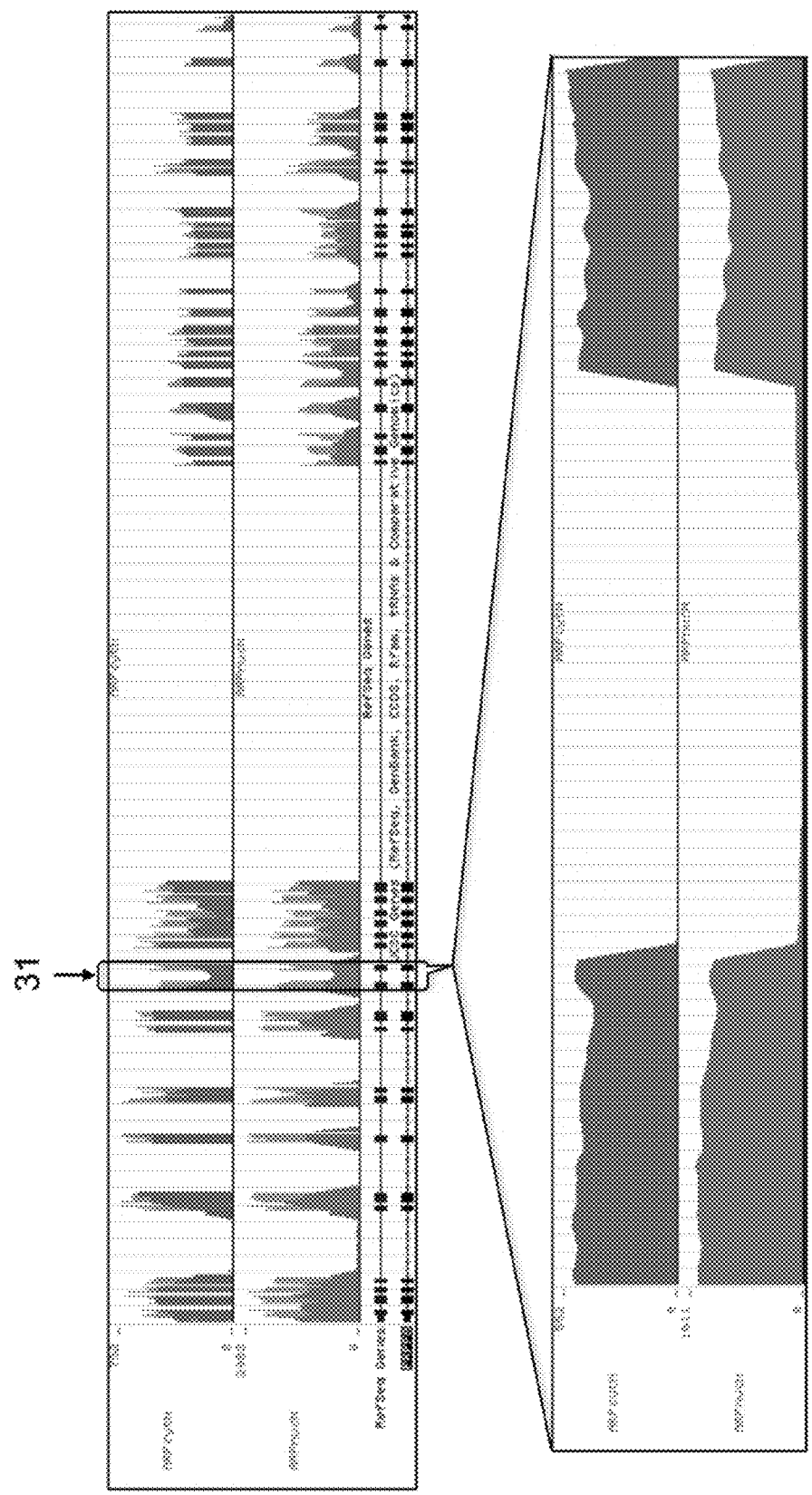
FIG. 34 depicts intron-retention in the PRPF8 gene with intron 31 detail. The identification of intron-retention events in the PRPF8 gene using RNA sequencing (RNAseq) is shown, visualized in the UCSC genome browser. The upper panel shows the read density corresponding to the PRPF8 transcript expressed in ARPE-19 (retina epithelial) cells and localized in either the cytoplasmic (top) or nuclear fraction (bottom). At the bottom of this panel, a graphic representation of the PRPF8 gene is shown to scale. The read density is shown as peaks. The highest read density corresponds to exons (black boxes), while no reads are observed for the majority of the introns (lines with arrow heads) in either cellular fraction. Higher read density is detected for intron 31 (indicated by the arrow) in the nuclear fraction compared to the cytoplasmic fraction indicating that splicing efficiency of intron 31 is low, resulting in intron retention. The retained-intron containing pre-mRNA transcripts are retained in the nucleus and are not exported out to the cytoplasm. The read density for intron 31 in renal epithelial cells is shown in detail in the lower panel.

An ASO walk was designed to target intron 13 of PRPF3 using the method described herein (FIG. 33). A region immediately downstream of the intron 13 5' splice site spanning nucleotides +6 to +146 and a region immediately upstream of intron 13 3' splice site spanning nucleotides −16 to −146 of the intron were targeted with 2'-O-Me RNA, PS backbone, 18-mer ASOs shifted by 5-nucleotide intervals (with the exception of ASOs P3-IVS13+15, P3-IVS13+31, and P3-IVS13-47).

Figure 35:
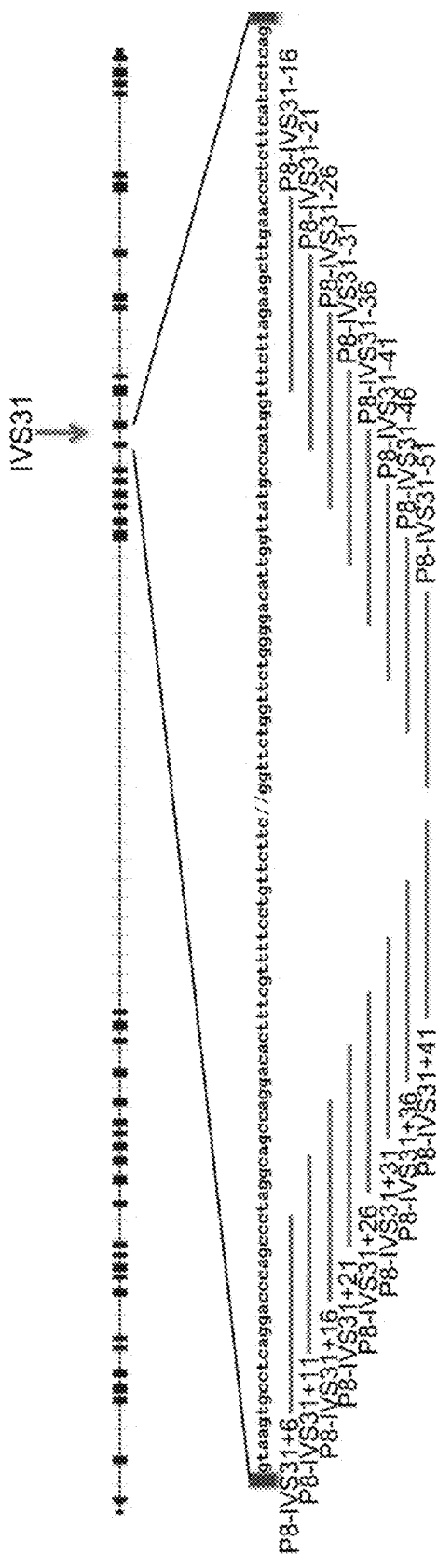
FIG. 35 illustrates a graphic representation of the ASO walk performed for PRPF8 IVS 31 targeting sequences immediately downstream of the 5' splice site or upstream of the 3' splice site using 2'-O-Me ASOs, PS backbone, is shown. ASOs were designed to cover these regions by shifting 5 nucleotides at a time. The PRPF8 exon-intron structure is drawn to scale.

An ASO walk was designed to target intron 31 of PRPF8 using the method described herein (FIG. 35). A region immediately downstream of the intron 31 5' splice site spanning nucleotides +6 to +156 and a region immediately upstream of intron 31 3' splice site spanning nucleotides −16 to −156 were targeted with 2'-O-Me RNA, PS backbone, 18-mer ASOs shifted by 5-nucleotide intervals.

Table 6 lists exemplary ASOs that were designed and their target sequences.

TABLE 6

| Gene SEQ ID NO. | Pre-mRNA SEQ ID NO. | ASOs | Retained Intron | Target Sequence SEQ ID NO. |
| --- | --- | --- | --- | --- |
| PRPF3 SEQ ID NO. 5826 | PRPF3: NM_004698 SEQ ID NO. 5828 | 5830-6064 6065-6148 | 12 13 | 6272 6271 |
| PRPF8 SEQ ID NO. 5827 | PRPF8: NM_006445 SEQ ID NO. 5829 | 6149-6270 | 31 | 6273 |

Figure 36:
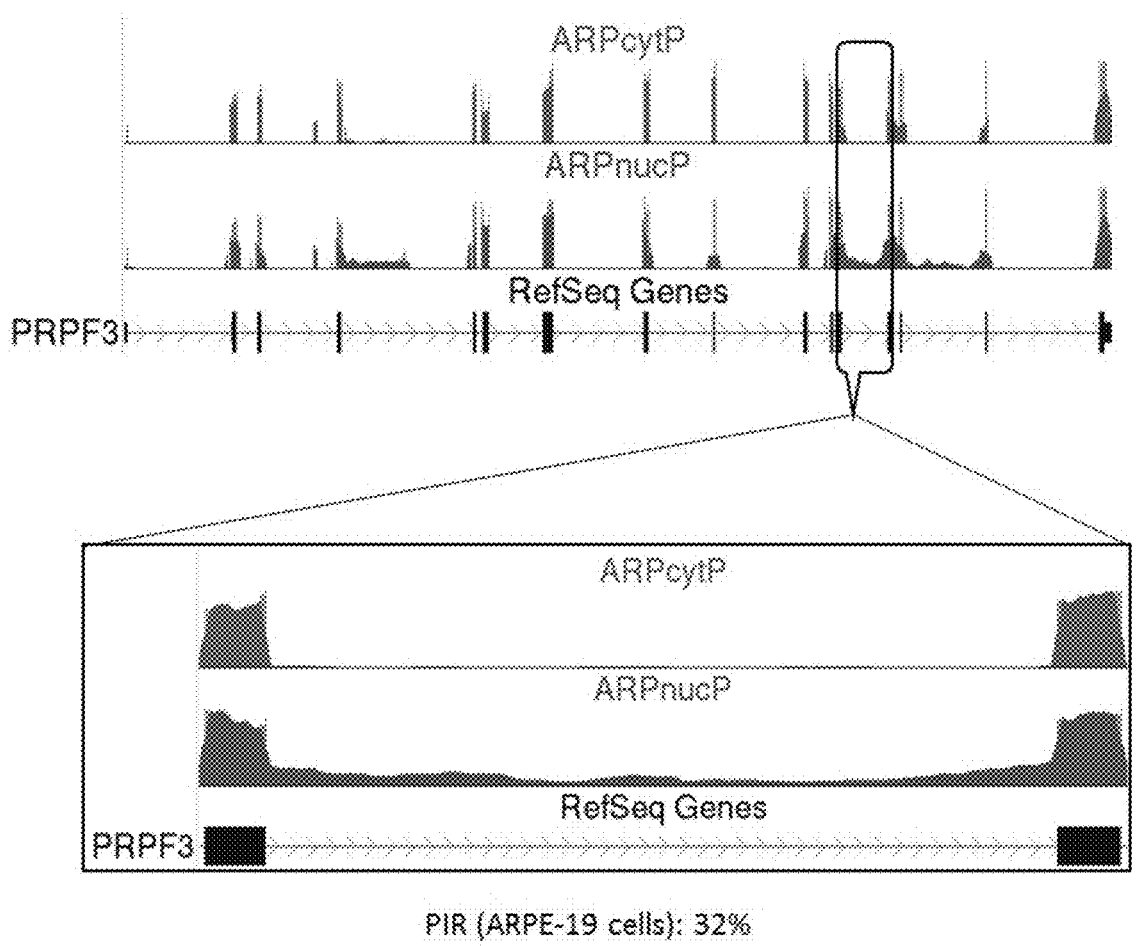
FIG. 36 depicts a schematic of the RefSeq Genes for PRPF3 corresponding to NM_004698. The Percent Intron Retention (PIR) of the circled intron is shown.
Figure 37:
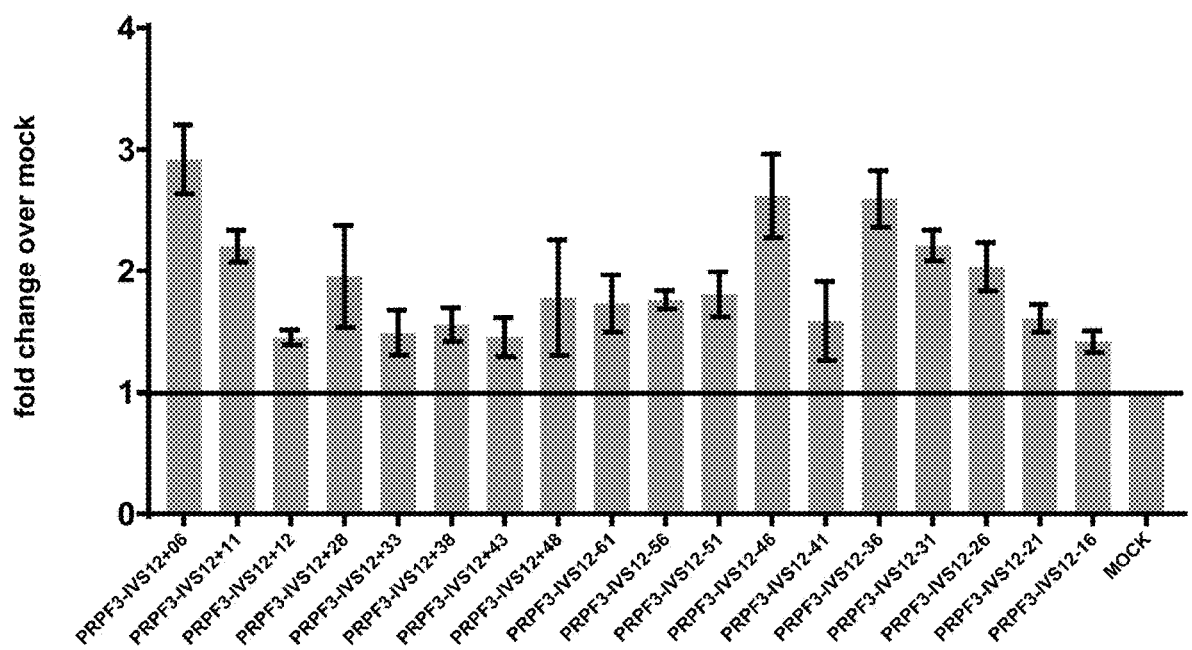
FIG. 37 depicts an exemplary graph is depicted showing the average (n=3) fold change in expression levels of PRPF3 mRNA without intron 12 in ARPE-19 cells treated for 24 hrs with 80 nM of the indicated ASOs over mock treated cells. Data is normalized to RPL32 expression.

Example 17: Improved Splicing Efficiency Via ASO-Targeting of PRPF3 Intron 12 Increases Transcript Levels To determine whether an increase in target gene intron splicing efficiency could be achieved with ASOs, the method described herein was used. ARPE-19 cells, a human retinal epithelium cell line (American Type Culture Collection (ATCC), USA) were mock-transfected, or transfected with the targeting ASOs described in Table 6. Cells were transfected using Lipofectamine RNAiMax transfection reagent (Thermo Fisher) according to vendor's specifications. Briefly, ASOs were plated in 96-well tissue culture plates and combined with RNAiMax diluted in Opti-MEM. Cells were detached using trypsin and resuspended in full medium, and approximately 25,000 cells were added the ASO-transfection mixture. Transfection experiments were carried out in triplicate plate replicates. Final ASO concentration was 80 nM. Media was changed 6h post-transfection, and cells harvested at 24h, using the Cells-to-Ct lysis reagent, supplemented with DNAse (Thermo Fisher), according to vendor's specifications. cDNA was generated with Cells-to-Ct RT reagents (Thermo Fisher) according to vendor's specifications. To quantify the amount of splicing at the intron of interest, quantitative PCR was carried out using Taqman assays with probes spanning the corresponding exon-exon junction (Thermo Fisher). Taqman assays were carried out according to vendor's specifications, on a QuantStudio 7 Flex Real-Time PCR system (Thermo Fisher). Target gene assay values were normalized to RPL32 (deltaCt) and plate-matched mock transfected samples (delta-delta Ct), generating fold-change over mock quantitation (2^-(delta-deltaCt). Average fold-change over mock of the three plate replicates was plotted (FIG. 37). Several ASOs were identified that increased the target gene expression, as shown in FIG. 37, implying an increase in splicing at that target intron. Together with whole transcriptome data confirming retention of the target intron (FIG. 36), these results confirm that ASOs can improve the splicing efficiency of a rate limiting intron.

Figure 38:
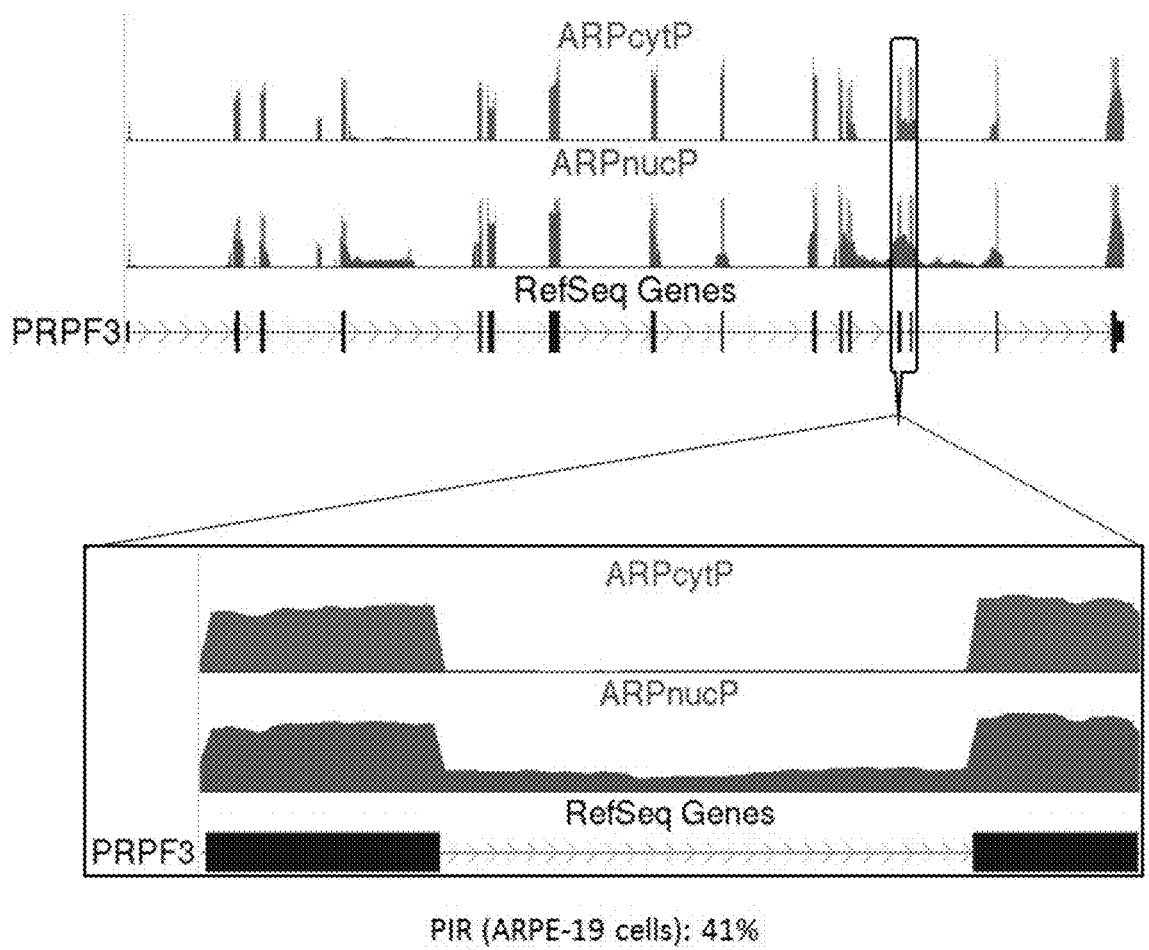
FIG. 38 depicts a schematic of the RefSeq Genes for PRPF3 corresponding to NM_004698. The Percent Intron Retention (PIR) of the circled intron is shown.
Figure 39:
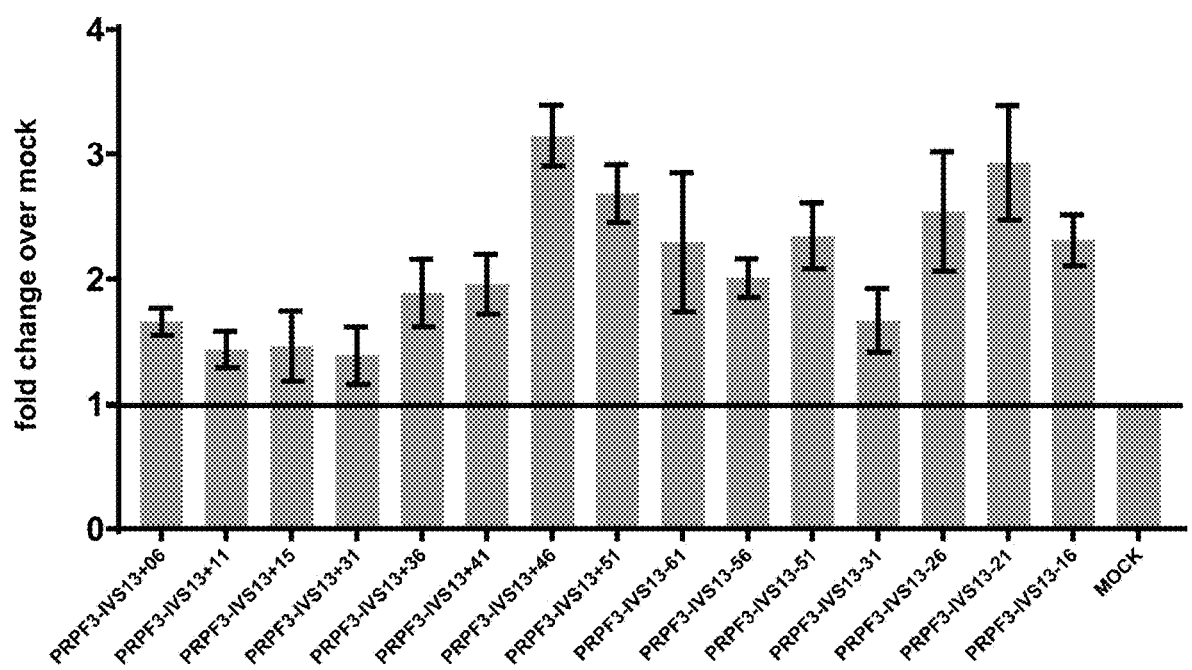
FIG. 39 depicts an exemplary graph showing the average (n=3) fold change in expression levels of PRPF3 mRNA without intron 13 in ARPE-19 cells treated for 24 hrs with 80 nM of the indicated ASOs over mock treated cells. Data is normalized to RPL32 expression.

Example 18: Improved Splicing Efficiency Via ASO-Targeting of PRPF3 Intron 13 Increases Transcript Levels To determine whether an increase in target gene intron splicing efficiency could be achieved with ASOs, the method described herein was used. ARPE-19 cells, a human retinal epithelium cell line (American Type Culture Collection (ATCC), USA) were mock-transfected, or transfected with the targeting ASOs described in Table 6. Cells were transfected using Lipofectamine RNAiMax transfection reagent (Thermo Fisher) according to vendor's specifications. Briefly, ASOs were plated in 96-well tissue culture plates and combined with RNAiMax diluted in Opti-MEM. Cells were detached using trypsin and resuspended in full medium, and approximately 25,000 cells were added the ASO-transfection mixture. Transfection experiments were carried out in triplicate plate replicates. Final ASO concentration was 80 nM. Media was changed 6h post-transfection, and cells harvested at 24h, using the Cells-to-Ct lysis reagent, supplemented with DNAse (Thermo Fisher), according to vendor's specifications. cDNA was generated with Cells-to-Ct RT reagents (Thermo Fisher) according to vendor's specifications. To quantify the amount of splicing at the intron of interest, quantitative PCR was carried out using Taqman assays with probes spanning the corresponding exon-exon junction (Thermo Fisher). Taqman assays were carried out according to vendor's specifications, on a QuantStudio 7 Flex Real-Time PCR system (Thermo Fisher). Target gene assay values were normalized to RPL32 (deltaCt) and plate-matched mock transfected samples (delta-delta Ct), generating fold-change over mock quantitation (2^-(delta-deltaCt). Average fold-change over mock of the three plate replicates was plotted (FIG. 37, FIG. 39). Several ASOs were identified that increased the target gene expression, as shown in FIG. 39, implying an increase in splicing at that target intron. Together with whole transcriptome data confirming retention of the target intron (FIG. 38), these results confirm that ASOs can improve the splicing efficiency of a rate limiting intron.

Figure 40:
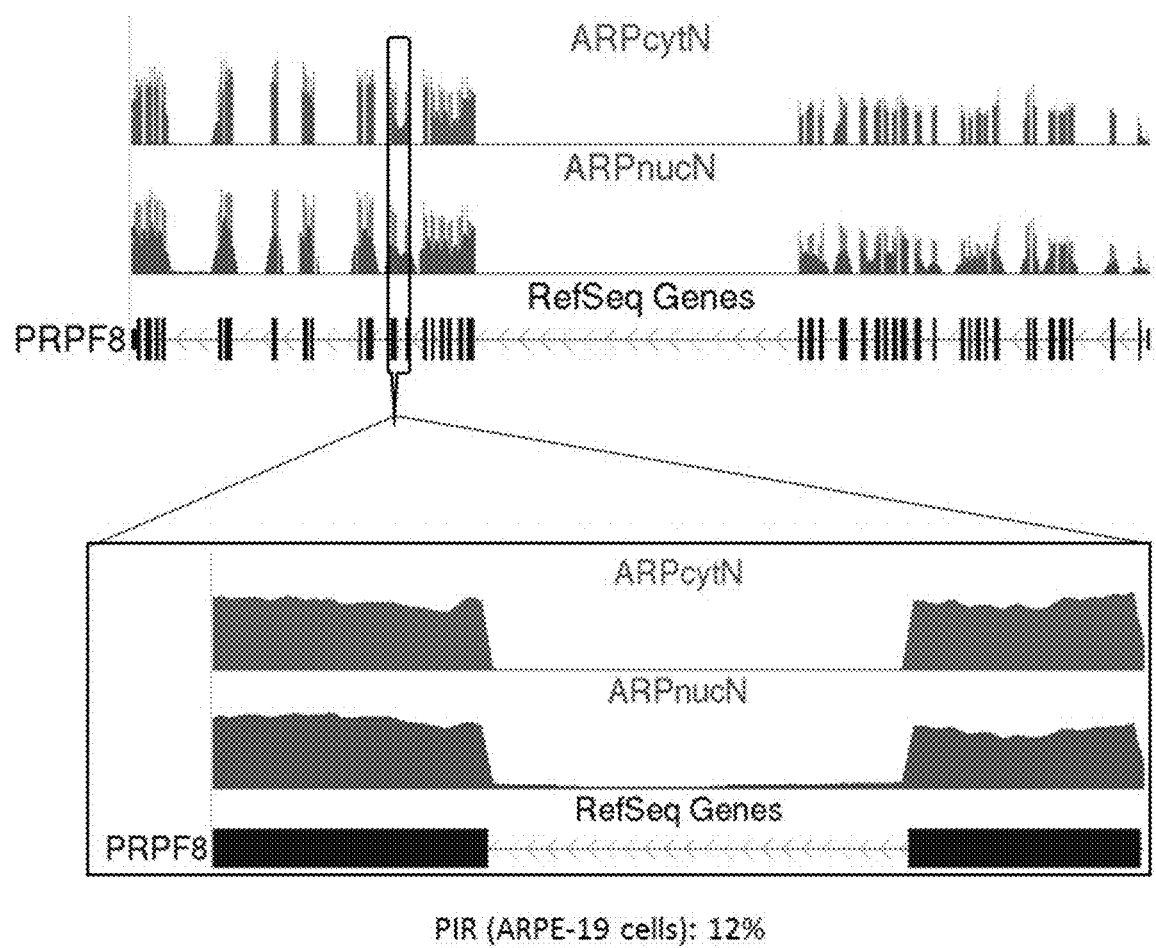
FIG. 40 depicts a schematic of the RefSeq Genes for PRPF8 corresponding to NM_006445. The Percent Intron Retention (PIR) of the circled intron is shown.
Figure 41:
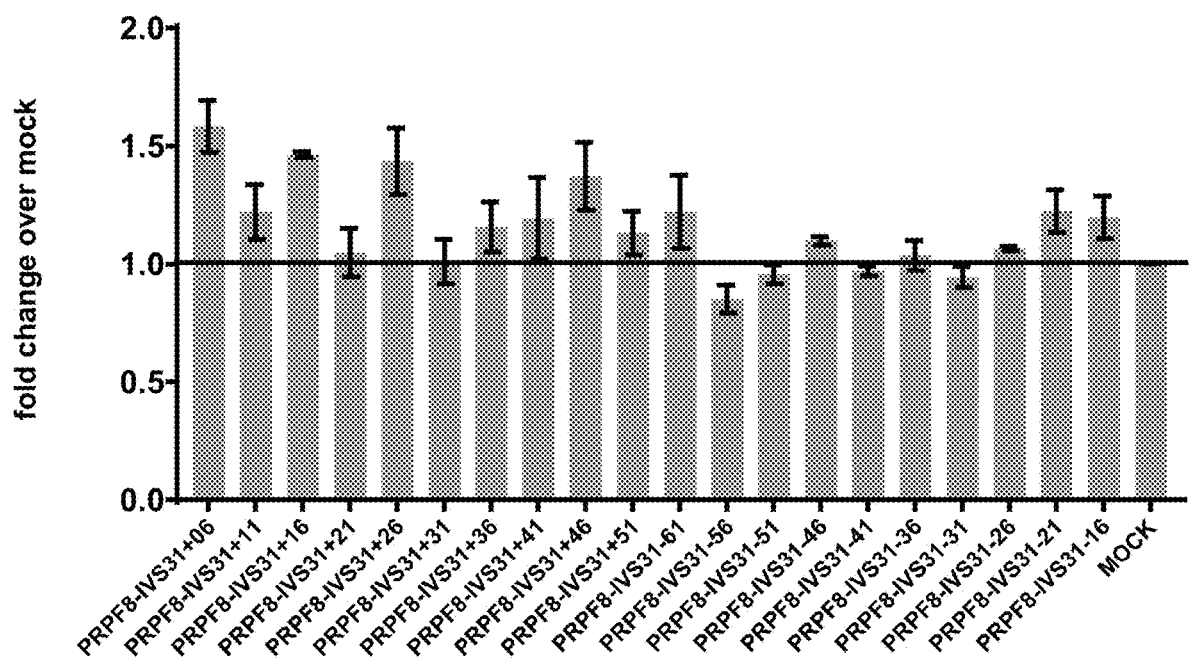
FIG. 41 depicts an exemplary graph is depicted showing the average (n=3) fold change in expression levels of PRPF8 mRNA without intron 31 in ARPE-19 cells treated for 24 hrs with 80 nM of the indicated ASOs over mock treated cells. Data is normalized to RPL32 expression.

Example 19: Improved Splicing Efficiency Via ASO-Targeting of PRPF8 Intron 31 Increases Transcript Levels To determine whether an increase in target gene intron splicing efficiency could be achieved with ASOs, the method described herein was used. ARPE-19 cells, a human retinal epithelium cell line (American Type Culture Collection (ATCC), USA) were mock-transfected, or transfected with the targeting ASOs described in Table 6. Cells were transfected using Lipofectamine RNAiMax transfection reagent (Thermo Fisher) according to vendor's specifications. Briefly, ASOs were plated in 96-well tissue culture plates and combined with RNAiMax diluted in Opti-MEM. Cells were detached using trypsin and resuspended in full medium, and approximately 25,000 cells were added the ASO-transfection mixture. Transfection experiments were carried out in triplicate plate replicates. Final ASO concentration was 80 nM. Media was changed 6h post-transfection, and cells harvested at 24h, using the Cells-to-Ct lysis reagent, supplemented with DNAse (Thermo Fisher), according to vendor's specifications. cDNA was generated with Cells-to-Ct RT reagents (Thermo Fisher) according to vendor's specifications. To quantify the amount of splicing at the intron of interest, quantitative PCR was carried out using Taqman assays with probes spanning the corresponding exon-exon junction (Thermo Fisher). Taqman assays were carried out according to vendor's specifications, on a QuantStudio 7 Flex Real-Time PCR system (Thermo Fisher). Target gene assay values were normalized to RPL32 (deltaCt) and plate-matched mock transfected samples (delta-delta Ct), generating fold-change over mock quantitation (2^-(delta-deltaCt). Average fold-change over mock of the three plate replicates is plotted (FIG. 41). Several ASOs were identified that increased the target gene expression, as shown in FIG. 41, implying an increase in splicing at that target intron. Together with whole transcriptome data confirming retention of the target intron (FIG. 40), these results confirm that ASOs can improve the splicing efficiency of a rate limiting intron.

Example 20: Identification of Intron Retention Events in ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, and STX1B Transcripts by RNAseq Using Next Generation Sequencing Whole transcriptome shotgun sequencing was carried out using next generation sequencing to reveal a snapshot of transcripts produced by the ATP1A2, CACNA1A, SETD5, SHANK3, NF2, DNMT1, TCF4, RAI1, PEX1, ARSA, EIF2B5, EIF2B1, EIF2B2, NPC1, ADAR, MFSD8, STXBP1, PRICKLE2, PRRT2, IDUA, and STX1B gene to identify intron-retention events. For this purpose, polyA+ RNA from nuclear and cytoplasmic fractions of cells was isolated and cDNA libraries constructed using Illumina's TruSeq Stranded mRNA library Prep Kit. The libraries were pair-end sequenced resulting in 100-nucleotide reads that were mapped to the human genome (February 2009, GRCh37/hg19 assembly. The mapped reads were visualized using the UCSC genome browser (operated by the UCSC Genome Informatics Group (Center for Biomolecular Science & Engineering, University of California, Santa Cruz, 1156 High Street, Santa Cruz, Calif. 95064) and described by, e.g., Rosenbloom, et al., 2015, "The UCSC Genome Browser database: 2015 update," Nucleic Acids Research 43, Database Issue, doi: 10.1093/nar/gku1177) and the coverage and number of reads were inferred by the peak signals. The height of the peaks indicates the level of expression given by the density of the reads in a particular region. A schematic representation of the gene was provided by the UCSC genome browser so that peaks could be matched to the exonic and intronic regions. Based on this display, we identified introns that have high read density in the nuclear fraction of the cells, but have very low to no reads in the cytoplasmic fraction. This indicated that these introns were retained and that the intron-containing transcripts remain in the nucleus, and suggested that these retained RIC pre-mRNAs are non-productive, as they were not exported out to the cytoplasm.

Example 21: Design of ASO-Walk Targeting

An ASO walk was designed to target introns using the method described herein. A region immediately downstream of an intron 5' splice site spanning nucleotides, e.g., +6 to +69 and a region immediately upstream of the intron's 3' splice site spanning nucleotides, e.g., −16 to −79 of the intron were targeted with 2'-O-Me RNA, PS backbone, 18-mer ASOs shifted by 5-nucleotide intervals.

Example 22: Improved Splicing Efficiency Via ASO-Targeting

To determine whether an increase in expression of ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B could be achieved by improving splicing efficiency of a retained intron in ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B using ASOs, ARPE-19 or SK-N-AS cells were mock-transfected, or transfected with the targeting ASOs described in FIG. 46, FIG. 48, FIG. 50, FIG. 52, FIG. 54, FIG. 56, FIG. 58, FIG. 61, FIG. 63, FIG. 65, FIG. 76, FIG. 78, FIG. 80, and Table 7. Cells were transfected using Lipofectamine RNAiMax transfection reagent (Thermo Fisher) according to vendor's specifications. Briefly, ASOs were plated in 96-well tissue culture plates and combined with RNAiMax diluted in Opti-MEM. Cells were detached using trypsin and resuspended in full medium, and approximately 25,000 cells were added the ASO-transfection mixture. Transfection experiments were carried out in triplicate plate replicates. Final ASO concentration was 80 nM. Media was changed 6h post-transfection, and cells harvested at 24h, using the Cells-to-Ct lysis reagent, supplemented with DNAse (Thermo Fisher), according to vendor's specifications. cDNA was generated with Cells-to-Ct RT reagents (Thermo Fisher) according to vendor's specifications. To quantify the amount of splicing at the intron of interest, quantitative PCR was carried out using Taqman assays with probes spanning the corresponding exon-exon junction (Thermo Fisher). Taqman assays were carried out according to vendor's specifications, on a QuantStudio 7 Flex Real-Time PCR system (Thermo Fisher). ATP1A2, CACNA1A, SETD5, SHANK3, NF2, DNMT1, TCF4, RAI1, PEX1, ARSA, EIF2B5, EIF2B2, NPC1, ADAR, STXBP1, PRICKLE2, PRRT2, or STX1B assay values were normalized to RPL32 (deltaCt) and plate-matched mock transfected samples (delta-delta Ct), generating fold-change over mock quantitation (2^-(delta-deltaCt). Average fold-change over mock of the three plate replicates were plotted These results were used to confirm that inducing splicing of a retained intron in the gene using ASOs leads to an increase in gene expression.

Figure 42:
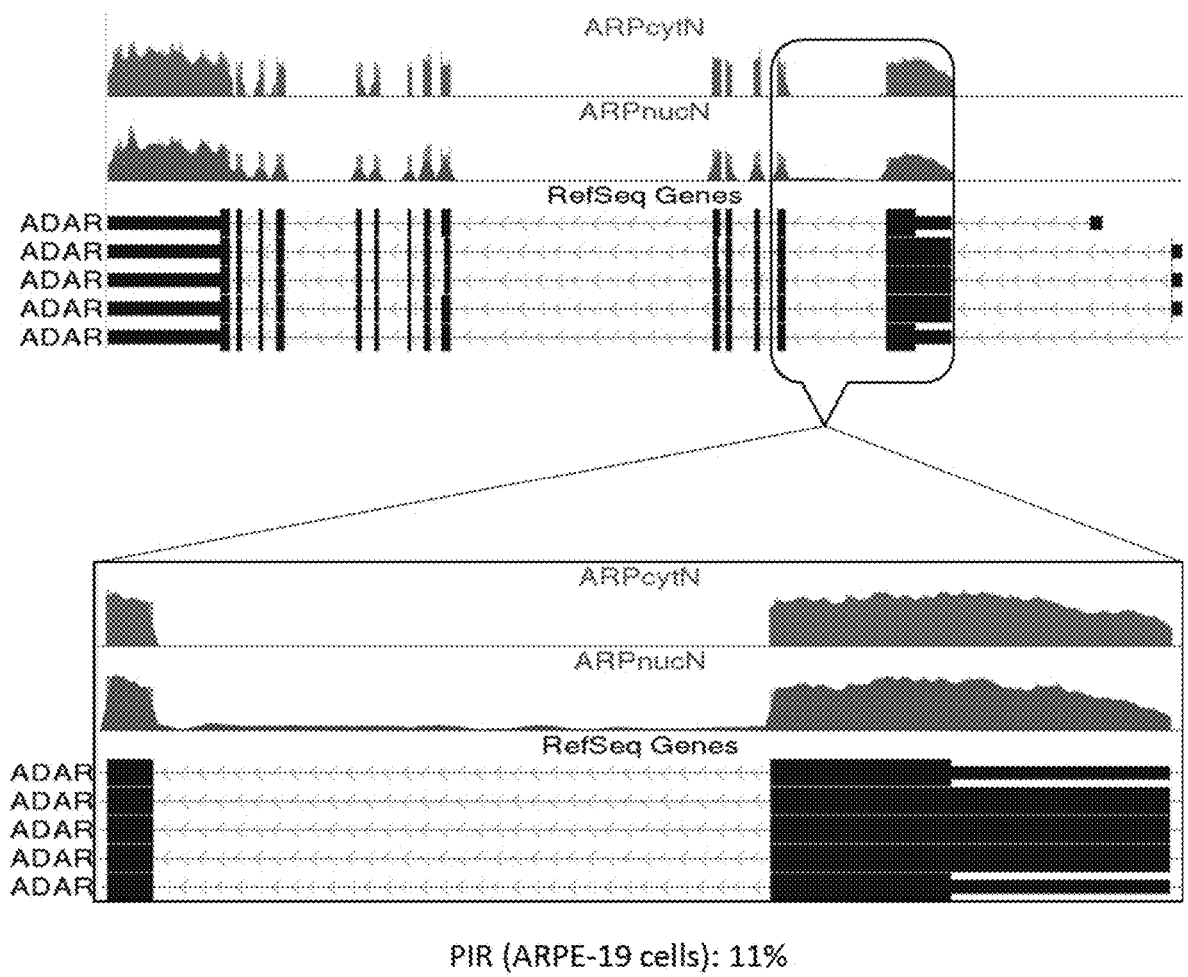
FIG. 42 depicts a schematic of the RefSeq Genes for ADAR intron 2 corresponding to NM_001111. The Percent Intron Retention (PIR) of the circled intron is shown.

FIG. 42 depicts a schematic of the RefSeq Genes for ADAR intron 2 corresponding to NM_001111. The Percent Intron Retention (PIR) of the circled intron is shown.

Figure 43:
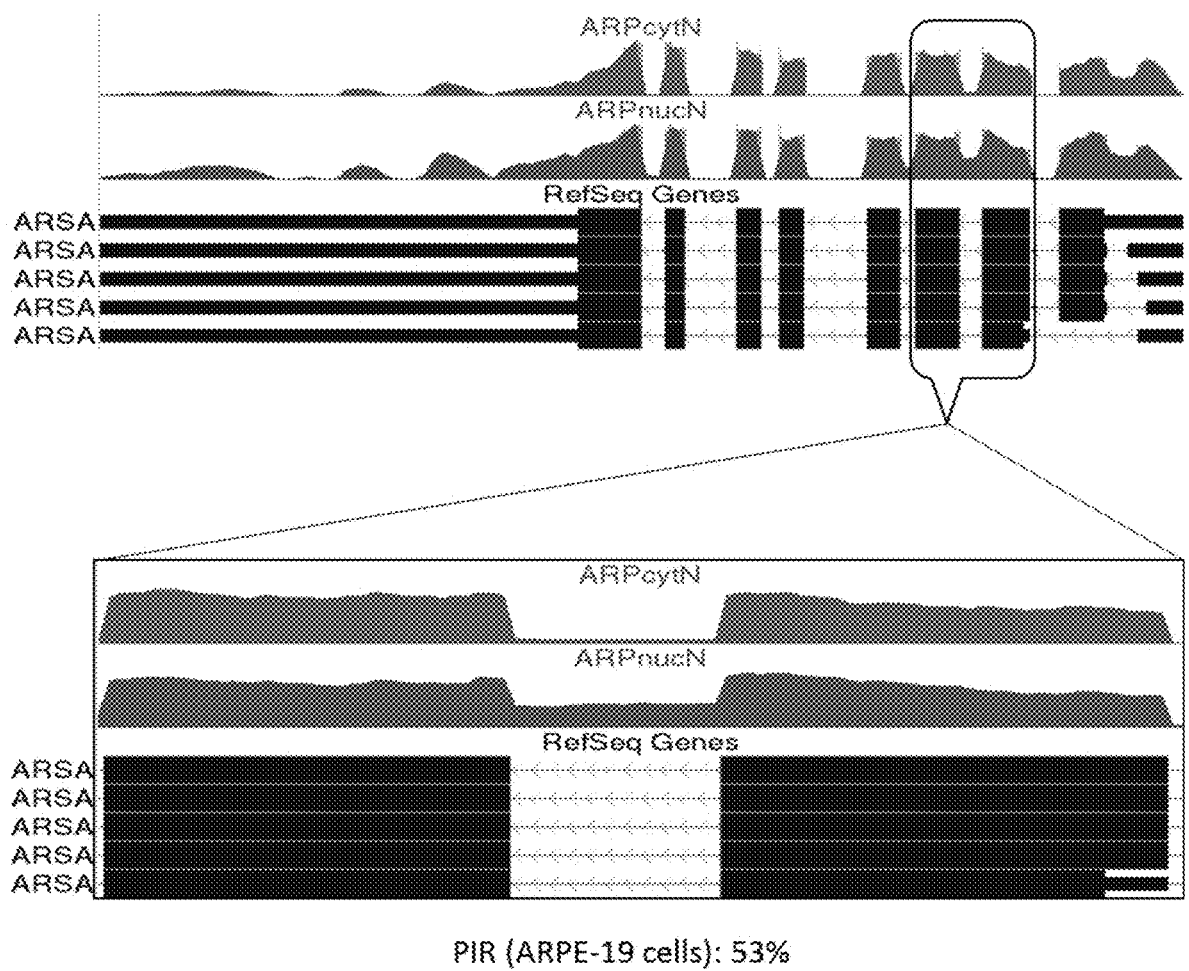
FIG. 43 depicts a schematic of the RefSeq Genes for ARSA intron 3 corresponding to NM_001085425. The Percent Intron Retention (PIR) of the circled intron is shown.

FIG. 43 depicts a schematic of the RefSeq Genes for ARSA intron 3 corresponding to NM_001085425. The Percent Intron Retention (PIR) of the circled intron is shown.

Figure 44:
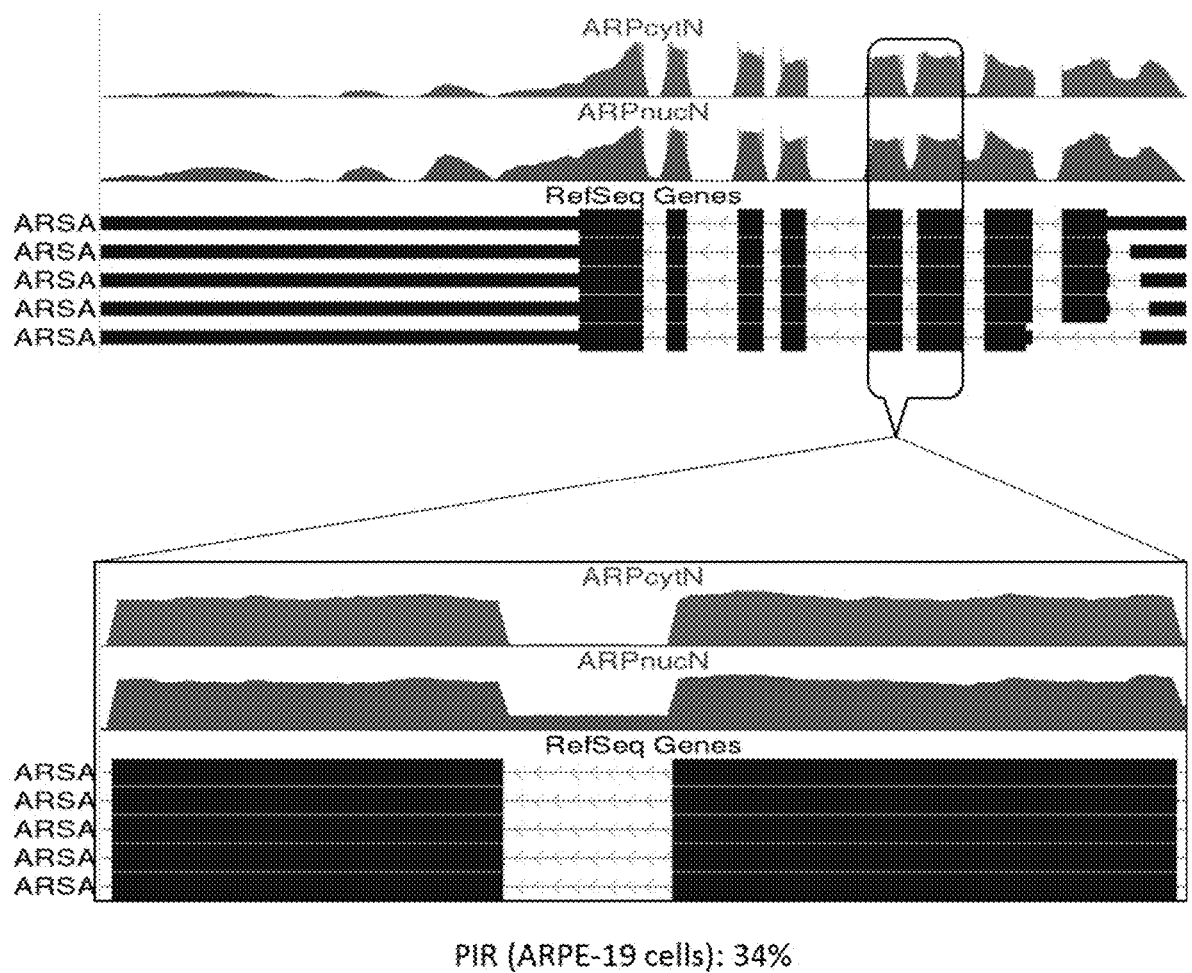
FIG. 44 depicts a schematic of the RefSeq Genes for ARSA intron 4 corresponding to NM_001085425. The Percent Intron Retention (PIR) of the circled intron is shown.

FIG. 44 depicts a schematic of the RefSeq Genes for ARSA intron 4 corresponding to NM_001085425. The Percent Intron Retention (PIR) of the circled intron is shown.

Figure 45:
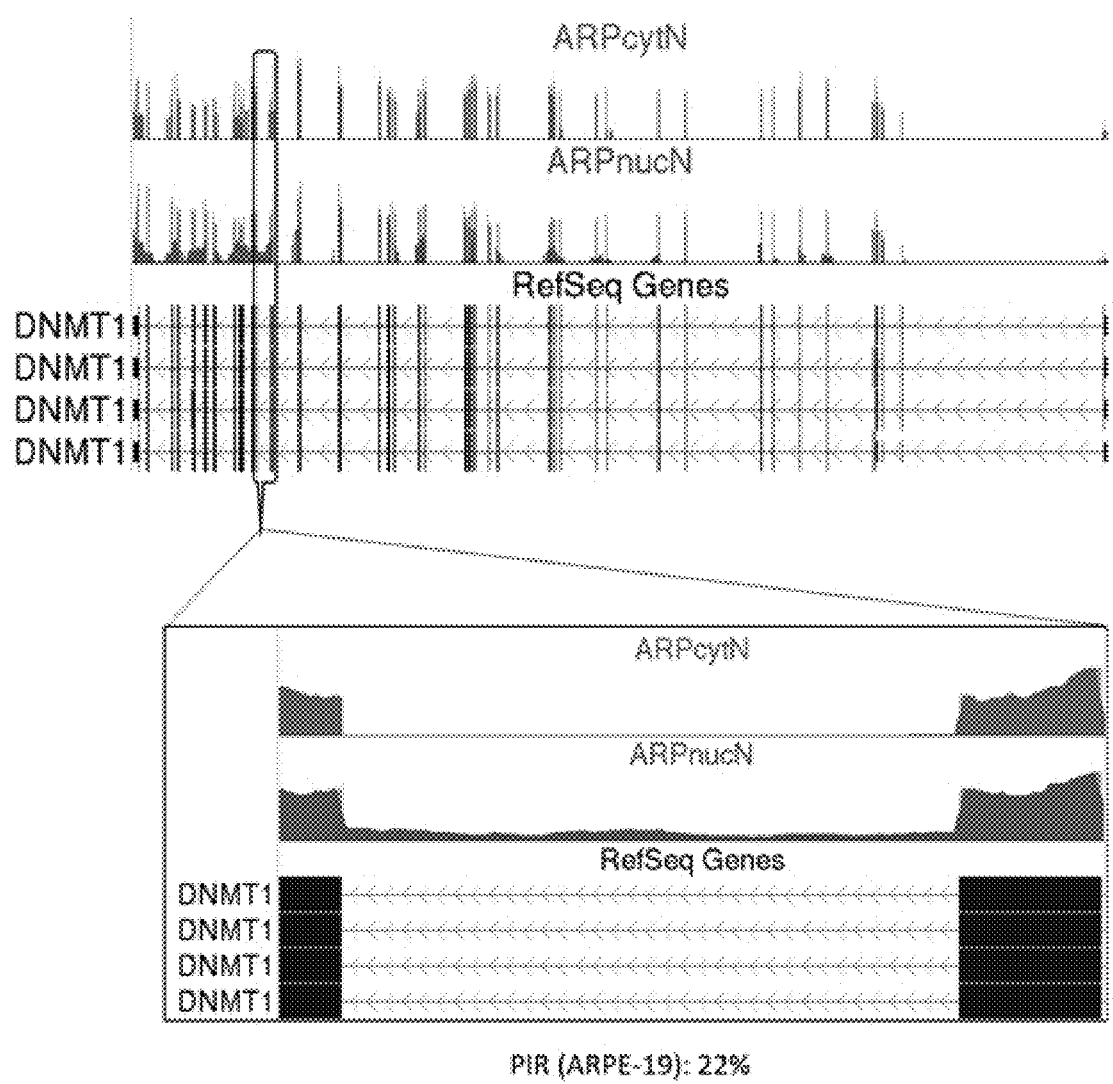
FIG. 45 depicts a schematic of the RefSeq Genes for DNMT1 intron 30 corresponding to NM_001130823. The Percent Intron Retention (PIR) of the circled intron is shown.

FIG. 45 depicts a schematic of the RefSeq Genes for DNMT1 intron 30 corresponding to NM_001130823. The Percent Intron Retention (PIR) of the circled intron is shown.

Figure 46:
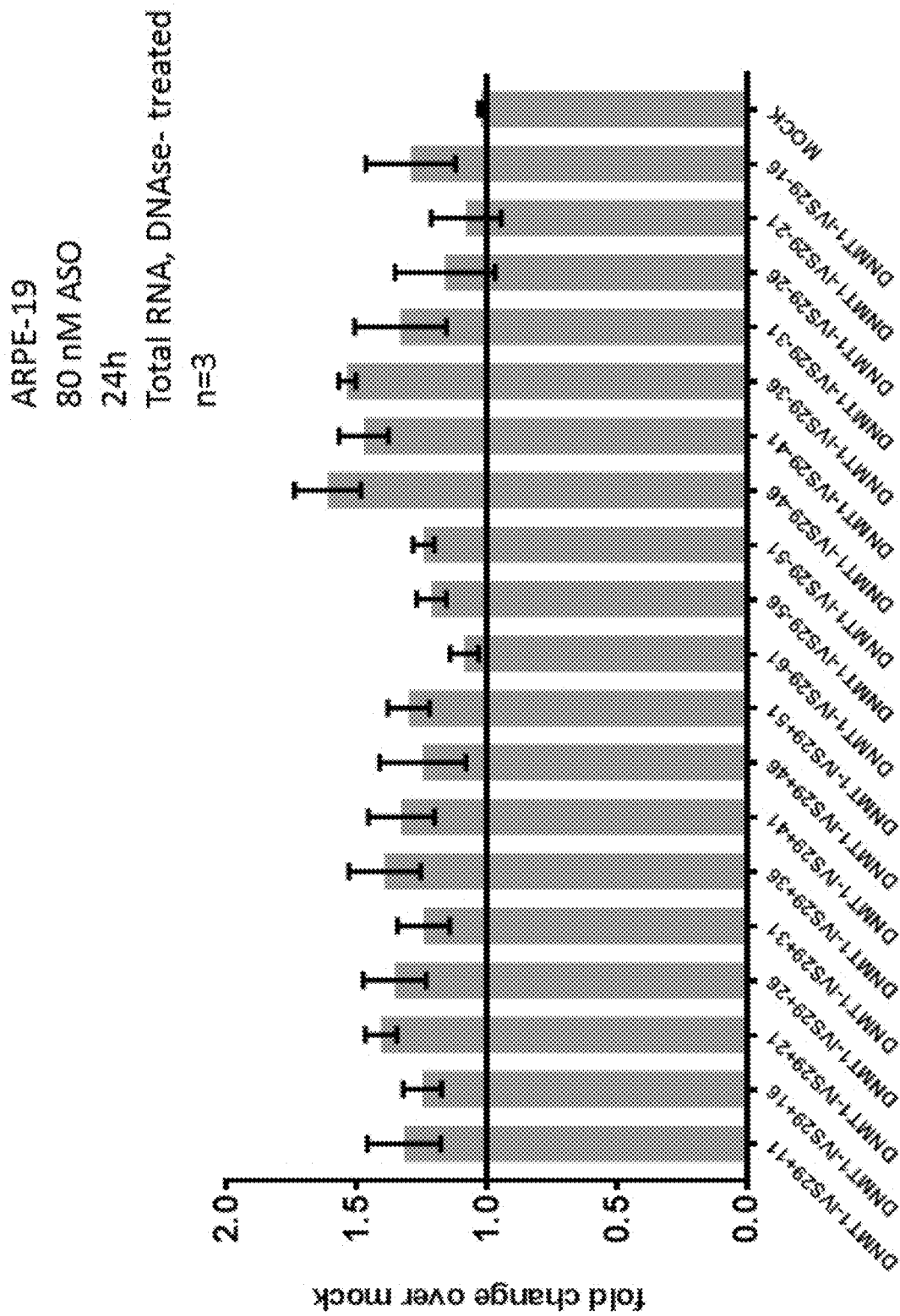
FIG. 46 depicts an exemplary graph showing the average (n=3) fold change in expression levels of DNMT1 mRNA without intron 30 in ARPE-19 cells treated for 24 hrs with 80 nM of the indicated ASOs over mock treated cells. Data is normalized to RPL32 expression.

FIG. 46 depicts an exemplary graph showing the average (n=3) fold change in expression levels of DNMT1 mRNA without intron 30 in ARPE-19 cells treated for 24 hrs with 80 nM of the indicated ASOs over mock treated cells. Data is normalized to RPL32 expression.

Figure 47:
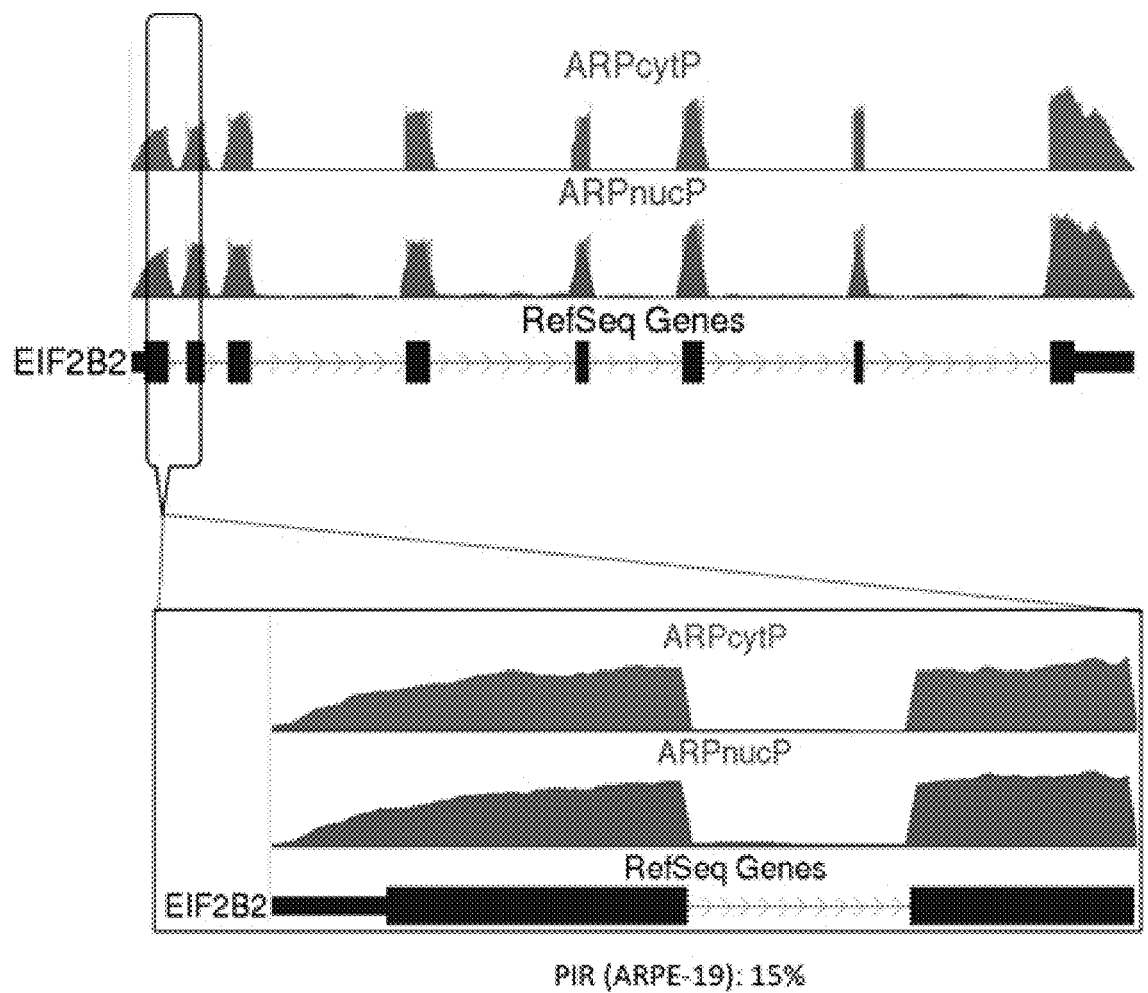
FIG. 47 depicts a schematic of the RefSeq Genes for EIF2B2 intron 1 corresponding to NM_014239. The Percent Intron Retention (PIR) of the circled intron is shown.

FIG. 47 depicts a schematic of the RefSeq Genes for EIF2B2 intron 1 corresponding to NM_014239. The Percent Intron Retention (PIR) of the circled intron is shown.

Figure 48:
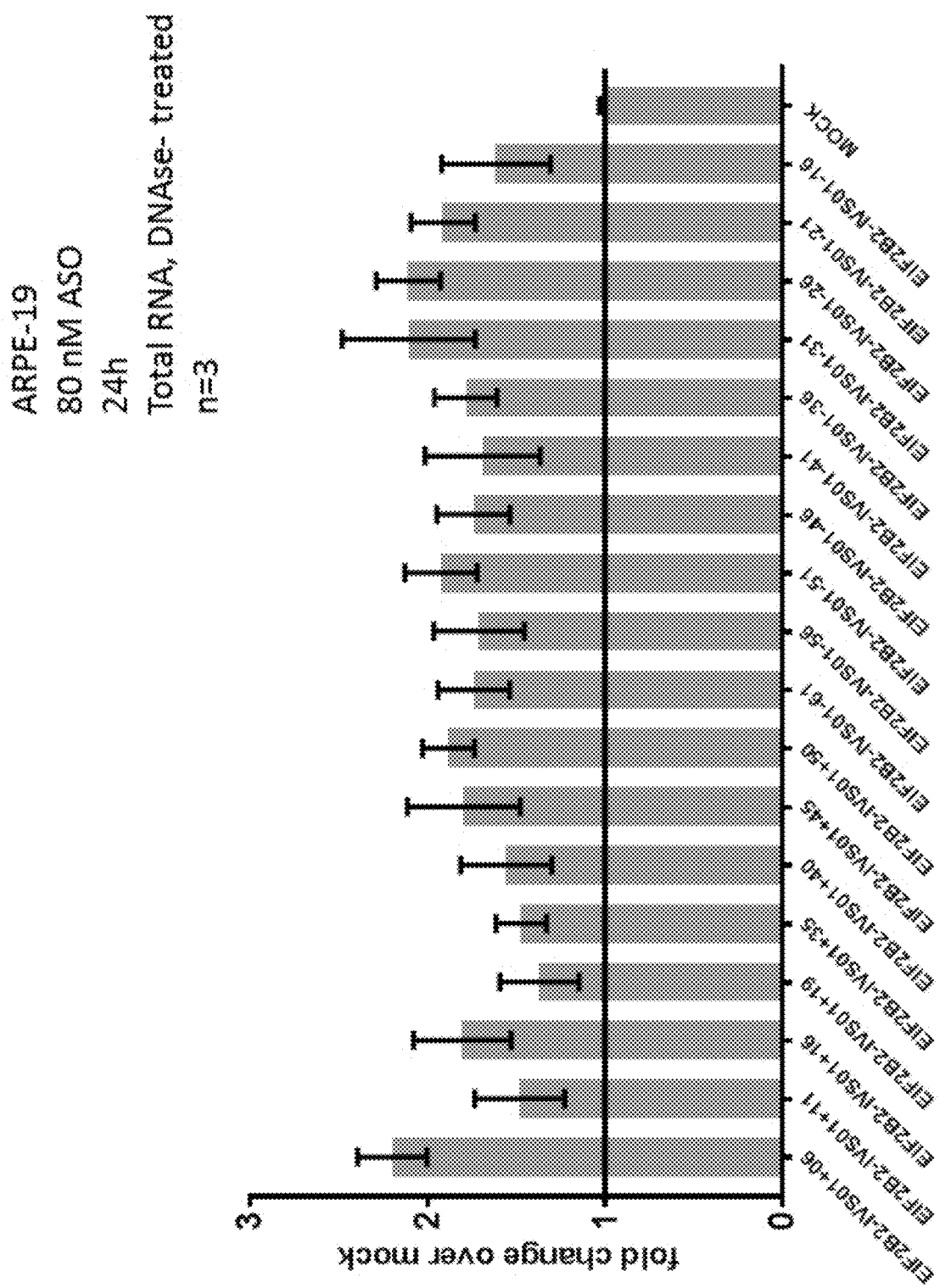
FIG. 48 depicts an exemplary graph showing the average (n=3) fold change in expression levels of EIF2B2 mRNA without intron 1 in ARPE-19 cells treated for 24 hrs with 80 nM of the indicated ASOs over mock treated cells. Data is normalized to RPL32 expression.

FIG. 48 depicts an exemplary graph showing the average (n=3) fold change in expression levels of EIF2B2 mRNA without intron 1 in ARPE-19 cells treated for 24 hrs with 80 nM of the indicated ASOs over mock treated cells. Data is normalized to RPL32 expression.

Figure 49:
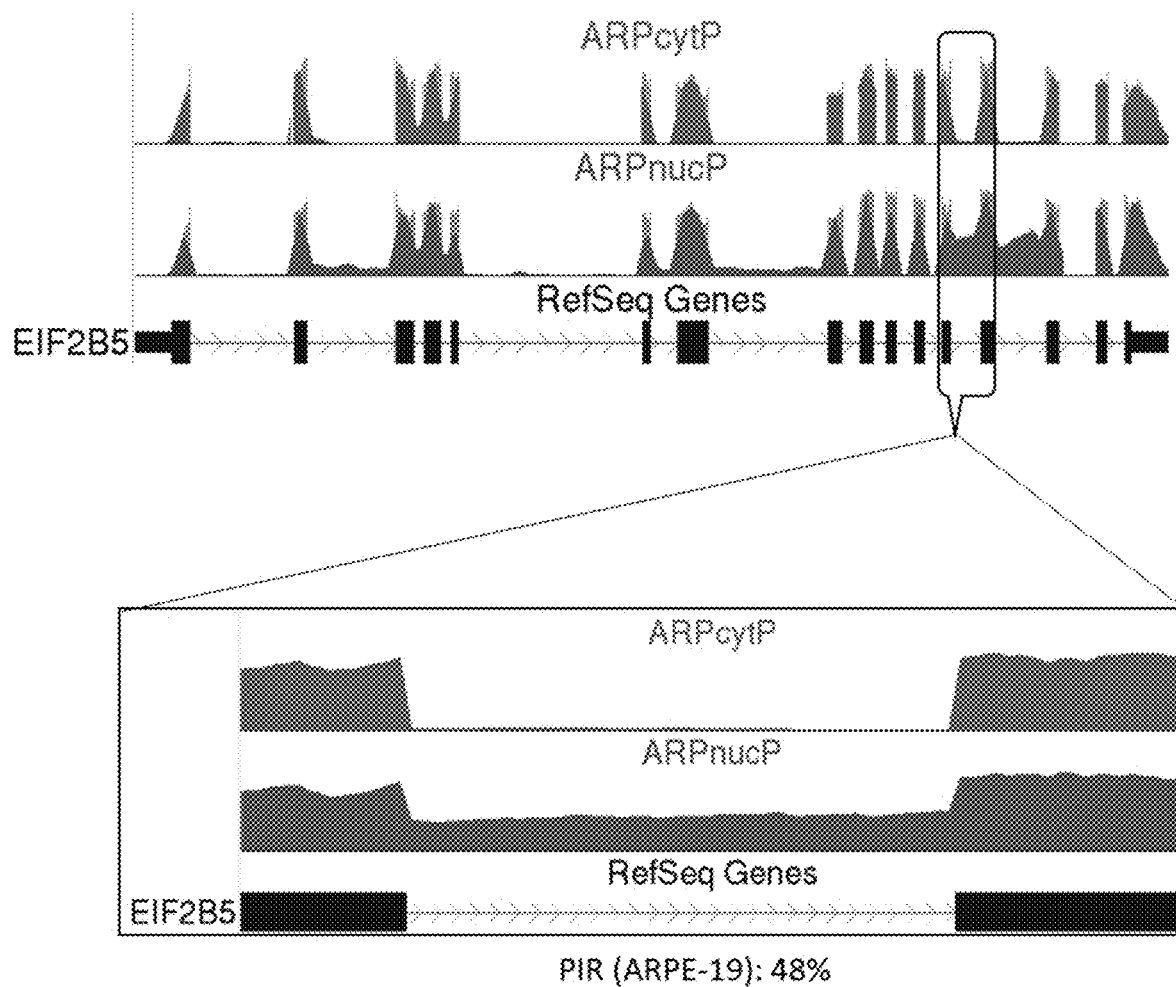
FIG. 49 depicts a schematic of the RefSeq Genes for EIF2B5 intron 12 corresponding to NM_003907. The Percent Intron Retention (PIR) of the circled intron is shown.

FIG. 49 depicts a schematic of the RefSeq Genes for EIF2B5 intron 12 corresponding to NM_003907. The Percent Intron Retention (PIR) of the circled intron is shown.

Figure 50:
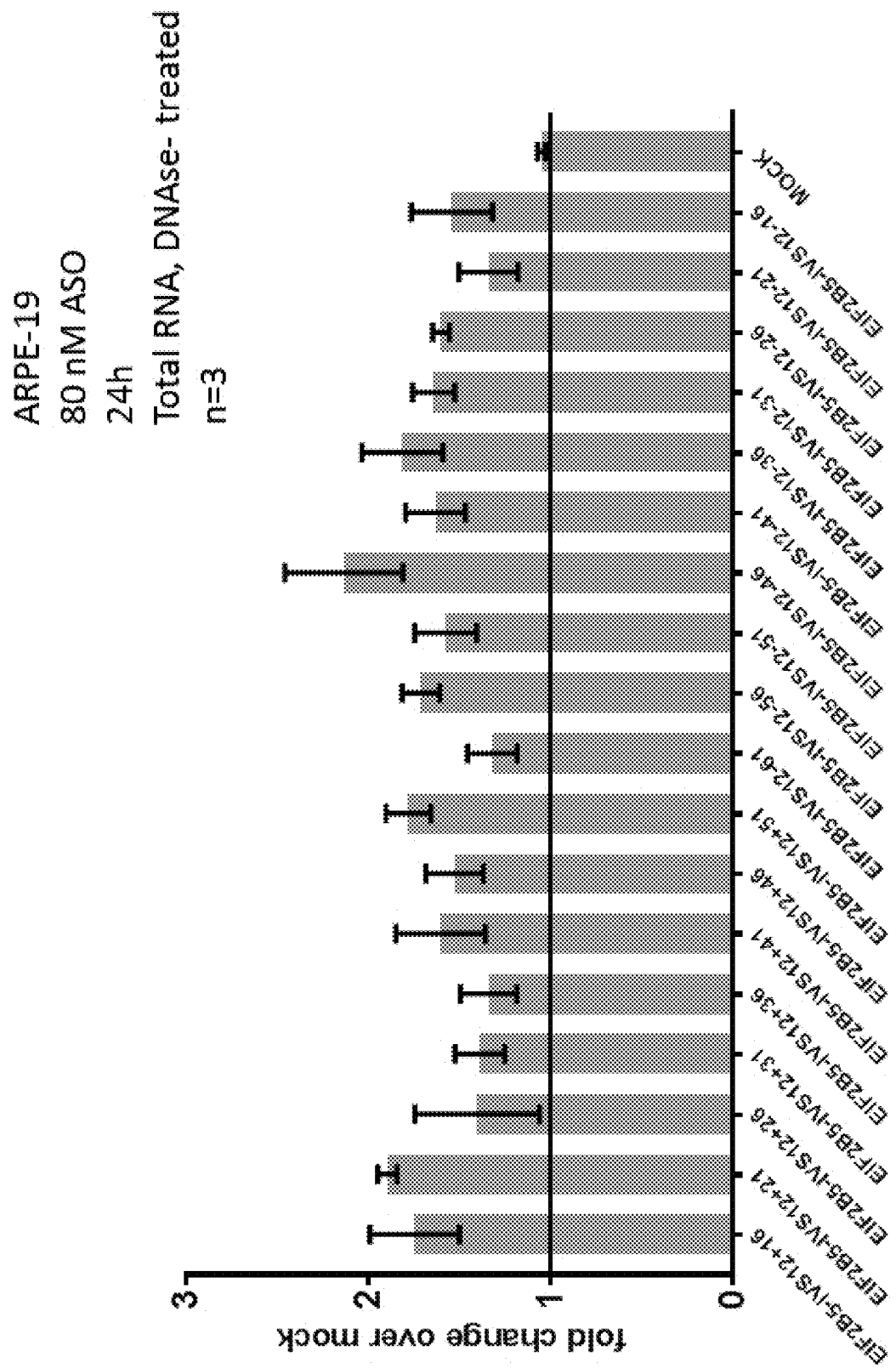
FIG. 50 depicts an exemplary graph showing the average (n=3) fold change in expression levels of EIF2B5 mRNA without intron 12 in ARPE-19 cells treated for 24 hrs with 80 nM of the indicated ASOs over mock treated cells. Data is normalized to RPL32 expression.

FIG. 50 depicts an exemplary graph showing the average (n=3) fold change in expression levels of EIF2B5 mRNA without intron 12 in ARPE-19 cells treated for 24 hrs with 80 nM of the indicated ASOs over mock treated cells. Data is normalized to RPL32 expression.

Figure 51:
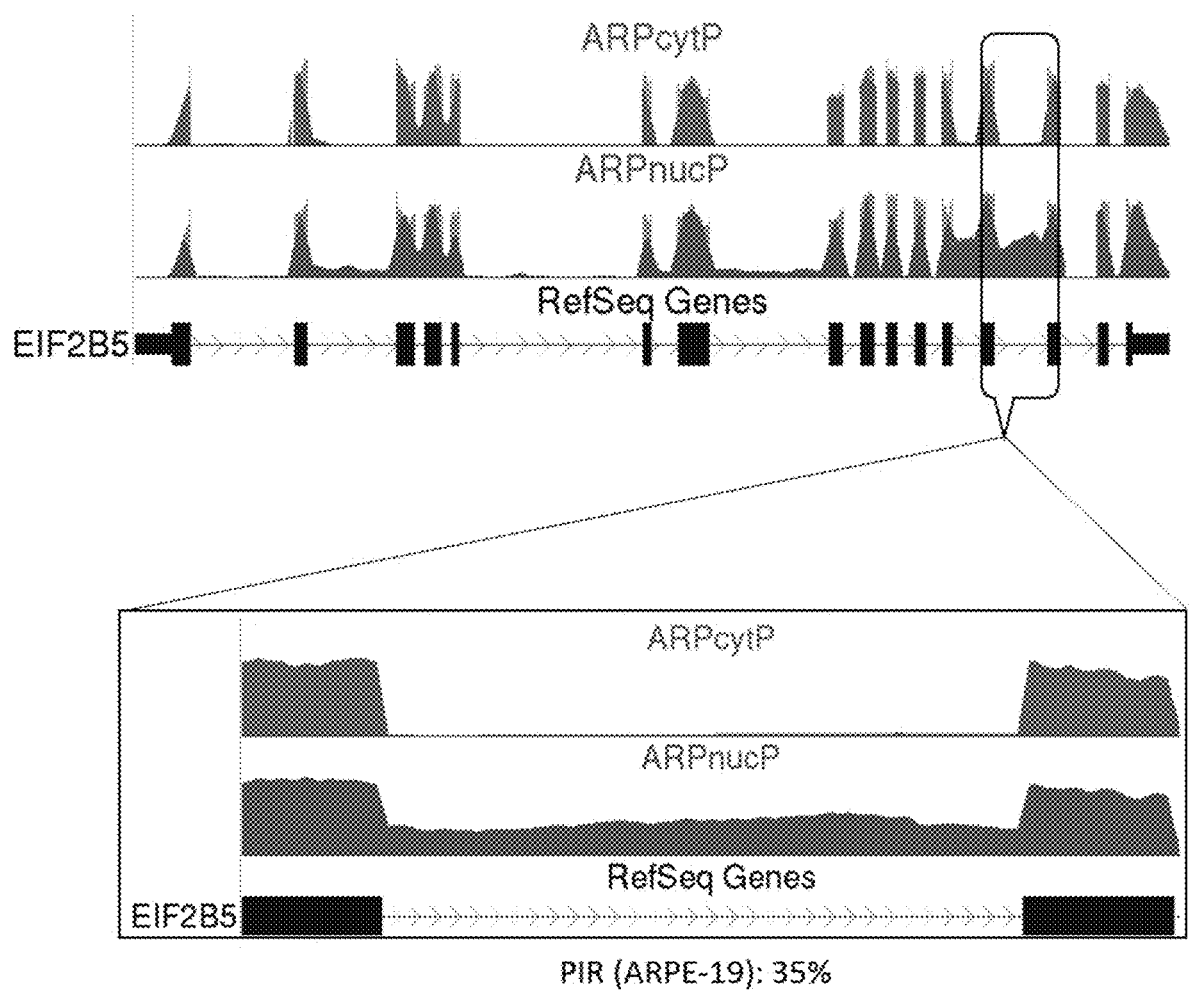
FIG. 51 depicts a schematic of the RefSeq Genes for EIF2B5 intron 13 corresponding to NM_003907. The Percent Intron Retention (PIR) of the circled intron is shown.

FIG. 51 depicts a schematic of the RefSeq Genes for EIF2B5 intron 13 corresponding to NM_003907. The Percent Intron Retention (PIR) of the circled intron is shown.

Figure 52:
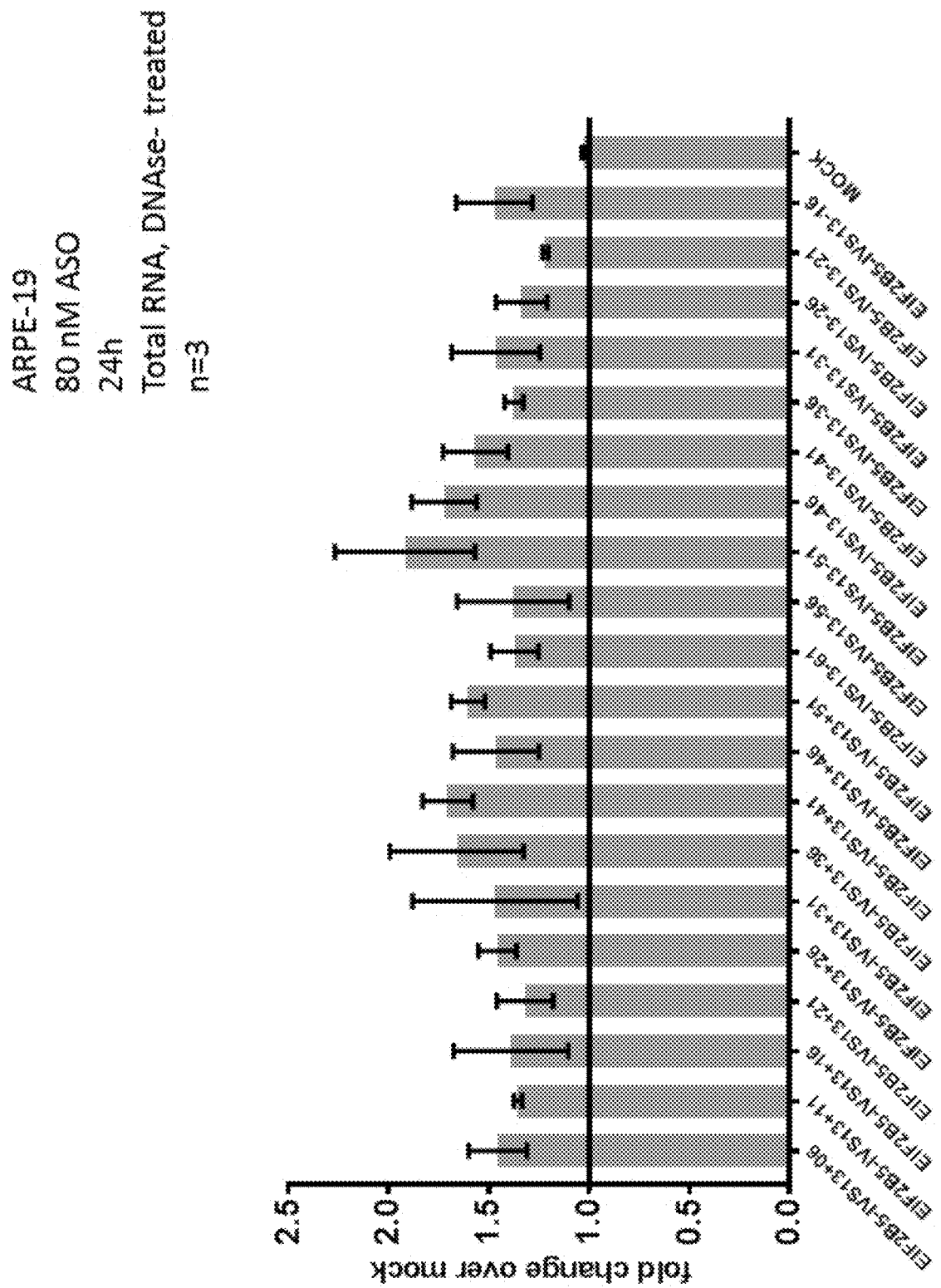
FIG. 52 depicts an exemplary graph showing the average (n=3) fold change in expression levels of EIF2B5 mRNA without intron 13 in ARPE-19 cells treated for 24 hrs with 80 nM of the indicated ASOs over mock treated cells. Data is normalized to RPL32 expression.

FIG. 52 depicts an exemplary graph showing the average (n=3) fold change in expression levels of EIF2B5 mRNA without intron 13 in ARPE-19 cells treated for 24 hrs with 80 nM of the indicated ASOs over mock treated cells. Data is normalized to RPL32 expression.

Figure 53:
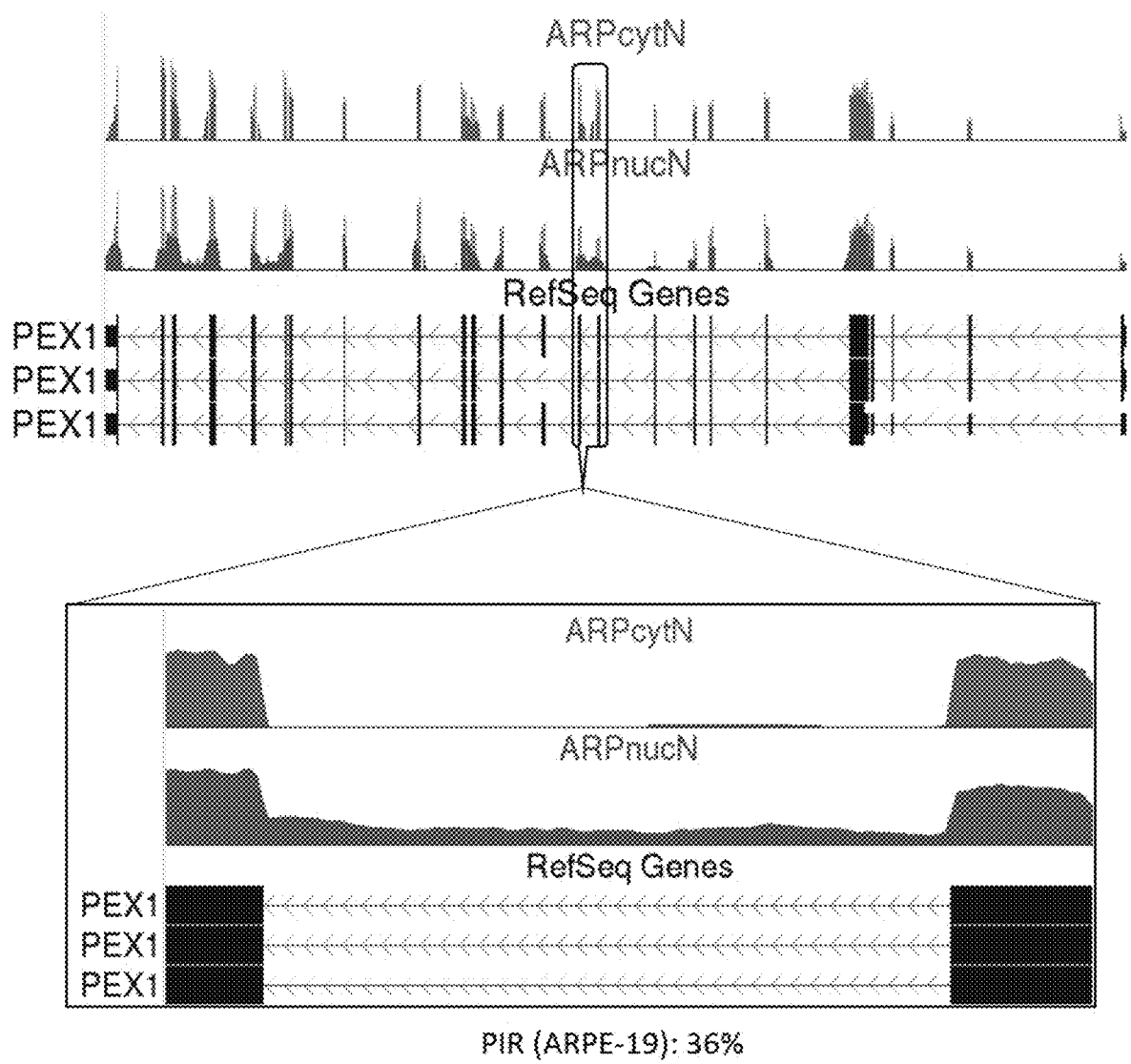
FIG. 53 depicts a schematic of the RefSeq Genes for PEX1 intron 10 corresponding to NM_000466. The Percent Intron Retention (PIR) of the circled intron is shown.

FIG. 53 depicts a schematic of the RefSeq Genes for PEX1 intron 10 corresponding to NM_000466. The Percent Intron Retention (PIR) of the circled intron is shown.

Figure 54:
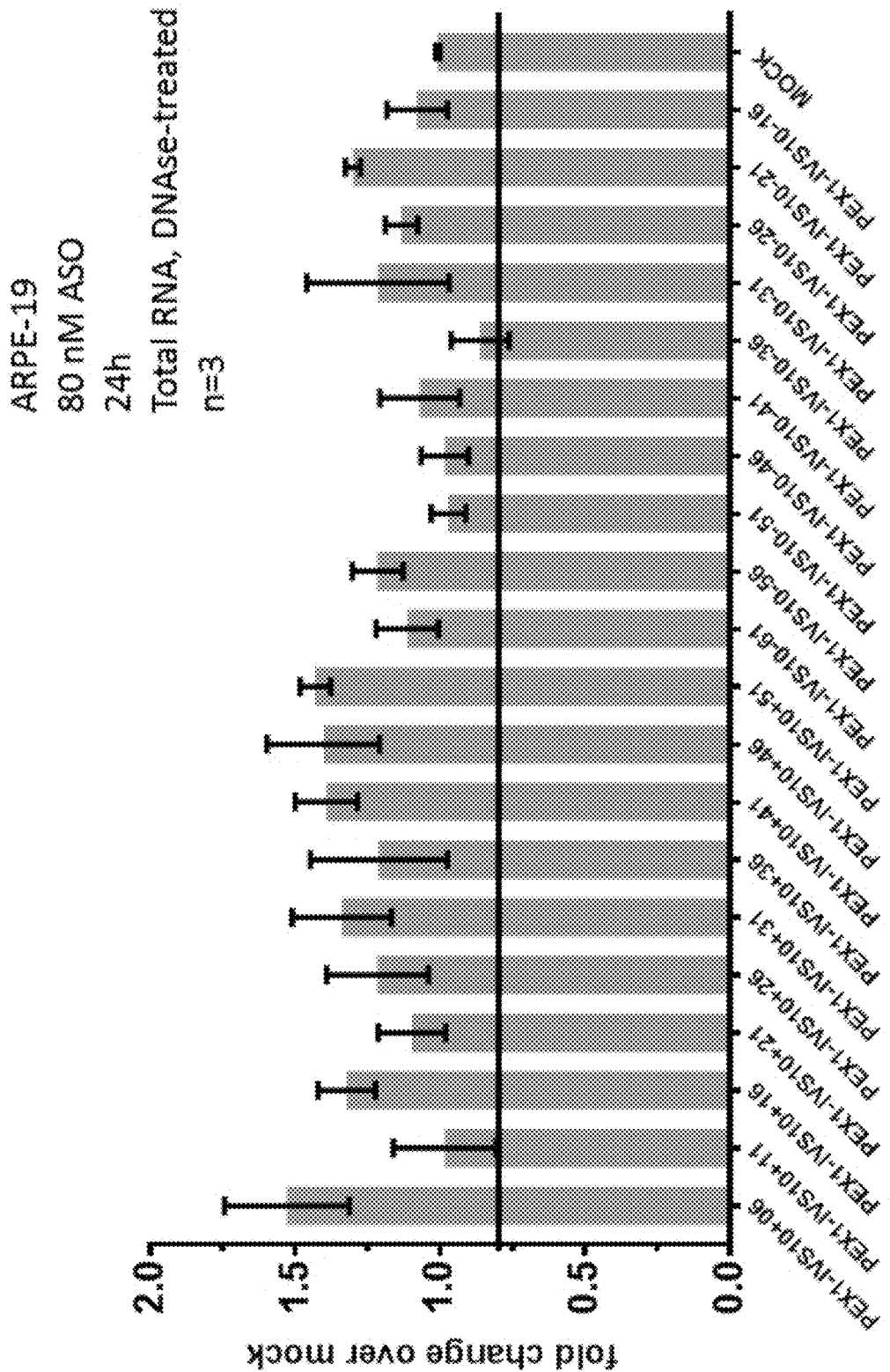
FIG. 54 depicts an exemplary graph showing the average (n=3) fold change in expression levels of PEX1 mRNA without intron 10 in ARPE-19 cells treated for 24 hrs with 80 nM of the indicated ASOs over mock treated cells. Data is normalized to RPL32 expression.

FIG. 54 depicts an exemplary graph showing the average (n=3) fold change in expression levels of PEX1 mRNA without intron 10 in ARPE-19 cells treated for 24 hrs with 80 nM of the indicated ASOs over mock treated cells. Data is normalized to RPL32 expression.

Figure 55:
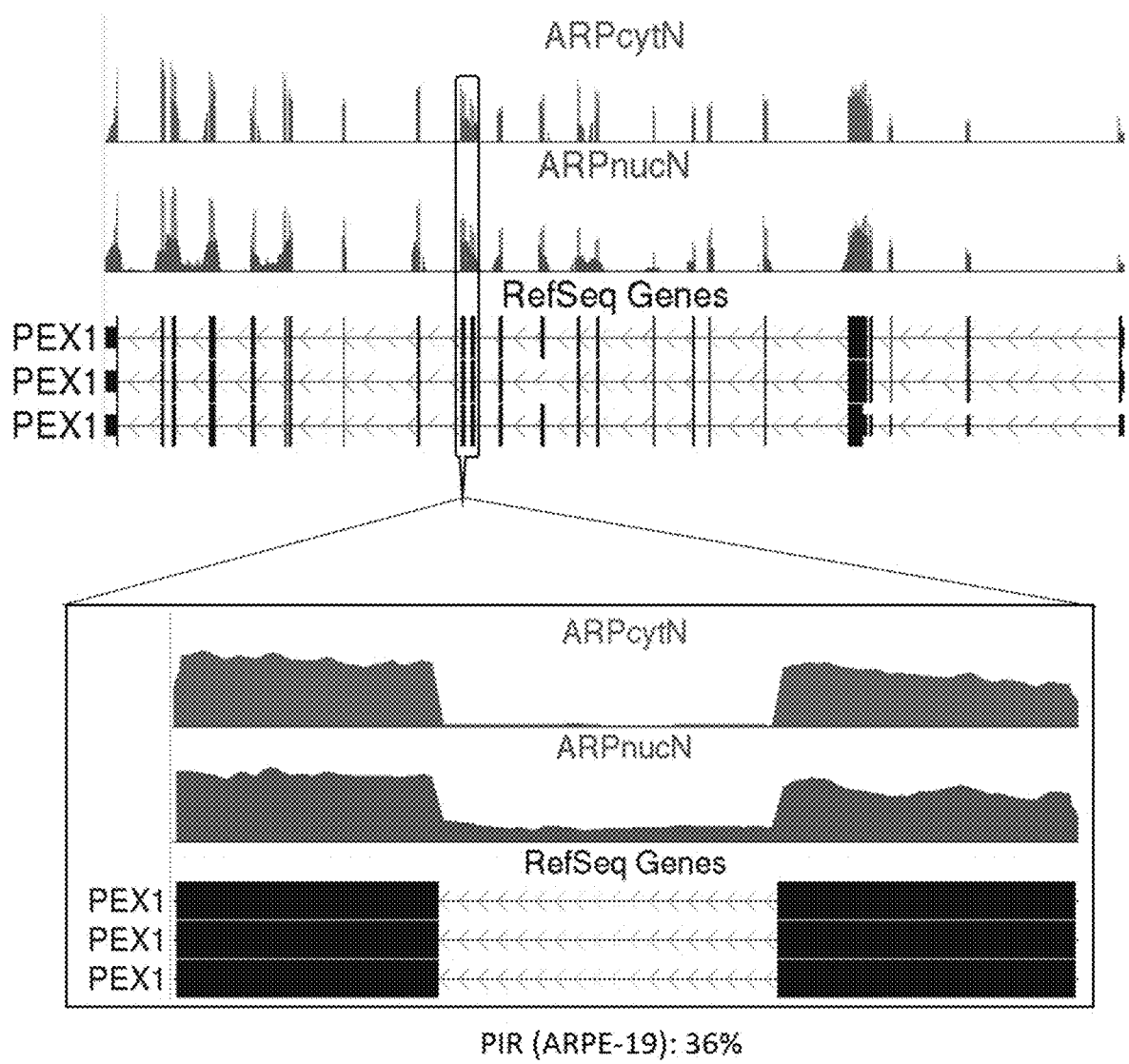
FIG. 55 depicts a schematic of the RefSeq Genes for PEX1 intron 14 corresponding to NM_000466. The Percent Intron Retention (PIR) of the circled intron is shown.

FIG. 55 depicts a schematic of the RefSeq Genes for PEX1 intron 14 corresponding to NM_000466. The Percent Intron Retention (PIR) of the circled intron is shown.

Figure 56:
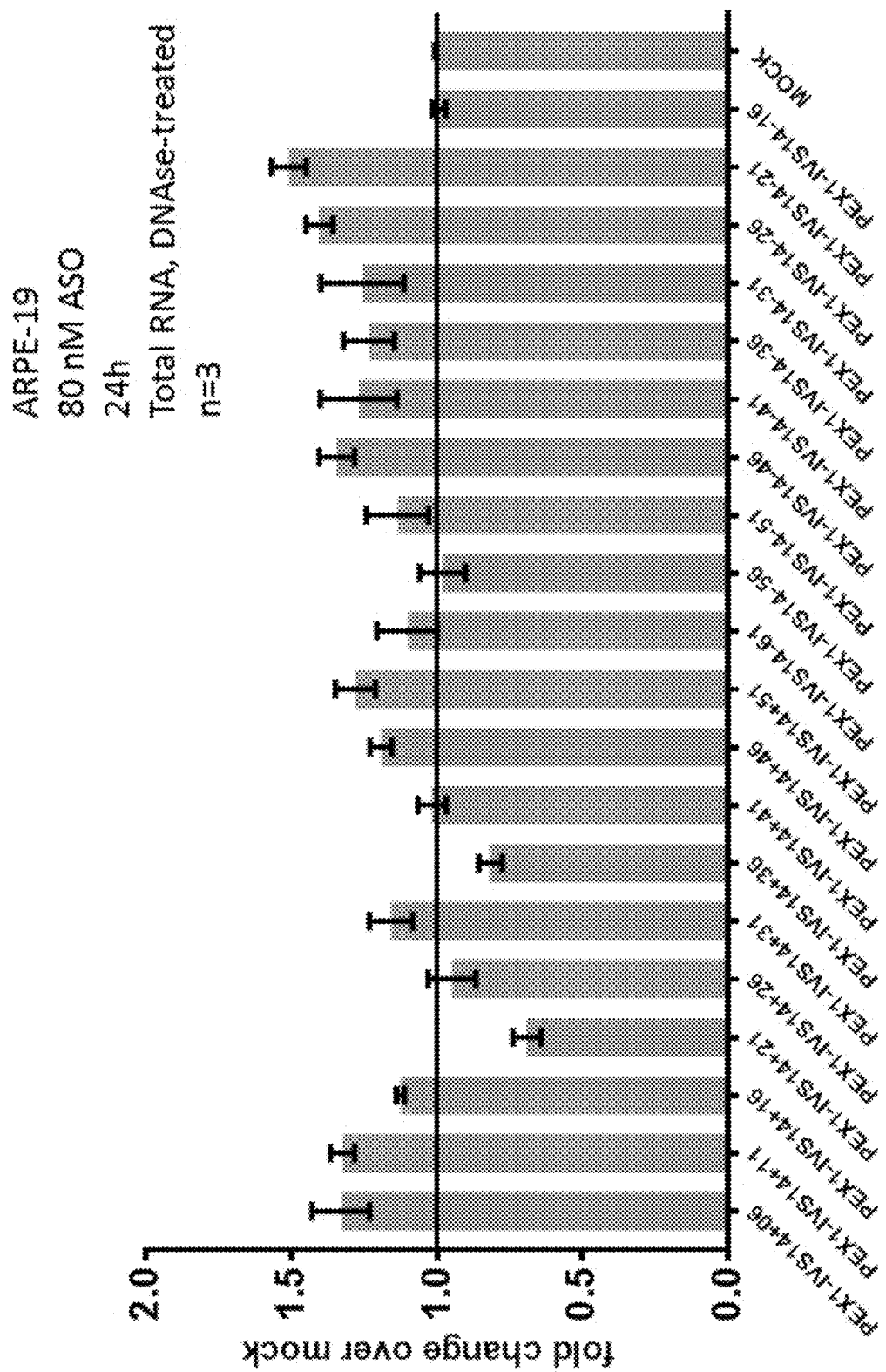
FIG. 56 depicts an exemplary graph showing the average (n=3) fold change in expression levels of PEX1 mRNA without intron 14 in ARPE-19 cells treated for 24 hrs with 80 nM of the indicated ASOs over mock treated cells. Data is normalized to RPL32 expression.

FIG. 56 depicts an exemplary graph showing the average (n=3) fold change in expression levels of PEX1 mRNA without intron 14 in ARPE-19 cells treated for 24 hrs with 80 nM of the indicated ASOs over mock treated cells. Data is normalized to RPL32 expression.

Figure 57:
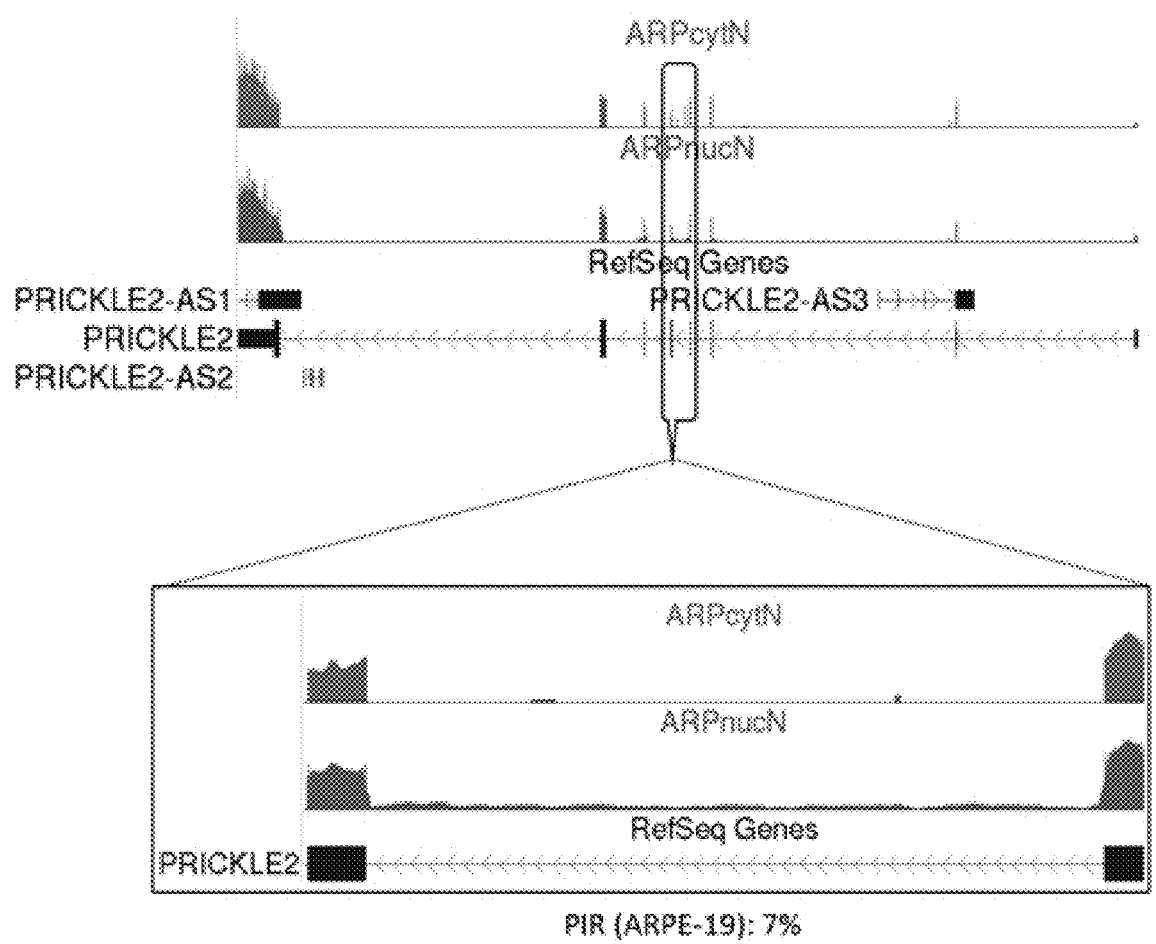
FIG. 57 depicts a schematic of the RefSeq Genes for PRICKLE2 intron 4 corresponding to NM_198859. The Percent Intron Retention (PIR) of the circled intron is shown.

FIG. 57 depicts a schematic of the RefSeq Genes for PRICKLE2 intron 4 corresponding to NM_198859. The Percent Intron Retention (PIR) of the circled intron is shown.

Figure 58:
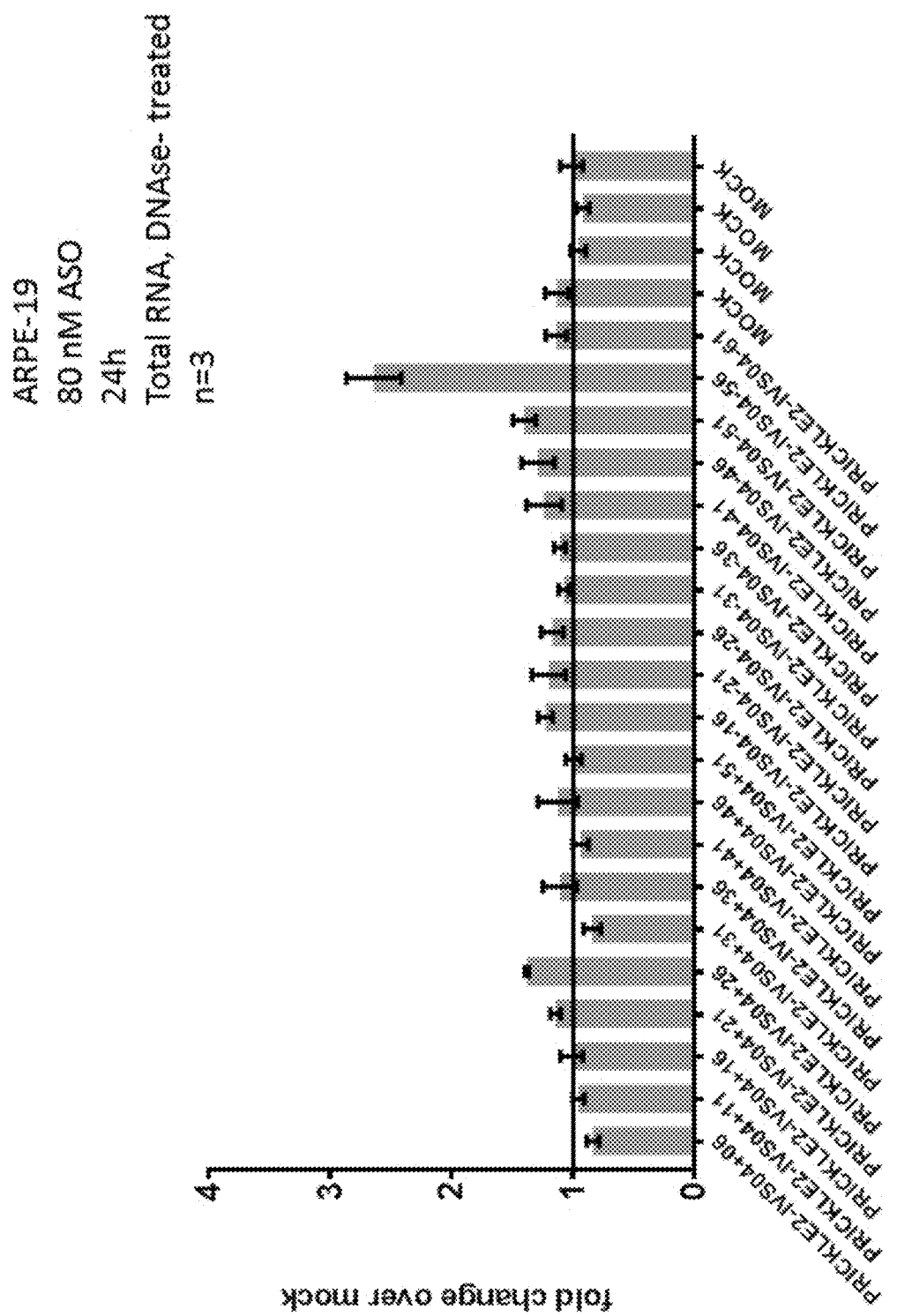
FIG. 58 depicts an exemplary graph showing the average (n=3) fold change in expression levels of PRICKLE2 mRNA without intron 4 in ARPE-19 cells treated for 24 hrs with 80 nM of the indicated ASOs over mock treated cells. Data is normalized to RPL32 expression.

FIG. 58 depicts an exemplary graph showing the average (n=3) fold change in expression levels of PRICKLE2 mRNA without intron 4 in ARPE-19 cells treated for 24 hrs with 80 nM of the indicated ASOs over mock treated cells. Data is normalized to RPL32 expression.

Figure 59:
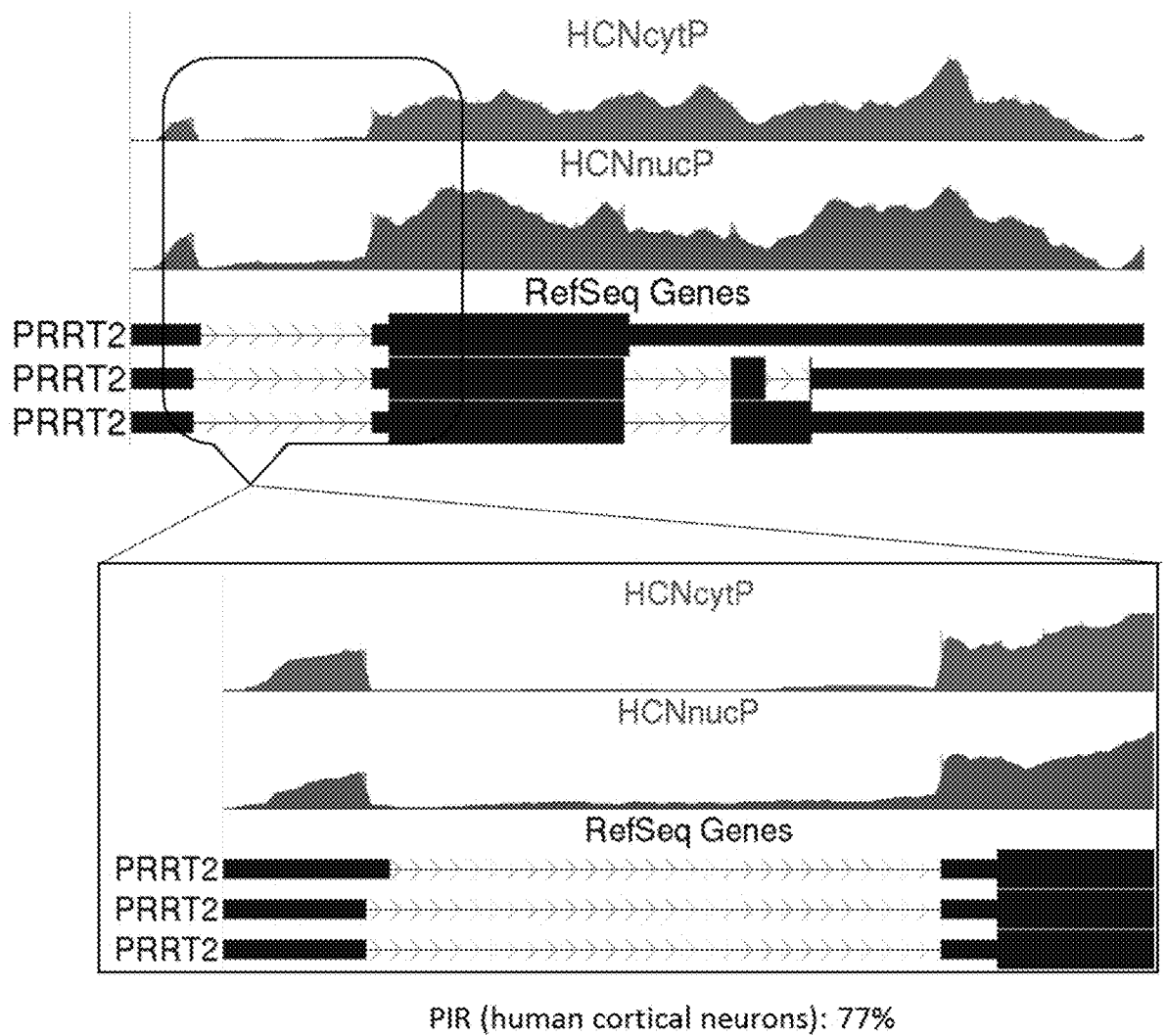
FIG. 59 depicts a schematic of the RefSeq Genes for PRRT2 intron 1 corresponding to NM_145239. The Percent Intron Retention (PIR) of the circled intron is shown.

FIG. 59 depicts a schematic of the RefSeq Genes for PRRT2 intron 1 corresponding to NM_145239. The Percent Intron Retention (PIR) of the circled intron is shown.

Figure 60:
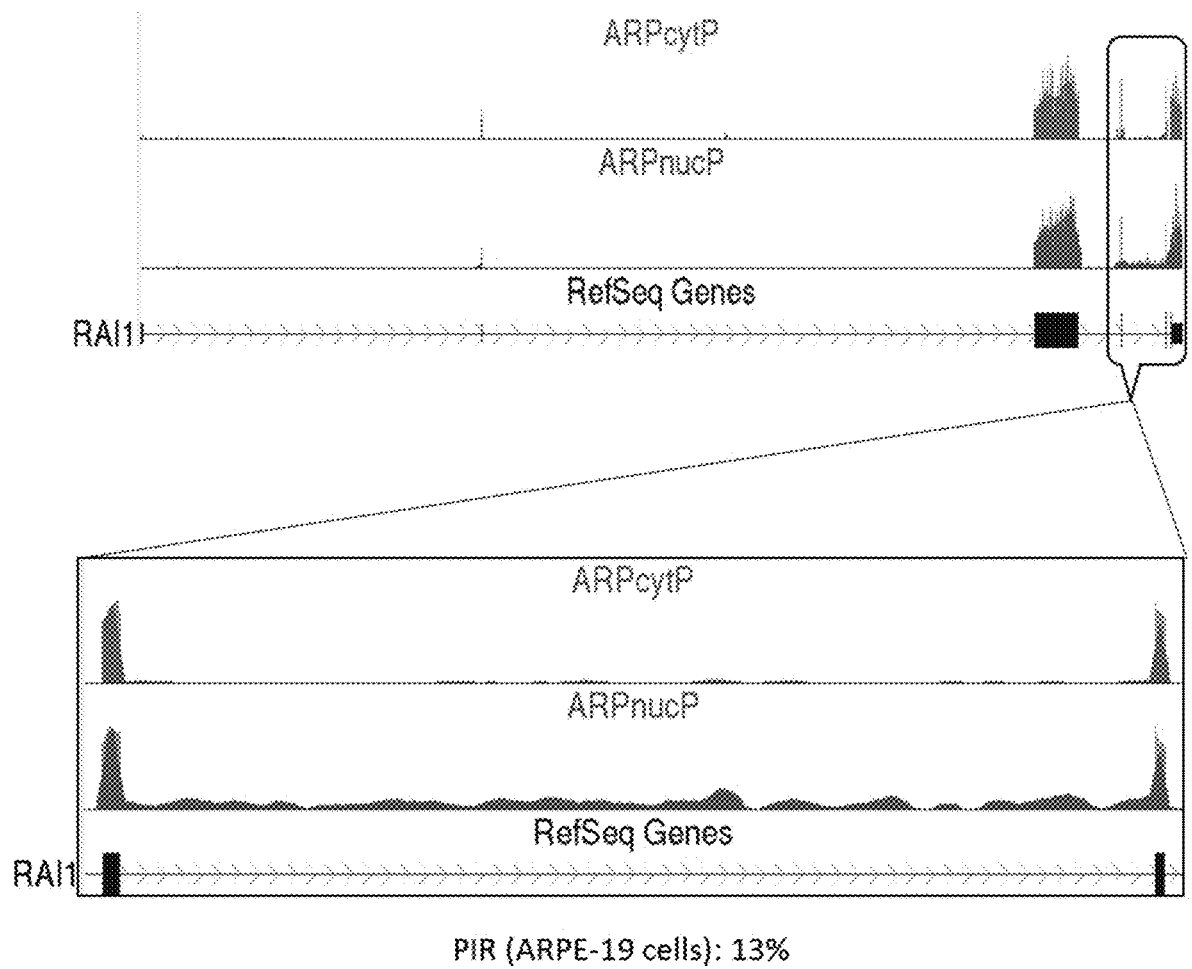
FIG. 60 depicts a schematic of the RefSeq Genes for RAI1 intron 4 corresponding to NM_030665. The Percent Intron Retention (PIR) of the circled intron is shown.

FIG. 60 depicts a schematic of the RefSeq Genes for RAI1 intron 4 corresponding to NM_030665. The Percent Intron Retention (PIR) of the circled intron is shown.

Figure 61:
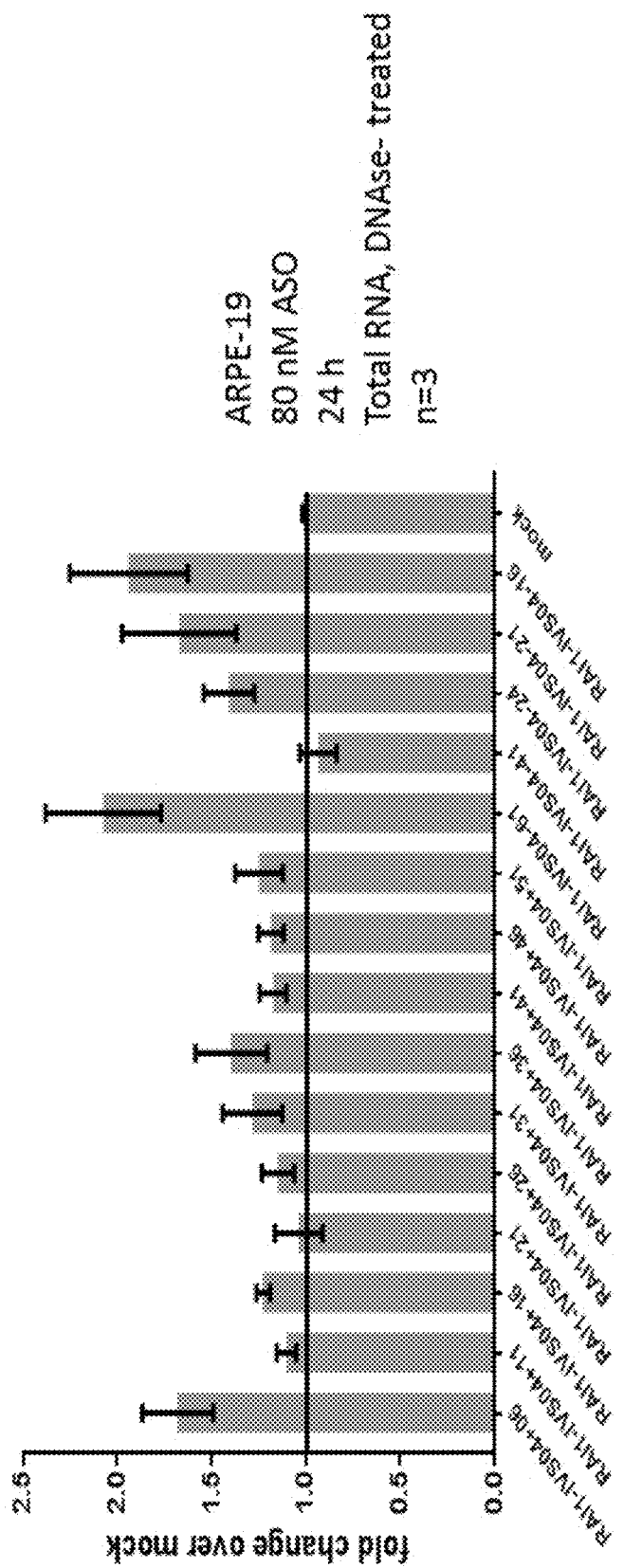
FIG. 61 depicts an exemplary graph showing the average (n=3) fold change in expression levels of RAI1 mRNA without intron 4 in ARPE-19 cells treated for 24 hrs with 80 nM of the indicated ASOs over mock treated cells. Data is normalized to RPL32 expression.

FIG. 61 depicts an exemplary graph showing the average (n=3) fold change in expression levels of RAI1 mRNA without intron 4 in ARPE-19 cells treated for 24 hrs with 80 nM of the indicated ASOs over mock treated cells. Data is normalized to RPL32 expression.

Figure 62:
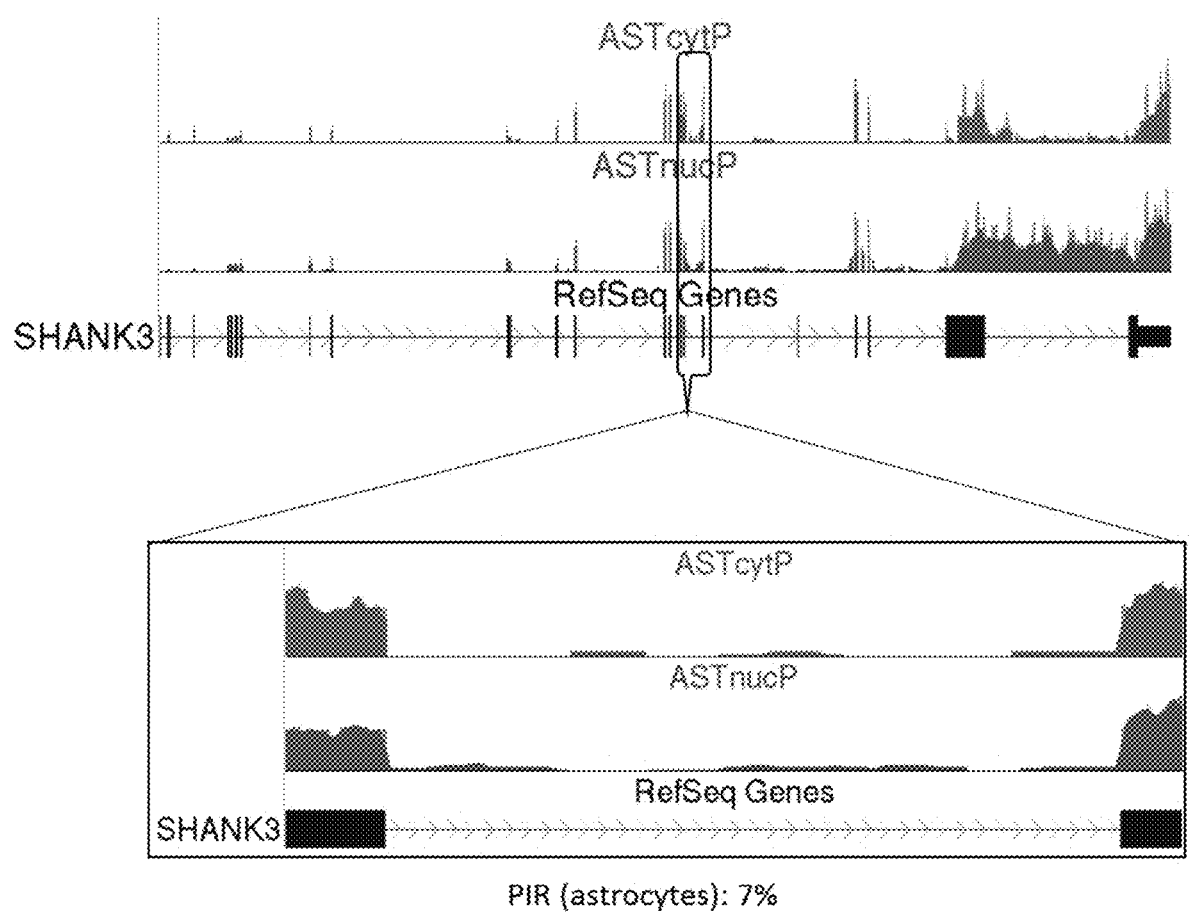
FIG. 62 depicts a schematic of the RefSeq Genes for SHANK3 intron 16 corresponding to NM_033517. The Percent Intron Retention (PIR) of the circled intron is shown.

FIG. 62 depicts a schematic of the RefSeq Genes for SHANK3 intron 16 corresponding to NM_033517. The Percent Intron Retention (PIR) of the circled intron is shown.

Figure 63:
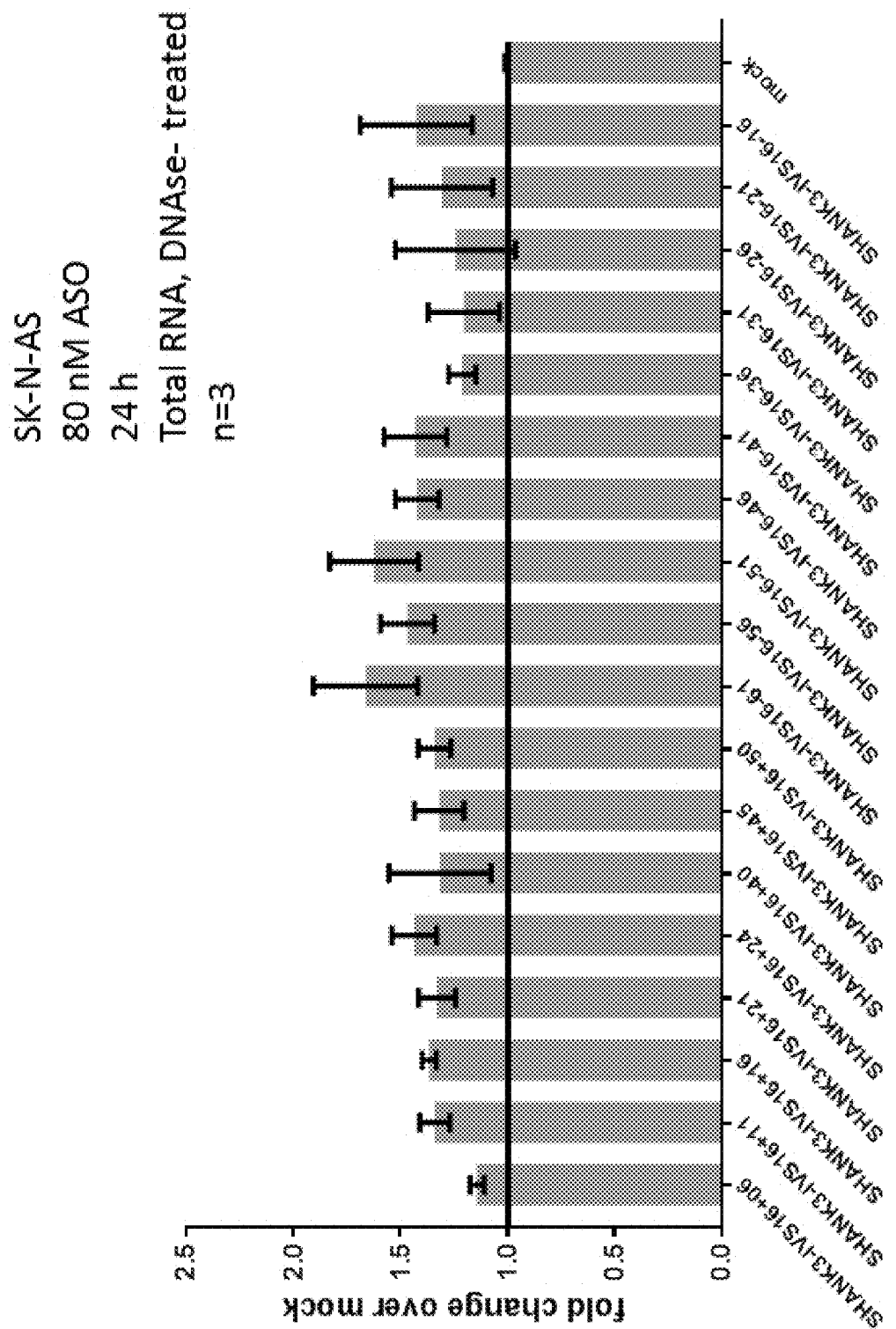
FIG. 63 depicts an exemplary graph showing the average (n=3) fold change in expression levels of SHANK3 mRNA without intron 16 in ARPE-19 cells treated for 24 hrs with 80 nM of the indicated ASOs over mock treated cells. Data is normalized to RPL32 expression.

FIG. 63 depicts an exemplary graph showing the average (n=3) fold change in expression levels of SHANK3 mRNA without intron 16 in ARPE-19 cells treated for 24 hrs with 80 nM of the indicated ASOs over mock treated cells. Data is normalized to RPL32 expression.

Figure 64:
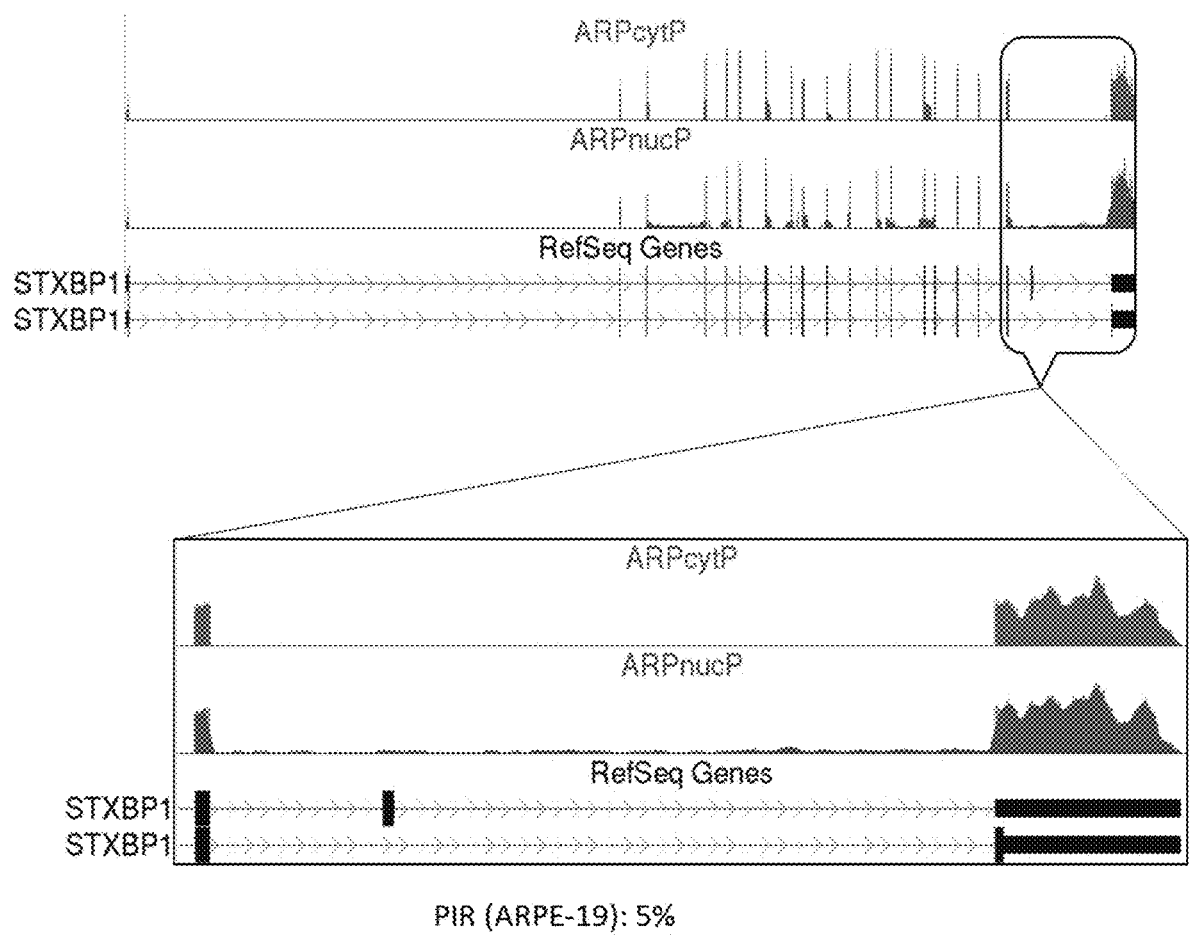
FIG. 64 depicts a schematic of the RefSeq Genes for STXBP1 intron 18 corresponding to NM_001032221. The Percent Intron Retention (PIR) of the circled intron is shown.

FIG. 64 depicts a schematic of the RefSeq Genes for STXBP1 intron 18 corresponding to NM_001032221. The Percent Intron Retention (PIR) of the circled intron is shown.

Figure 65:
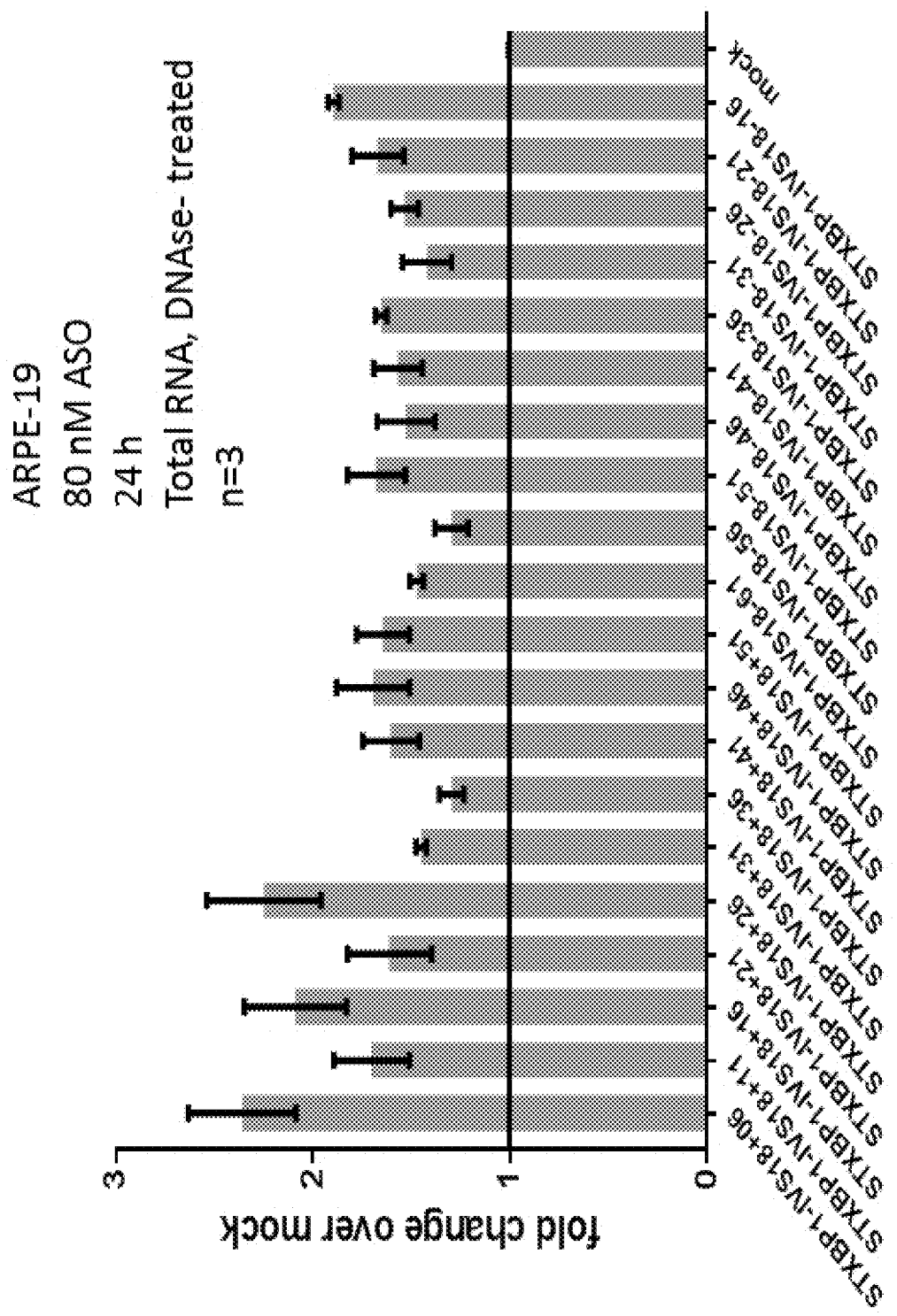
FIG. 65 depicts an exemplary graph showing the average (n=3) fold change in expression levels of STXBP1 mRNA without intron 18 in ARPE-19 cells treated for 24 hrs with 80 nM of the indicated ASOs over mock treated cells. Data is normalized to RPL32 expression.

FIG. 65 depicts an exemplary graph showing the average (n=3) fold change in expression levels of STXBP1 mRNA without intron 18 in ARPE-19 cells treated for 24 hrs with 80 nM of the indicated ASOs over mock treated cells. Data is normalized to RPL32 expression.

Figure 66:
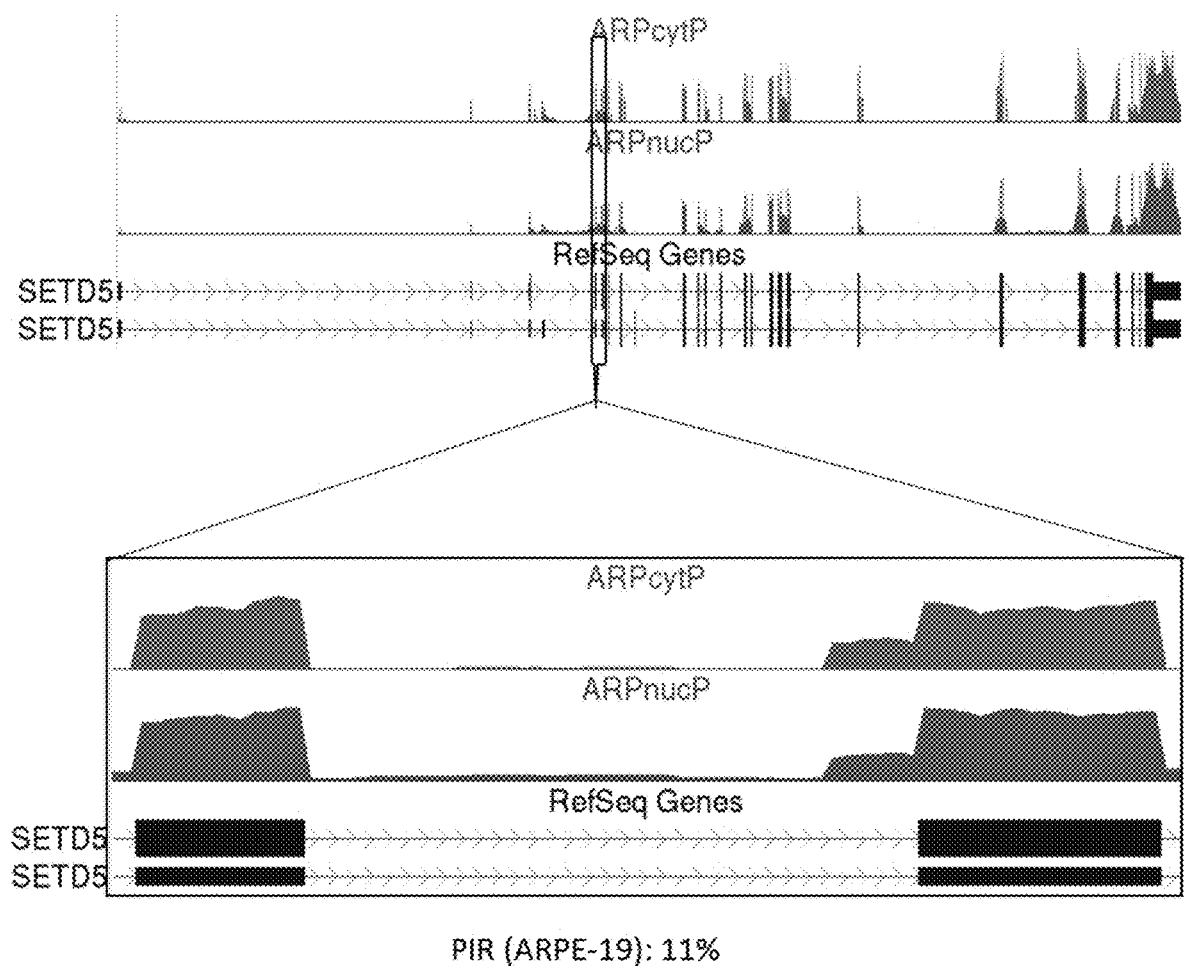
FIG. 66 depicts a schematic of the RefSeq Genes for SETD5 intron 4 corresponding to NM_001080517. The Percent Intron Retention (PIR) of the circled intron is shown.

FIG. 66 depicts a schematic of the RefSeq Genes for SETD5 intron 4 corresponding to NM_001080517. The Percent Intron Retention (PIR) of the circled intron is shown.

Figure 67:
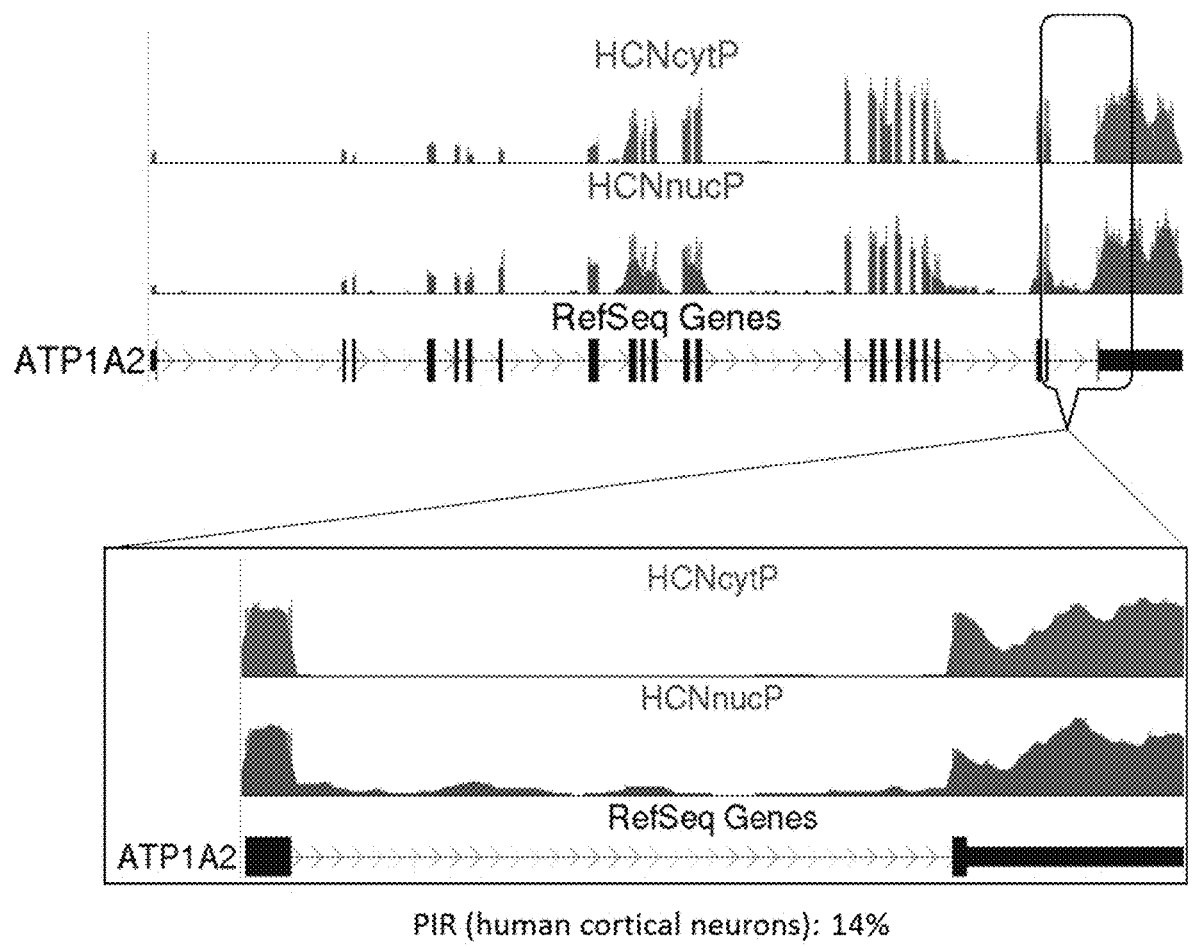
FIG. 67 depicts a schematic of the RefSeq Genes for ATP1A2 intron 22 corresponding to NM_000702. The Percent Intron Retention (PIR) of the circled intron is shown.

FIG. 67 depicts a schematic of the RefSeq Genes for ATP1A2 intron 22 corresponding to NM_000702. The Percent Intron Retention (PIR) of the circled intron is shown.

Figure 68:
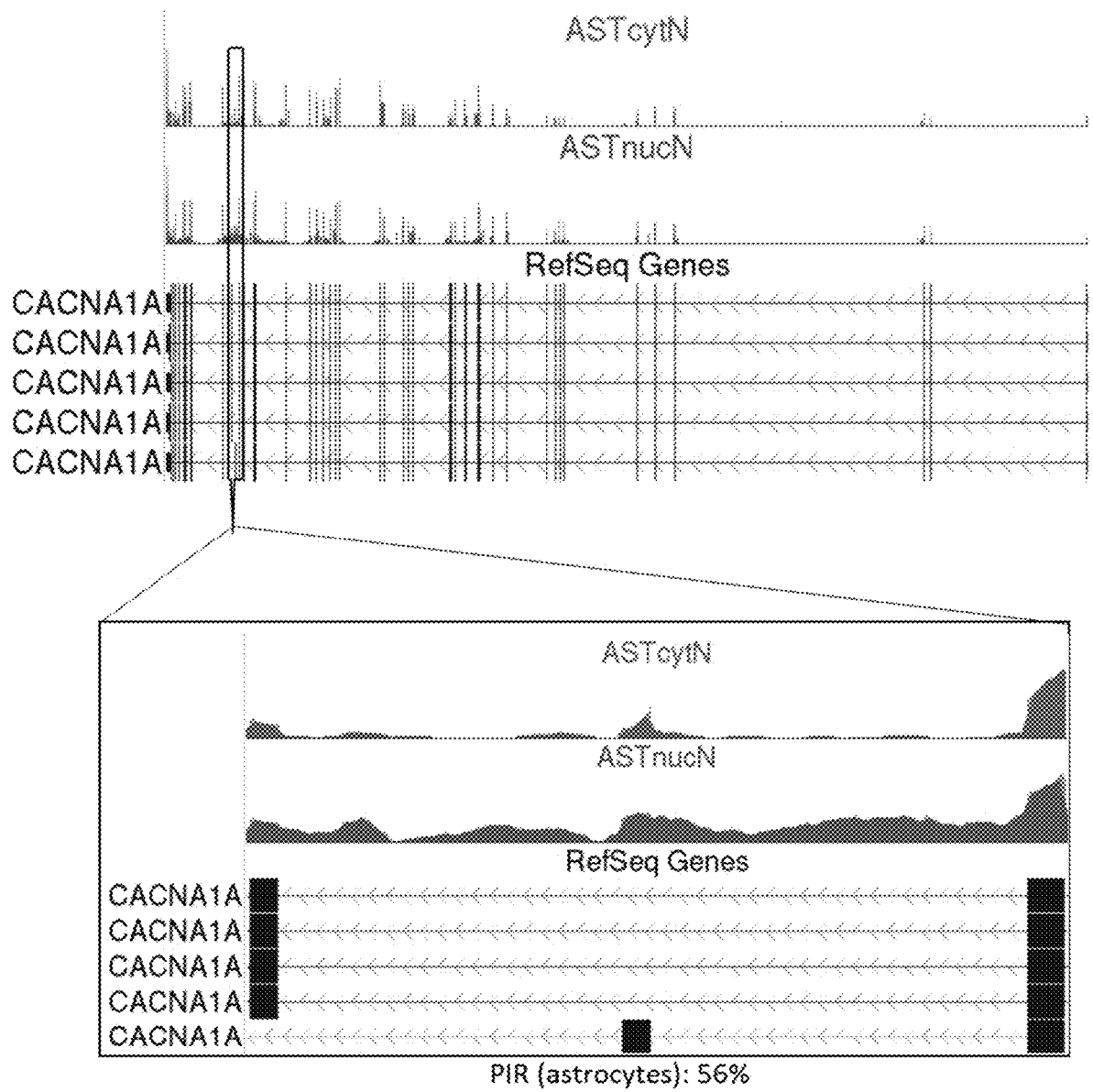
FIG. 68 depicts a schematic of the RefSeq Genes for CACNA1A intron 36 corresponding to NM_023035. The Percent Intron Retention (PIR) of the circled intron is shown.

FIG. 68 depicts a schematic of the RefSeq Genes for CACNA1A intron 36 corresponding to NM_023035. The Percent Intron Retention (PIR) of the circled intron is shown.

Figure 69:
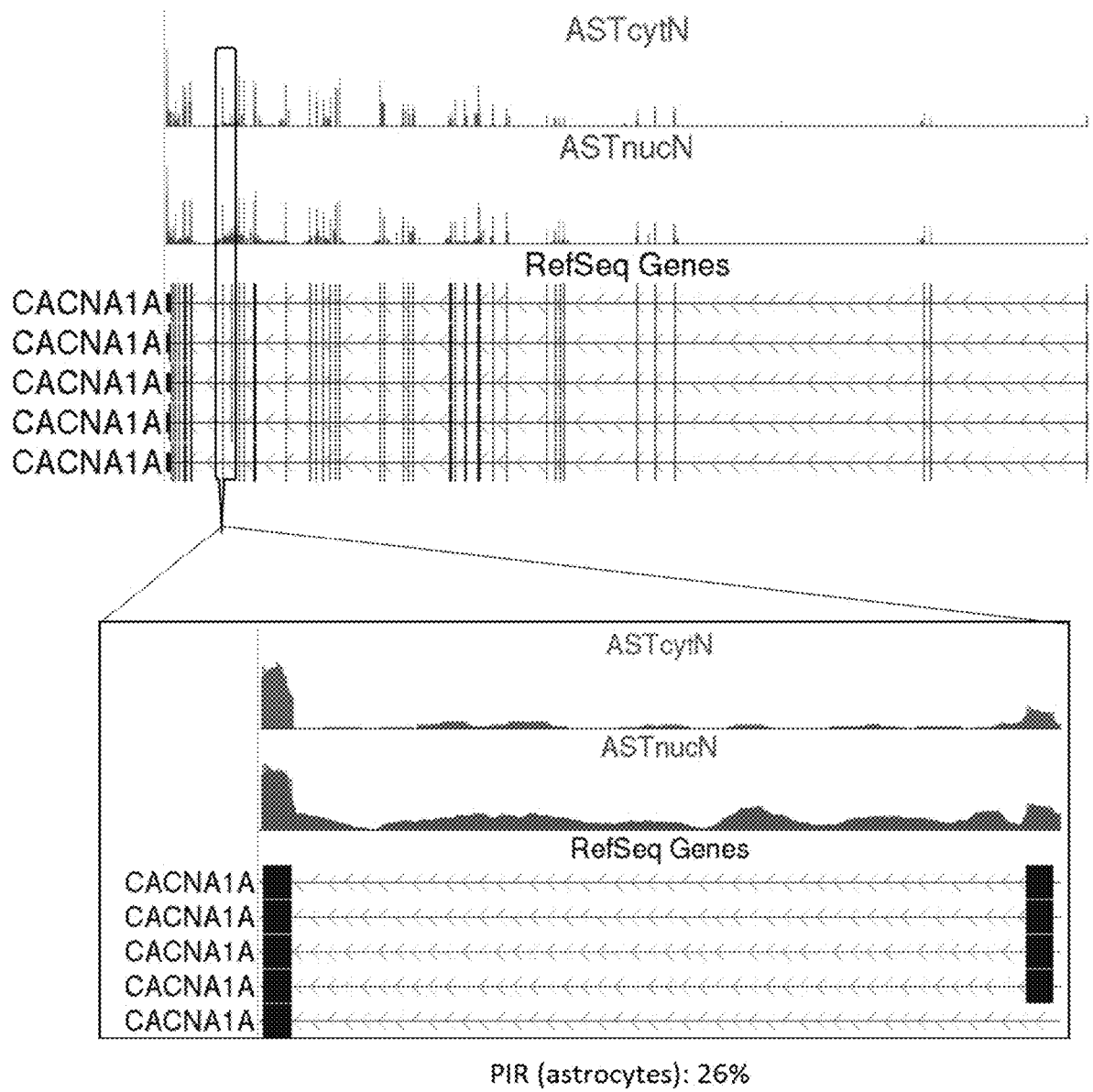
FIG. 69 depicts a schematic of the RefSeq Genes for CACNA1A intron 37 corresponding to NM_023035. The Percent Intron Retention (PIR) of the circled intron is shown.

FIG. 69 depicts a schematic of the RefSeq Genes for CACNA1A intron 37 corresponding to NM_023035. The Percent Intron Retention (PIR) of the circled intron is shown.

Figure 70:
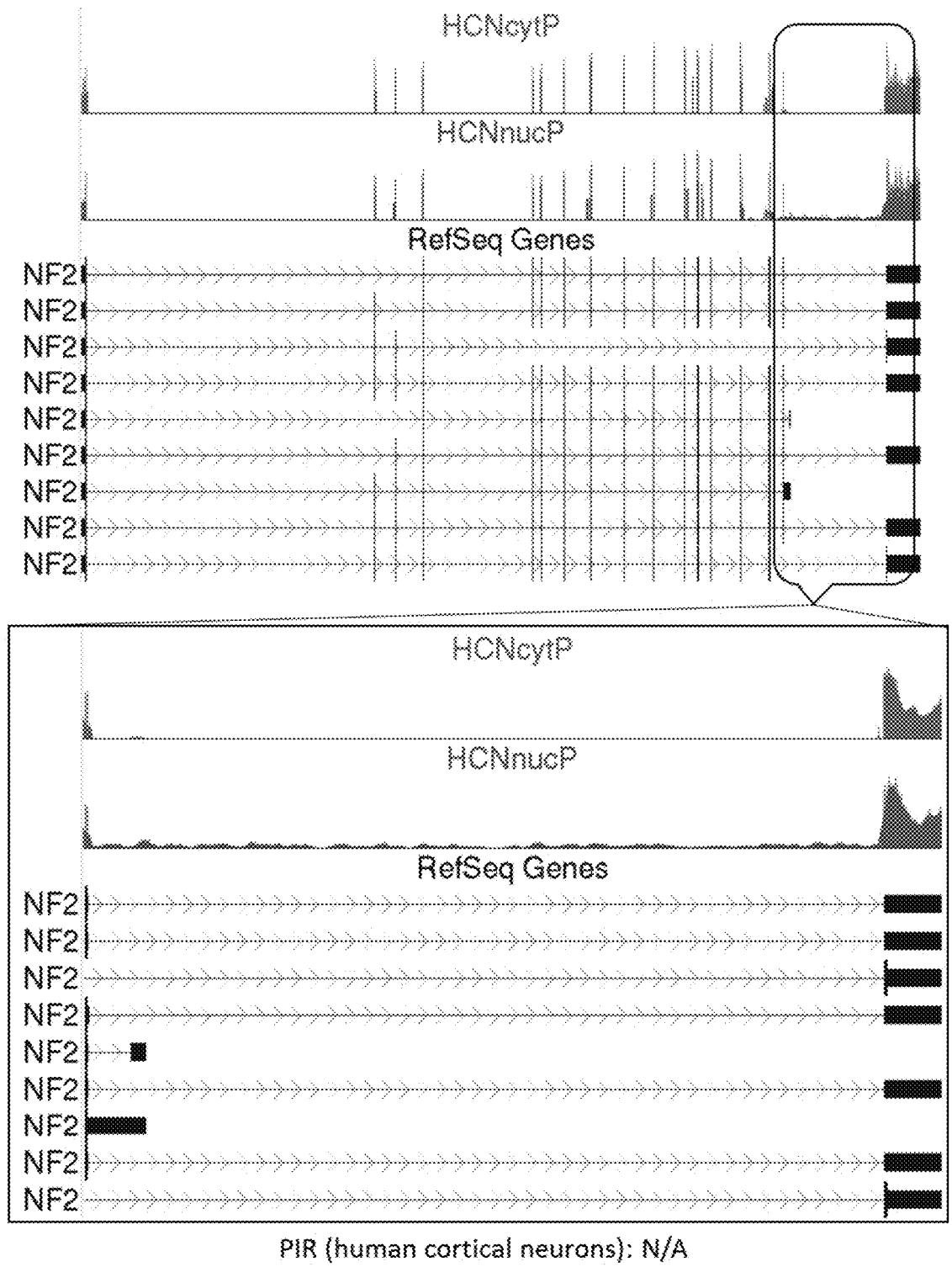
FIG. 70 depicts a schematic of the RefSeq Genes for NF2 intron 16 corresponding to NM_181832. The Percent Intron Retention (PIR) of the circled intron is shown.

FIG. 70 depicts a schematic of the RefSeq Genes for NF2 intron 16 corresponding to NM_181832. The Percent Intron Retention (PIR) of the circled intron is shown.

Figure 71:
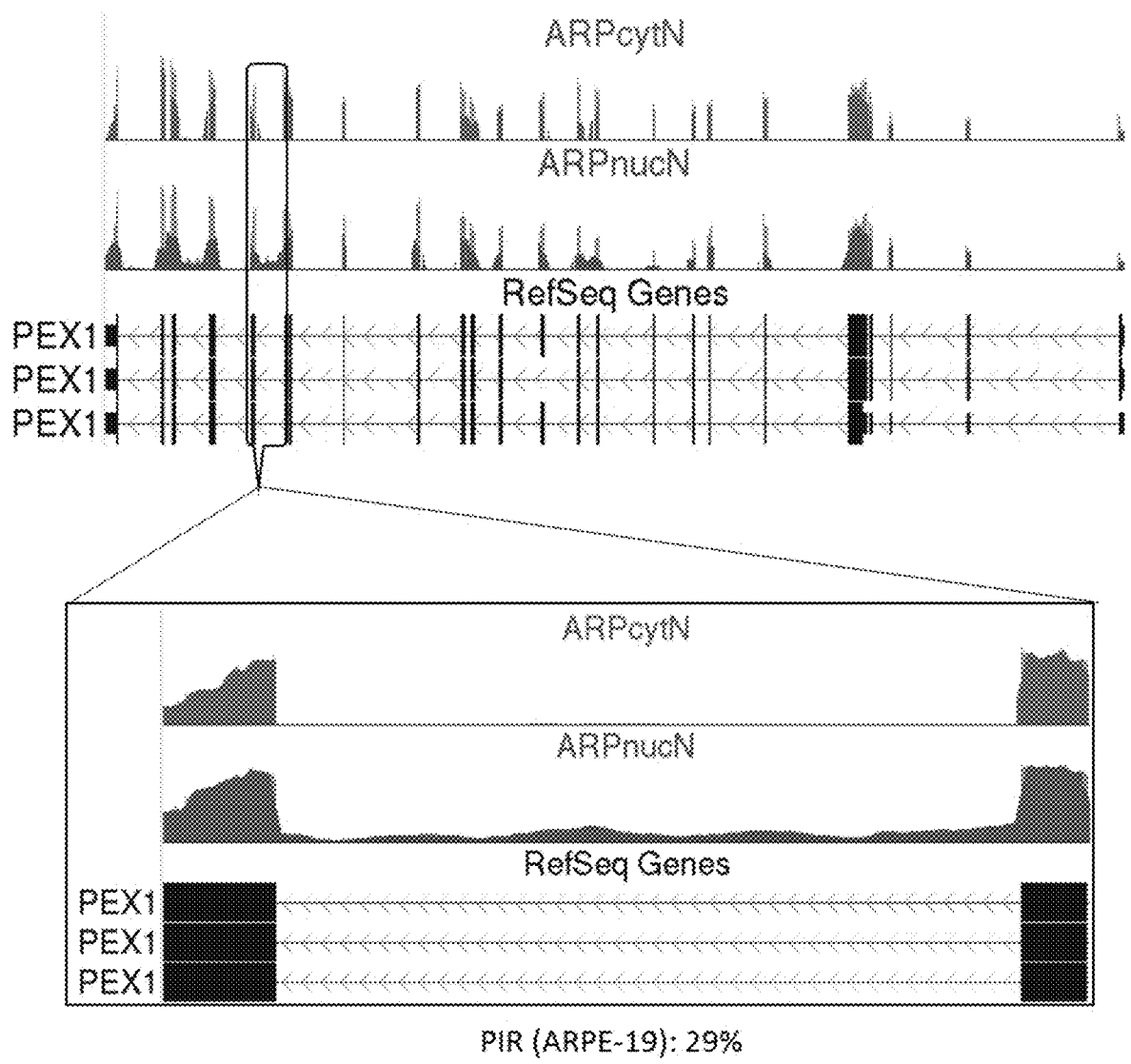
FIG. 71 depicts a schematic of the RefSeq Genes for PEX1 intron 19 corresponding to NM_000466. The Percent Intron Retention (PIR) of the circled intron is shown.

FIG. 71 depicts a schematic of the RefSeq Genes for PEX1 intron 19 corresponding to NM_000466. The Percent Intron Retention (PIR) of the circled intron is shown.

Figure 72:
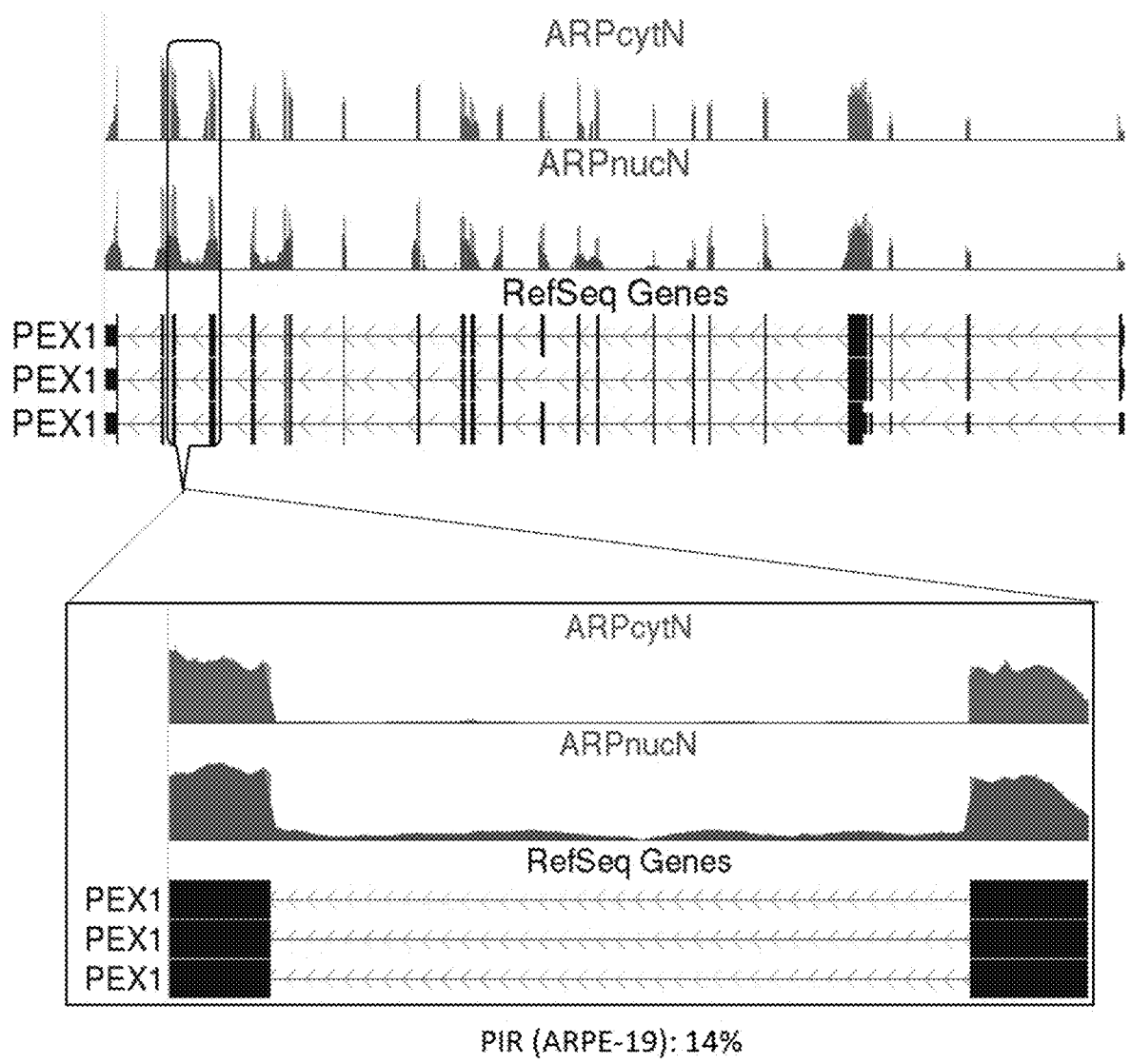
FIG. 72 depicts a schematic of the RefSeq Genes for PEX1 intron 21 corresponding to NM_000466. The Percent Intron Retention (PIR) of the circled intron is shown.

FIG. 72 depicts a schematic of the RefSeq Genes for PEX1 intron 21 corresponding to NM_000466. The Percent Intron Retention (PIR) of the circled intron is shown.

Figure 73:
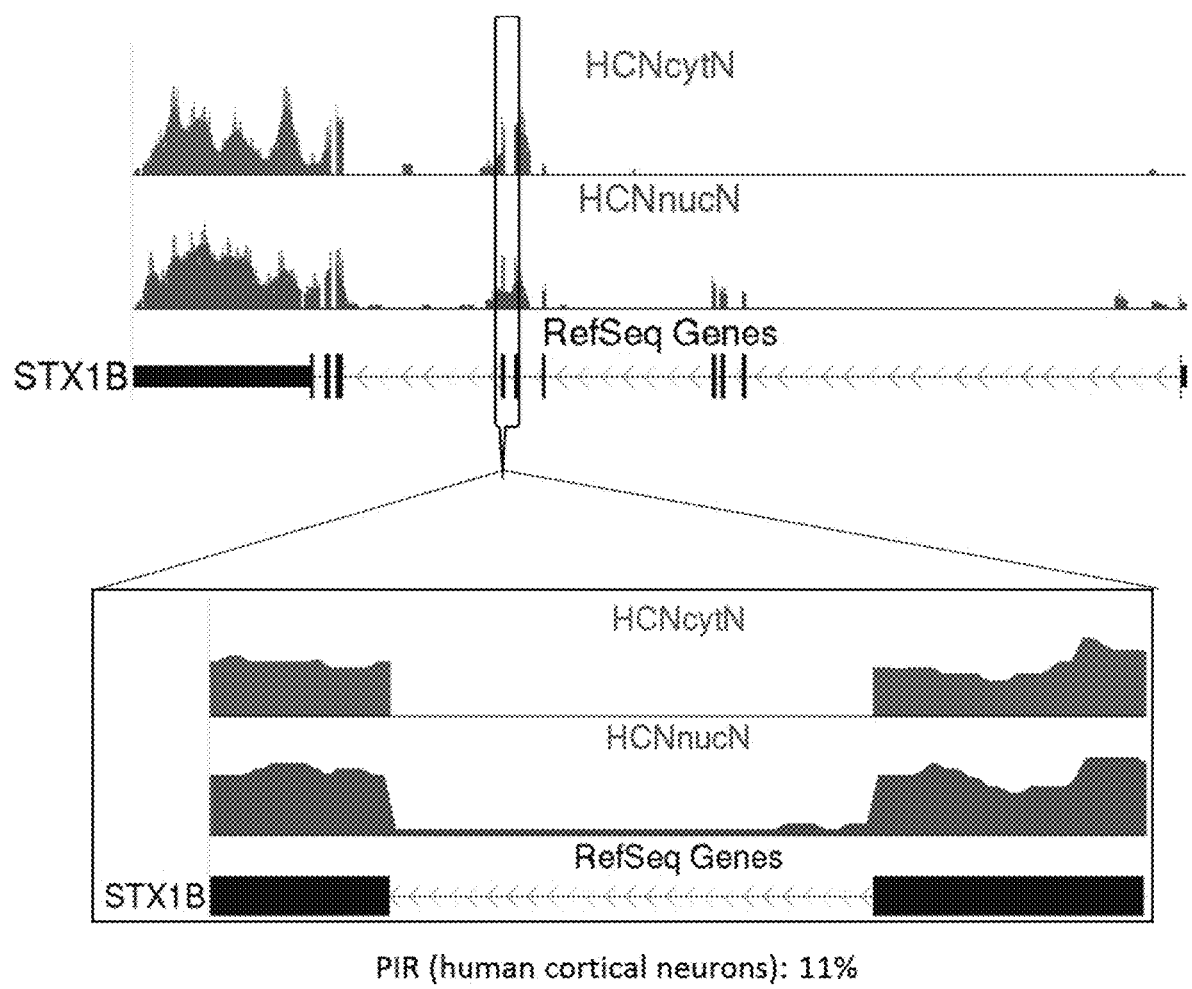
FIG. 73 depicts a schematic of the RefSeq Genes for STX1B intron 6 corresponding to NM_052874. The Percent Intron Retention (PIR) of the circled intron is shown.

FIG. 73 depicts a schematic of the RefSeq Genes for STX1B intron 6 corresponding to NM_052874. The Percent Intron Retention (PIR) of the circled intron is shown.

Figure 74:
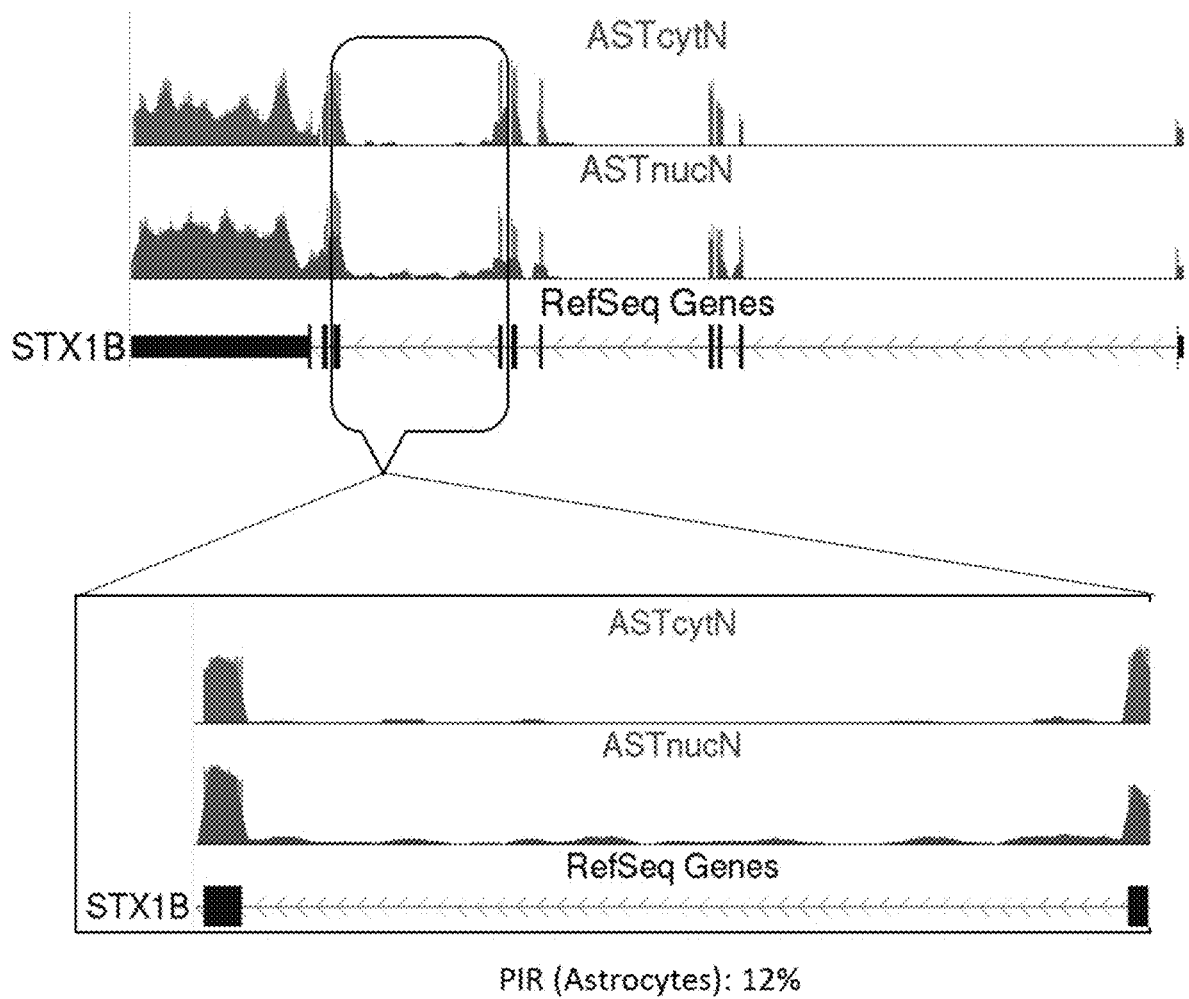
FIG. 74 depicts a schematic of the RefSeq Genes for STX1B intron 7 corresponding to NM_052874. The Percent Intron Retention (PIR) of the circled intron is shown.

FIG. 74 depicts a schematic of the RefSeq Genes for STX1B intron 7 corresponding to NM_052874. The Percent Intron Retention (PIR) of the circled intron is shown.

Figure 75:
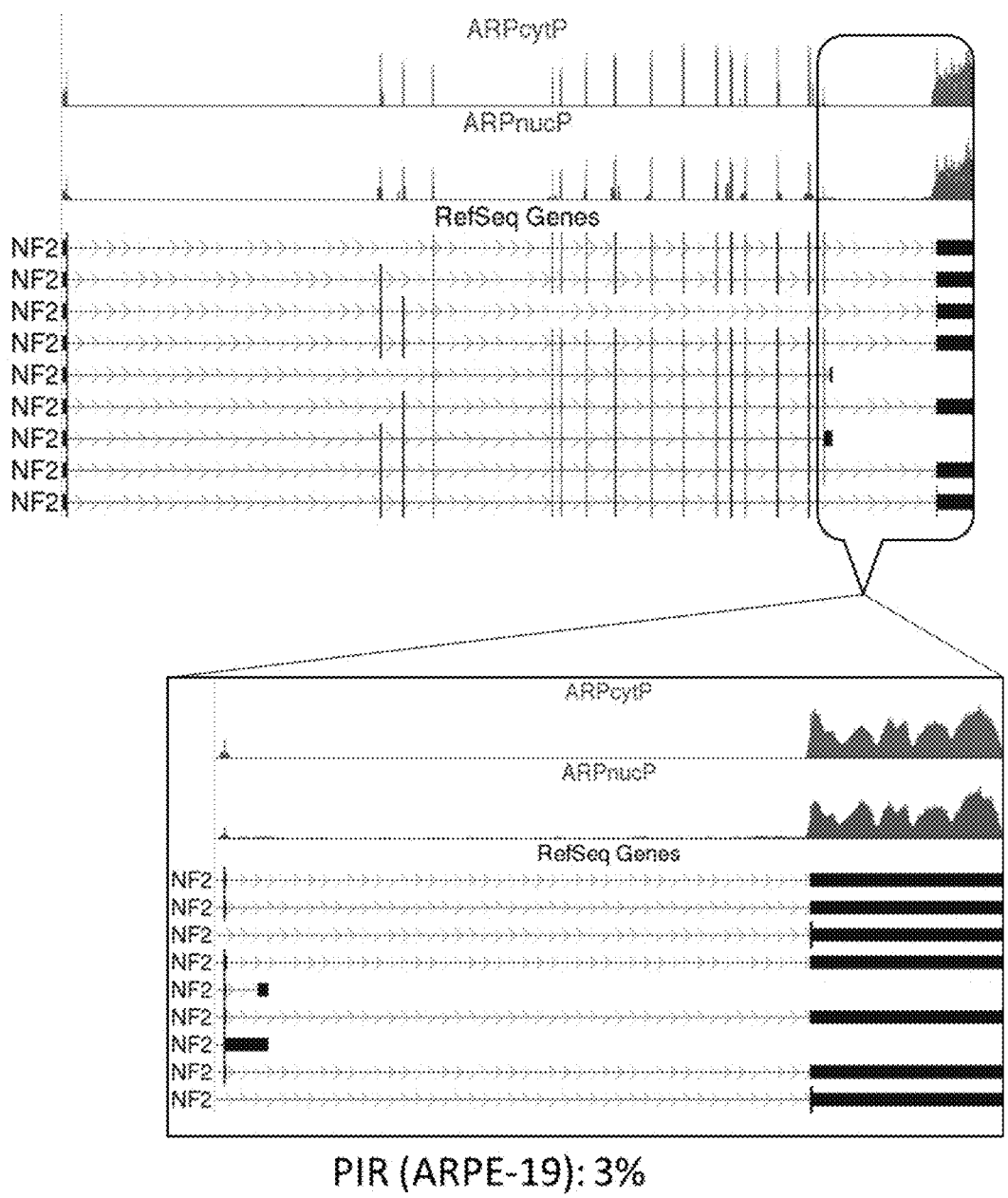
FIG. 75 depicts a schematic of the RefSeq Genes for NF2 intron 16 corresponding to NM_181832. The Percent Intron Retention (PIR) of the circled intron is shown.

FIG. 75 depicts a schematic of the RefSeq Genes for NF2 intron 16 corresponding to NM_181832. The Percent Intron Retention (PIR) of the circled intron is shown.

Figure 76:
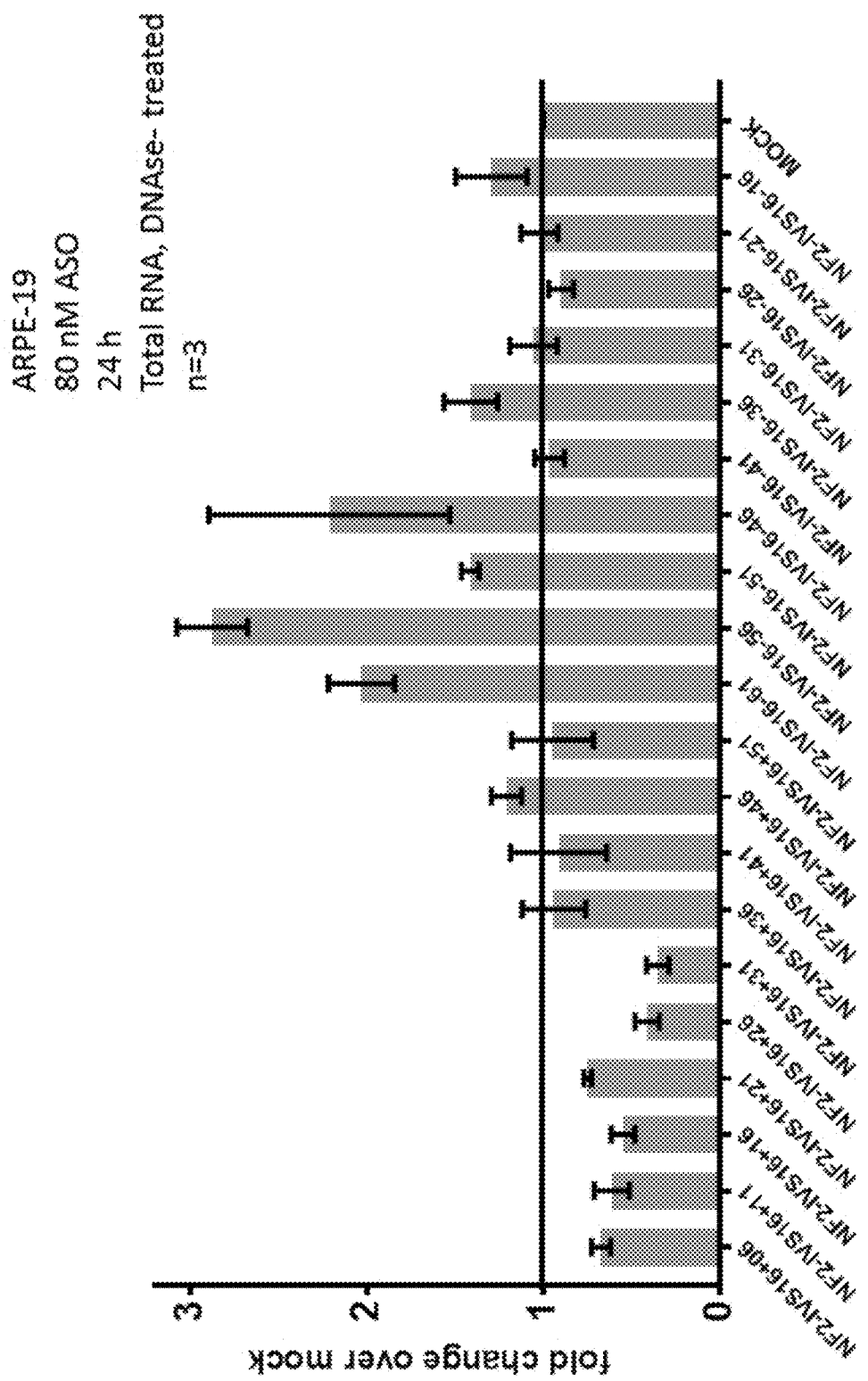
FIG. 76 depicts an exemplary graph showing the average (n=3) fold change in expression levels of NF2 mRNA without intron 16 in ARPE-19 cells treated for 24 hrs with 80 nM of the indicated ASOs over mock treated cells. Data is normalized to RPL32 expression.

FIG. 76 depicts an exemplary graph showing the average (n=3) fold change in expression levels of NF2 mRNA without intron 16 in ARPE-19 cells treated for 24 hrs with 80 nM of the indicated ASOs over mock treated cells. Data is normalized to RPL32 expression.

Figure 77:
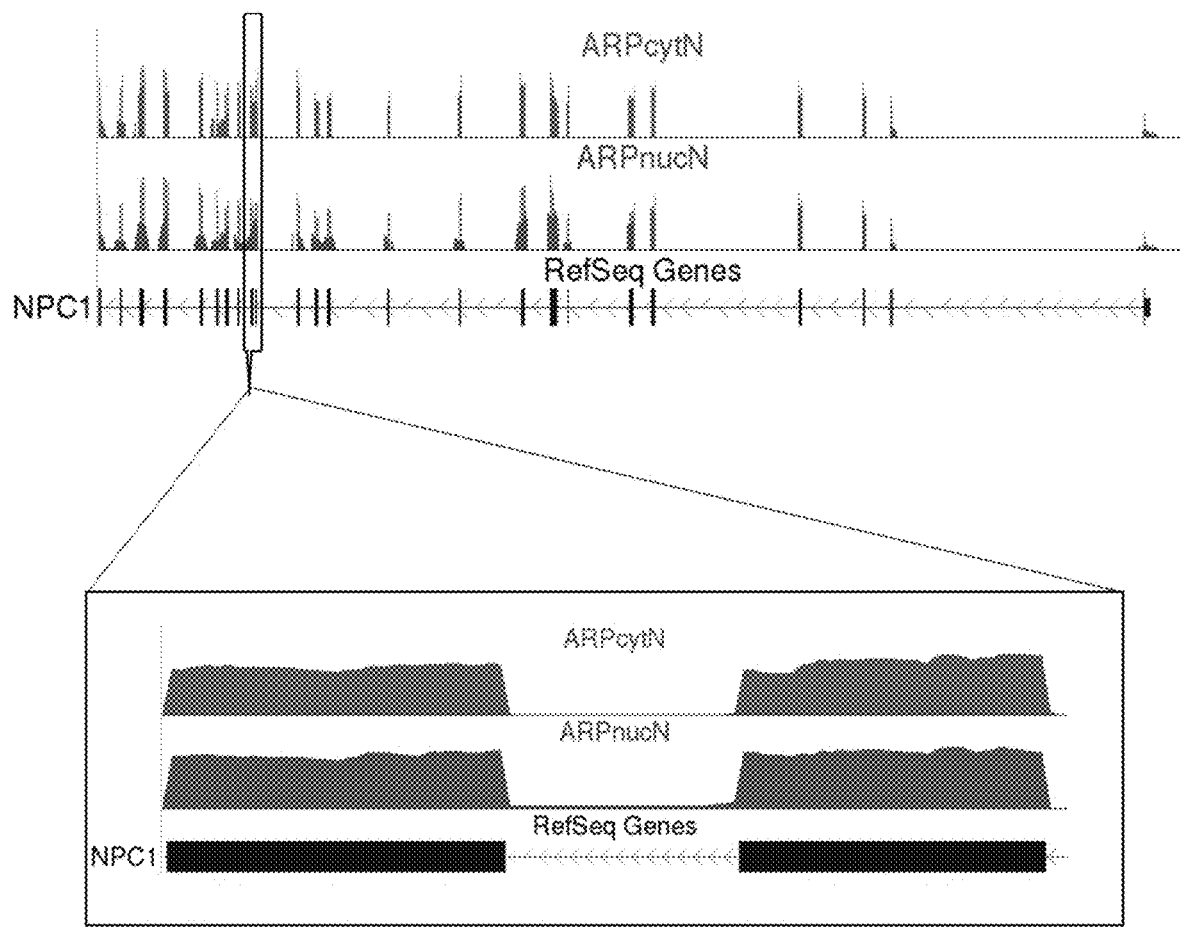
FIG. 77 depicts a schematic of the RefSeq Genes for NPC1 intron 15 corresponding to NM_000271. The Percent Intron Retention (PIR) of the circled intron is shown.

FIG. 77 depicts a schematic of the RefSeq Genes for NPC1 intron 15 corresponding to NM_000271. The Percent Intron Retention (PIR) of the circled intron is shown.

Figure 78:
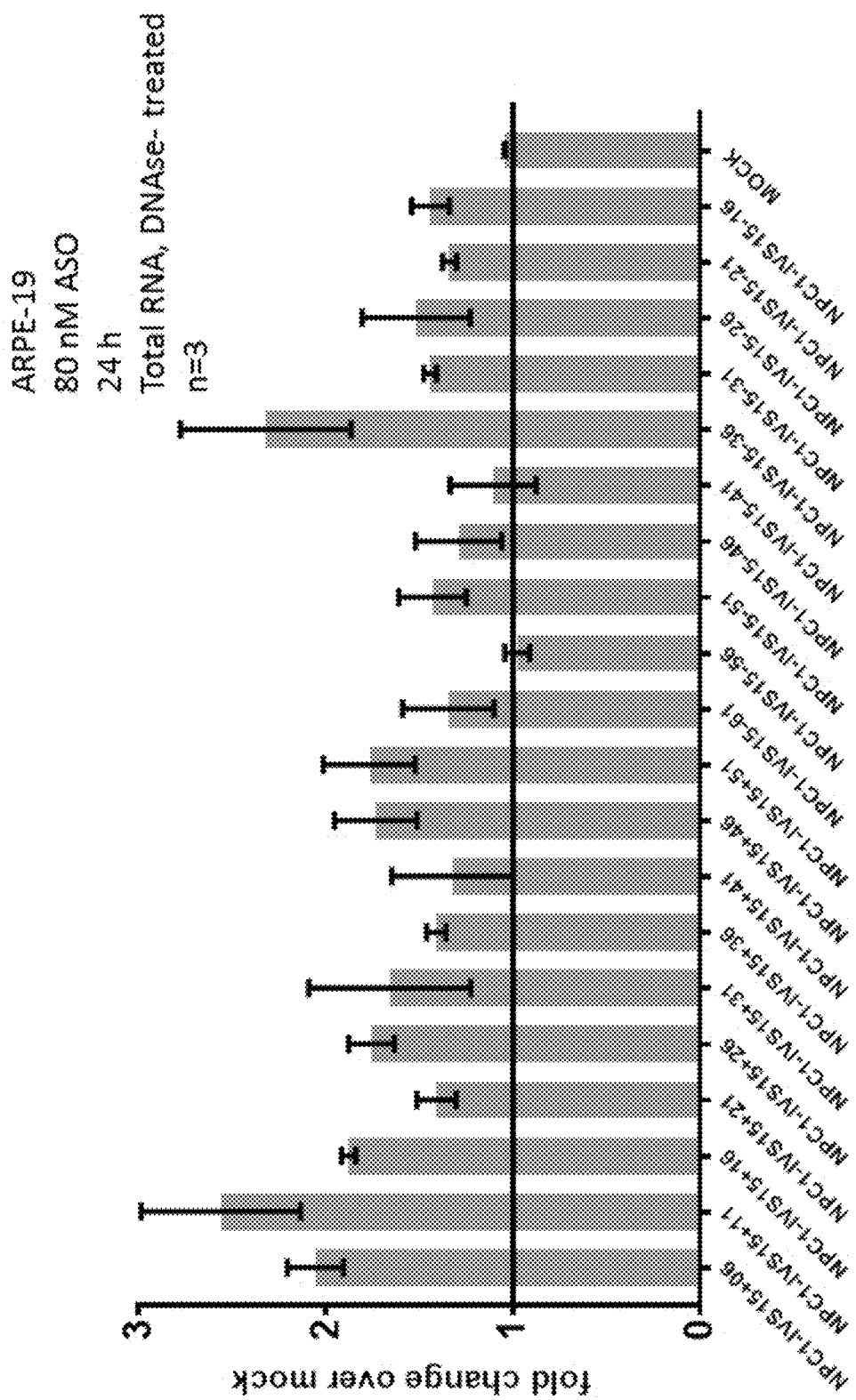
FIG. 78 depicts an exemplary graph showing the average (n=3) fold change in expression levels of NPC1 mRNA without intron 15 in ARPE-19 cells treated for 24 hrs with 80 nM of the indicated ASOs over mock treated cells. Data is normalized to RPL32 expression.

FIG. 78 depicts an exemplary graph showing the average (n=3) fold change in expression levels of NPC1 mRNA without intron 15 in ARPE-19 cells treated for 24 hrs with 80 nM of the indicated ASOs over mock treated cells. Data is normalized to RPL32 expression.

Figure 79:
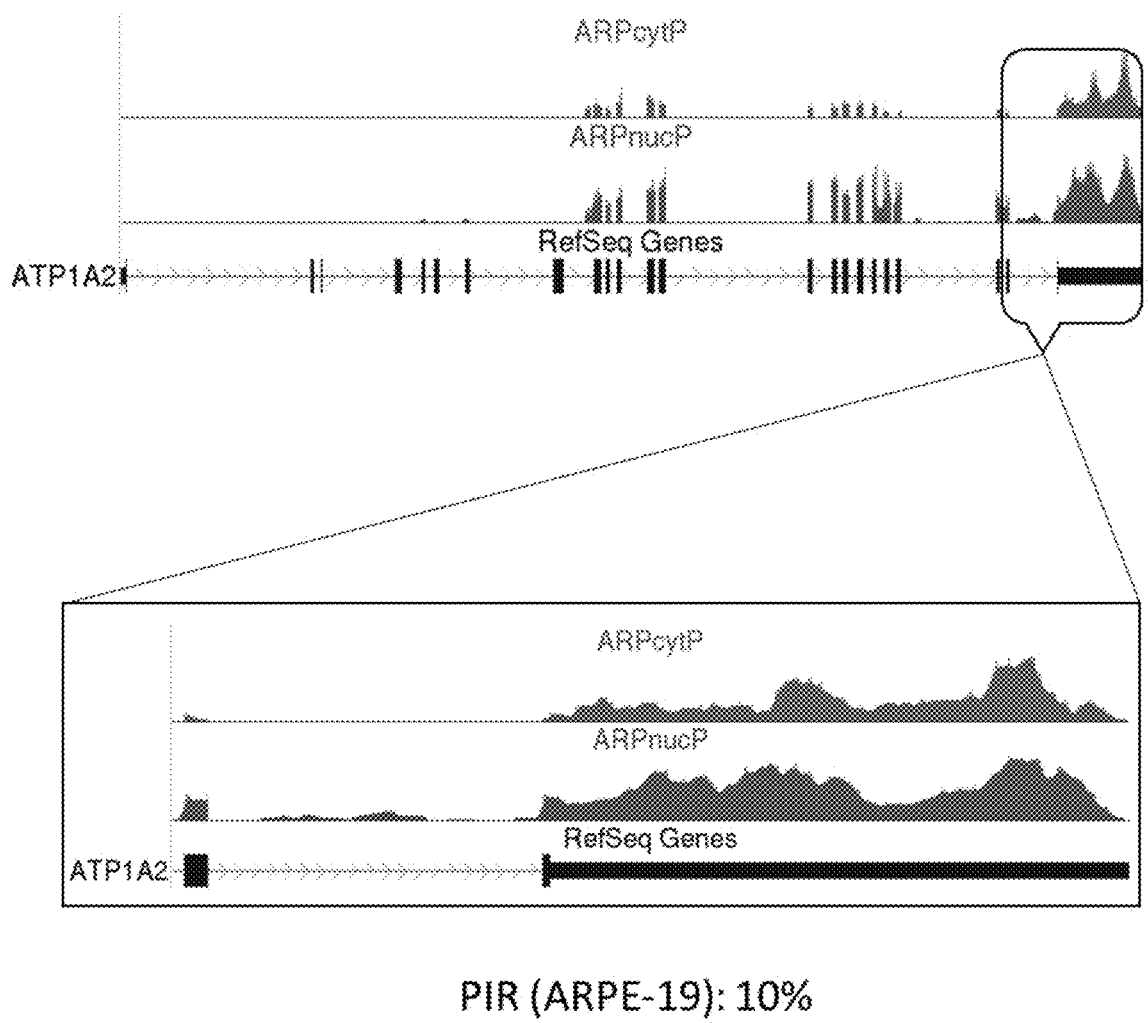
FIG. 79 depicts a schematic of the RefSeq Genes for ATP1A2 intron 22 corresponding to NM_000702. The Percent Intron Retention (PIR) of the circled intron is shown.

FIG. 79 depicts a schematic of the RefSeq Genes for ATP1A2 intron 22 corresponding to NM_000702. The Percent Intron Retention (PIR) of the circled intron is shown.

Figure 80:
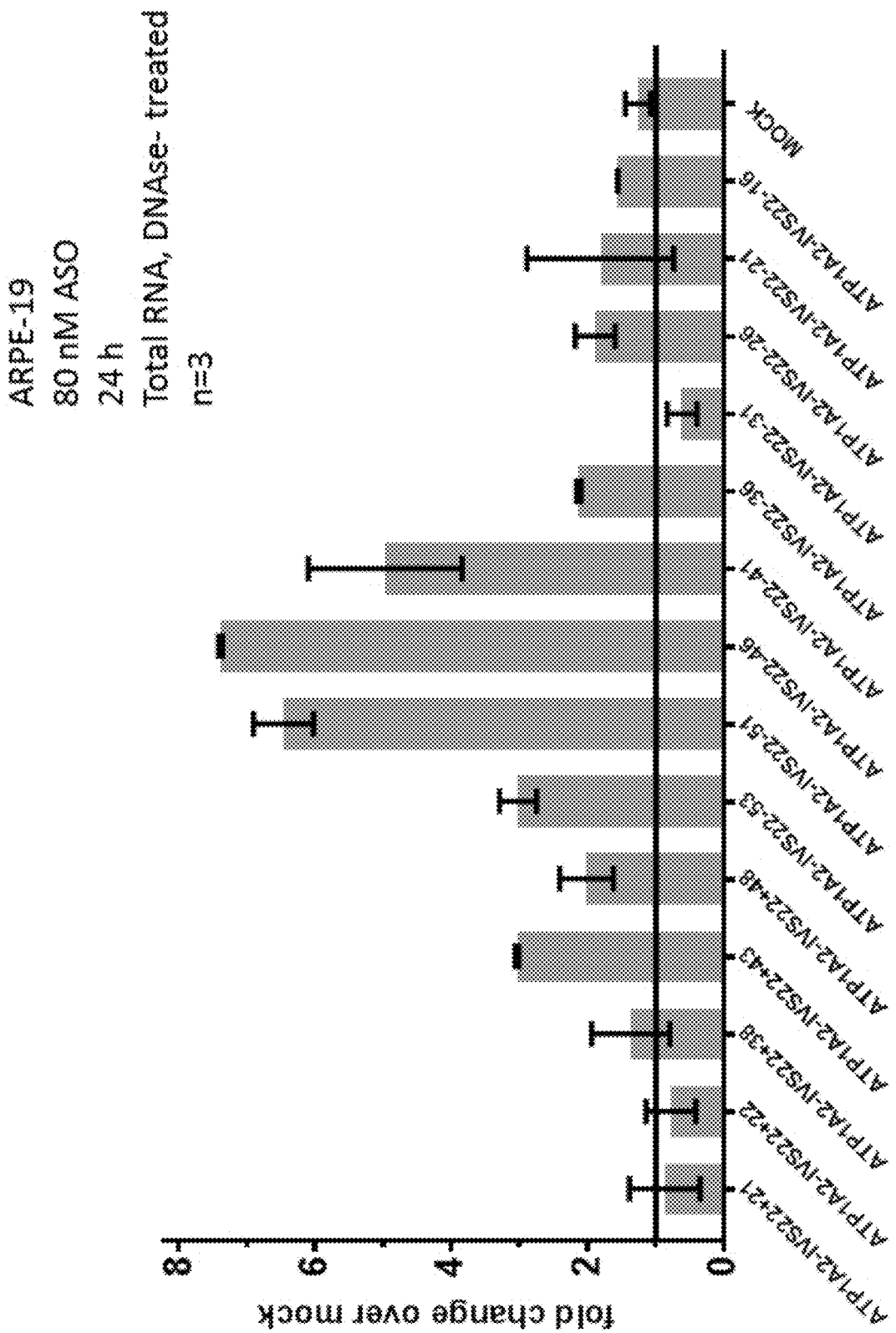
FIG. 80 depicts an exemplary graph showing the average (n=3) fold change in expression levels of ATP1A2 mRNA without intron 22 in ARPE-19 cells treated for 24 hrs with 80 nM of the indicated ASOs over mock treated cells. Data is normalized to RPL32 expression.

FIG. 80 depicts an exemplary graph showing the average (n=3) fold change in expression levels of ATP1A2 mRNA without intron 22 in ARPE-19 cells treated for 24 hrs with 80 nM of the indicated ASOs over mock treated cells. Data is normalized to RPL32 expression.

Figure 81:
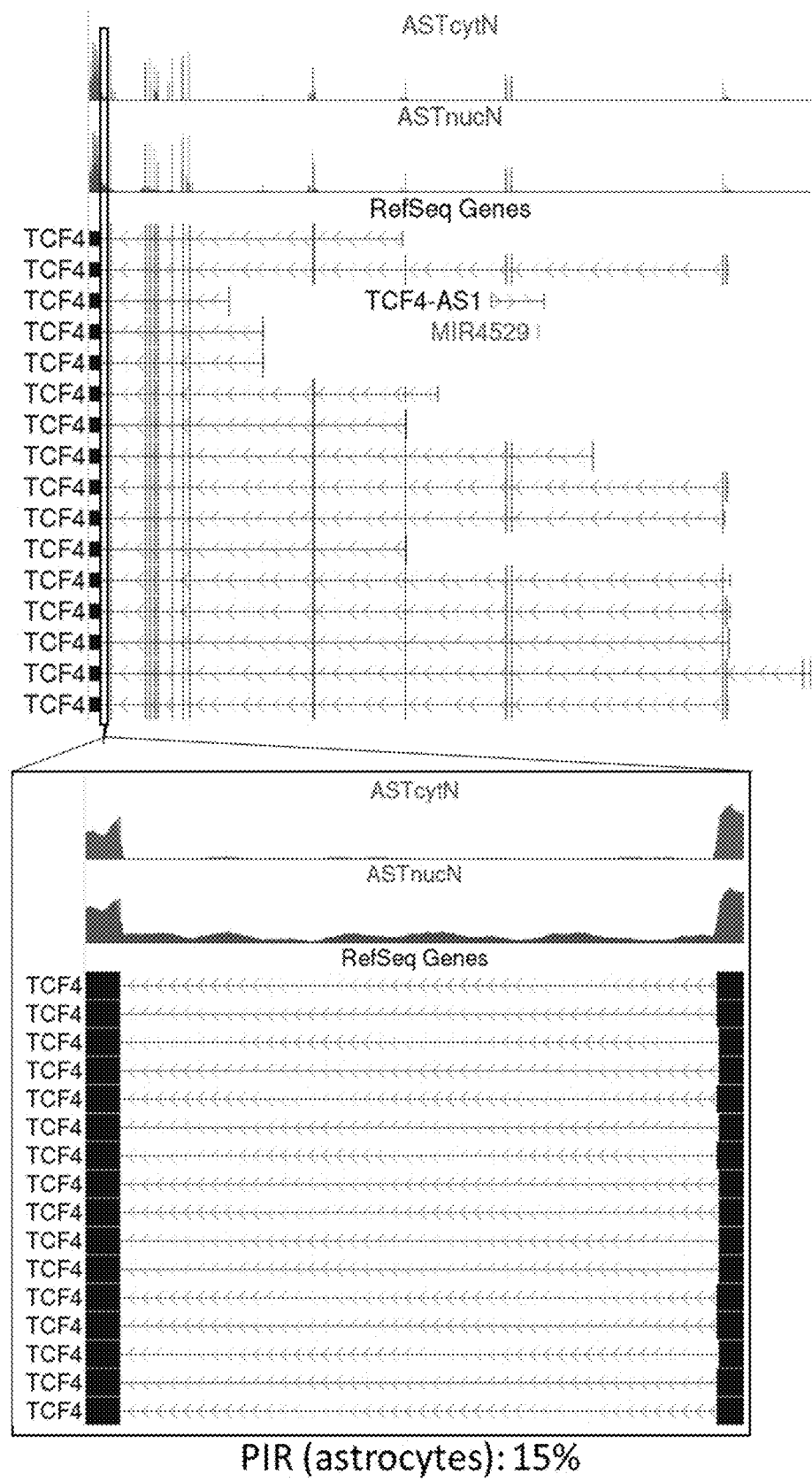
FIG. 81 depicts a schematic of the RefSeq Genes for TCF4 intron 18 corresponding to NM_001243226. The Percent Intron Retention (PIR) of the circled intron is shown.

FIG. 81 depicts a schematic of the RefSeq Genes for TCF4 intron 18 corresponding to NM_001243226. The Percent Intron Retention (PIR) of the circled intron is shown.

Table 8 illustrates percentage of retained intron with respect to the genes of interest.

TABLE 8

Retained Introns in Genes of Interest

| Gene Symbol | Gene ID | RNA Accession Number | Retained Intron (Percent Intron Retention) | Cells |
|---|---|---|---|---|
| ATP1A2 | 477 | NM_000702 | Intron 22 (14%) | HCN |
| CACNA1A | 773 | NM_023035 | Intron 37 (26%) | AST |
| | | | Intron 36 (56%) | |
| CACNA1A | 773 | NM_001127221 | Intron 36 (55%) | AST |
| SETD5 | 55209 | NM_001080517 | Intron 4 (42%) | HCN |
| SHANK3 | 85358 | NM_033517 | Intron 16 (7%) | AST |
| NF2 | 4771 | NM_181832 | Intron 16 (N/A) | HCN |
| DNMT1 | 1786 | NM_001379 | Intron 29 (13%) | HCN |
| TCF4 | 6925 | NM_003199 | Intron 17 (15%) | AST |
| TCF4 | 6925 | NM_001243228 | Intron 17 (29%) | AST |
| RAI1 | 10743 | NM_030665 | Intron 4 (13%) | AST |
| PEX1 | 5189 | NM_000466 | Intron 10 (25%) | HCN |
| | | | Intron 14 (19%) | |
| | | | Intron 19 (18%) | |
| | | | Intron 21 (14%) | |
| ARSA | 410 | NM_001085425 | Intron 3 (N/A) | HCN |
| | | | Intron 4 (N/A) | |
| EIF2B5 | 8893 | NM_003907 | Intron 12 (42%) | HCN |
| | | | Intron 13 (29%) | |
| EIF2B1 | 1967 | NM_001414 | Intron 6 (27%) | HCN |
| EIF2B2 | 8892 | NM_014239 | Intron 1 (9%) | HCN |
| NPC1 | 4864 | NM_000271 | Intron 15 (11%) | HCN |
| ADAR | 103 | NM_001111 | Intron 2 (12%) | AST |
| MFSD8 | 256471 | NM_152778 | Intron 12 (42%) | HCN |
| STXBP1 | 6812 | NM_001032221 | Intron 18 (N/A) | AST |
| PRICKLE2 | 166336 | NM_198859 | Intron 4 (19%) | AST |
| PRRT2 | 112476 | NM_145239 | Intron 1 (77%) | HCN |
| STX1B | 112755 | NM_052874 | Intron 6 (11%) | HCN, |
| | | | Intron 7 (12%) | AST |
| IDUA | 607015 | NM_000203 | Intron 3 (25%) | HCN |
| | | | Intron 4 (63%) | |
| | | | Intron 5 (16%) | |
| | | | Intron 6 (N/A) | |
| | | | Intron 7 (N/A) | |

Example 23: Identification of Intron Retention Events in ROM1, TEAD1, RDH5, PAX6, FSCN2, MYOC, TCF4, MFSD8, CTNS, OPTN, RLBP1, RPE65, LRAT, RDH8, RDH12, RGR, CNGA3, ALMS1, PER1 and IDUA Transcripts by RNAseq Using Next Generation Sequencing Whole transcriptome shotgun sequencing was carried out using next generation sequencing to reveal a snapshot of transcripts produced by the ROM1, TEAD1, RDH5, PAX6, FSCN2, TCF4, MFSD8, CTNS, OPTN, RLBP1, RPE65, LRAT, RDH8, RDH12, RGR, CNGA3, ALMS1, PER1 and IDUA gene to identify intron-retention events. For this purpose, polyA+ RNA from nuclear and cytoplasmic fractions of cells was isolated from cDNA libraries constructed using Illumina's TruSeq Stranded mRNA library Prep Kit. ARPE-19 cells or astrocytes were used for most analyses, and in certain cases (for RDH8 and RDH12) human retinal transcriptome data was used (Farkas, et al., 2013, "Transcriptome analyses of the human retina identify unprecedented transcript diversity and 3.5 Mb of novel transcribed sequence via significant alternative splicing and novel genes," BMC Genomics 14:486, incorporated herein by reference). The libraries were pair-end sequenced resulting in 100-nucleotide reads that can be mapped to the human genome. The mapped reads were visualized using the UCSC genome browser (operated by the UCSC Genome Informatics Group (Center for Biomolecular Science & Engineering, University of California, Santa Cruz, 1156 High Street, Santa Cruz, Calif. 95064) and described by, e.g., Rosenbloom, et al., 2015, "The UCSC Genome Browser database: 2015 update," Nucleic Acids Research 43, Database Issue, doi: 10.1093/nar/gku1177) and the coverage and number of reads were inferred by the peak signals. The height of the peaks indicates the level of expression given by the density of the reads in a particular region. A schematic representation of the gene (drawn to scale) was provided by the UCSC genome browser (below the read signals) so that peaks can be matched to the exonic and intronic regions. Based on this display, we identified introns that have high read density in the nuclear fraction of the cells, but have very low to no reads in the cytoplasmic fraction. This indicated that these introns were retained and that the intron-containing transcripts remain in the nucleus, and suggested that these retained RIC pre-mRNAs are non-productive, as they were not exported out to the cytoplasm.

Example 24: Identification of Intron Retention Events in CRX, ABCA4, MYOC, and NXNL1 Transcript by RNAseq Using Next Generation Sequencing Whole transcriptome shotgun sequencing was carried out using next generation sequencing to reveal a snapshot of transcripts produced by the CRX, ABCA4, MYOC, and NXNL1 genes described herein to identify intron-retention events. For this purpose, polyA+ RNA from nuclear and cytoplasmic fractions of THLE-3 (human liver epithelial) cells is isolated and cDNA libraries constructed using Illumina's TruSeq Stranded mRNA library Prep Kit. The libraries are pair-end sequenced resulting in 100-nucleotide reads that were mapped to the human genome. The mapped reads are visualized using the UCSC genome browser (operated by the UCSC Genome Informatics Group (Center for Biomolecular Science & Engineering, University of California, Santa Cruz, 1156 High Street, Santa Cruz, Calif. 95064) and described by, e.g., Rosenbloom, et al., 2015, "The UCSC Genome Browser database: 2015 update," Nucleic Acids Research 43, Database Issue, doi: 10.1093/nar/gku1177) and the coverage and number of reads were inferred by the peak signals. The height of the peaks indicates the level of expression given by the density of the reads in a particular region. A schematic representation of the gene is provided by the UCSC genome browser so that peaks can be matched to the exonic and intronic regions. Based on this display, we identify introns that have high read density in the nuclear fraction of THLE-3 cells, but have very low to no reads in the cytoplasmic fraction of these cells. This indicates that these introns are retained and that the intron-containing transcripts remain in the nucleus, and suggests that these retained RIC pre-mRNAs are non-productive, as they are not exported out to the cytoplasm.

Example 25: Design of ASO-Walk Targeting

An ASO walk was designed to target introns using the method described herein. A region immediately downstream of an intron 5' splice site, e.g., spanning nucleotides +6 to +69 and a region immediately upstream of the intron's 3' splice site, e.g., spanning nucleotides −16 to −68 of the intron was targeted with 2'-O-Me RNA, PS backbone, 18-mer ASOs shifted by 5-nucleotide intervals. Table 9 lists exemplary ASOs that were designed and their target sequences.

TABLE 9

| Gene SEQ ID NO. | Pre-mRNA SEQ ID NO. | ASOs SEQ ID NO. | Retained Intron | Target Sequence SEQ ID NO. |
|---|---|---|---|---|
| ABCA4 SEQ ID NO. 34790 | ABCA4: NM_000350 SEQ ID NO. 34813 | 34873-35104 | 40 | 61463 |
| | | 35105-35332 | 38 | 61495 |
| | | 35333-35563 | 36 | 61445 |
| | | 35564-35805 | 44 | 61470 |
| | | 35806-35915 | 39 | 61453 |
| RPE65 SEQ ID NO. 34791 | RPE65: NM_000329 SEQ ID NO. 34814 | 35916-36082 | 9 | 61480 |
| | | 36083-36317 | 10 | 61460 |
| MYOC SEQ ID NO. 34792 | MYOC: NM_000261 SEQ ID NO. 34815 | 36318-36644 | 1 | 61458 |
| | | 36645-37107 | 2 | 61485 |
| CNGA3 SEQ ID NO. 34793 | CNGA3: NM_001298 SEQ ID NO. 34816 | 37108-37333 | 6 | 61500 |
| | CNGA3: NM_001079878 SEQ ID NO. 34817 | 37334-37559 | 5 | 61500 |
| MFSD8 SEQ ID NO. 34794 | MFSD8: NM_152778 SEQ ID NO. 34818 | 37560-37641 | 11 | 61492 |
| | | 37642-38420 | 12 | 61497 |
| IDUA SEQ ID NO. 34795 | IDUA: NM_000203 SEQ ID NO. 34819 | 38421-38486 | 3 | 61457 |
| | | 38487-38602 | 4 | 61468 |
| | | 38603-38668 | 5 | 61489 |
| | | 38669-38741 | 6 | 61444 |
| | | 38742-38826 | 7 | 61452 |
| | IDUA: NR_110313 SEQ ID NO. 34820 | 38827-38892 | 3 | 61457 |
| | | 38893-39008 | 4 | 61468 |
| | | 39009-39074 | 5 | 61489 |
| | | 39075-39147 | 6 | 61444 |
| | | 39148-39232 | 7 | 61452 |
| LRAT SEQ ID NO. 34796 | LRAT: NM_001301645 SEQ ID NO. 34821 | 39233-40334 | 2 | 61474 |
| | LRAT: NM_004744 SEQ ID NO. 34822 | 40335-41436 | 2 | 61474 |
| OPTN SEQ ID NO 34797 | OPTN: NM_001008211 SEQ ID NO. 34823 | 41437-41669 | 9 | 61503 |
| | OPTN: NM_001008212 SEQ ID NO. 34824 | 41670-41902 | 8 | 61503 |
| | OPTN: NM_001008213 SEQ ID NO. 34825 | 41903-42135 | 9 | 61503 |
| | OPTN: NM_021980 SEQ ID NO. 34826 | 42136-42368 | 7 | 61503 |
| RGR SEQ ID NO. 34798 | RGR: NM_002921 SEQ ID No. 34827 | 42369-42595 | 1 | 61446 |
| | | 42596-42829 | 2 | 61476 |
| | RGR: NM_001012722 SEQ ID NO. 34828 | 42830-43056 | 1 | 61446 |
| | | 43057-43288 | 2 | 61472 |
| | RGR: NM_001012720 SEQ ID NO. 34829 | 43289-43515 | 1 | 61446 |
| | | 43516-43747 | 2 | 61472 |
| TEAD1 SEQ ID NO. 34799 | TEAD1: NM_021961 SEQ ID NO. 34830 | 43748-43952 | 4 | 61461 |
| PAX6 SEQ ID NO. 34800 | PAX6: NM_001310160 SEQ ID NO. 34831 | 43953-44085 | 2 | 61486 |
| | | 44086-44296 | 3 | 61466 |
| | PAX6: NM_001310161 SEQ ID NO. 34832 | 44297-44563 | 1 | 61496 |
| | | 44564-44630 | 3 | 61467 |
| | | 44631-44841 | 4 | 61502 |
| | PAX6: NM_001258465 SEQ ID NO. 34833 | 44842-45041 | 3 | 61483 |
| | | 45042-45273 | 4 | 61448 |
| | | 45274-45484 | 5 | 61502 |
| | PAX6: NM_000280 SEQ ID NO. 34834 | 45485-45684 | 4 | 61483 |
| | | 45685-45916 | 5 | 61448 |
| | | 45917-46127 | 6 | 61502 |

TABLE 9-continued

| Gene SEQ ID NO. | Pre-mRNA SEQ ID NO. | ASOs SEQ ID NO. | Retained Intron | Target Sequence SEQ ID NO. |
|---|---|---|---|---|
| | PAX6: NM_001258464 SEQ ID NO. 34835 | 46128-46327 | 4 | 61483 |
| | | 46328-46559 | 5 | 61448 |
| | | 46560-46770 | 6 | 61502 |
| | PAX6: NM_001604 SEQ ID NO. 34836 | 46771-46970 | 4 | 61483 |
| | | 46971-47037 | 6 | 61467 |
| | | 47038-47248 | 7 | 61502 |
| | PAX6: NM_001127612 SEQ ID NO. 34837 | 47249-47448 | 4 | 61483 |
| | | 47449-47680 | 5 | 61448 |
| | | 47681-47891 | 6 | 61502 |
| | PAX6: NM_001258462 SEQ ID NO. 34838 | 47892-48091 | 4 | 61483 |
| | | 48092-48158 | 6 | 61467 |
| | | 48159-48369 | 7 | 61502 |
| | PAX6: NM_001310159 SEQ ID NO. 34839 | 48370-48569 | 2 | 61483 |
| | | 48570-48801 | 3 | 61448 |
| | | 48802-49012 | 4 | 61502 |
| | PAX6: NM_001310158 SEQ ID NO. 34840 | 49013-49212 | 4 | 61483 |
| | | 49213-49279 | 6 | 61467 |
| | | 49280-49490 | 7 | 61502 |
| | PAX6: NM_001258463 SEQ ID NO. 34841 | 49491-49690 | 4 | 61483 |
| | | 49691-49757 | 6 | 61467 |
| | | 49758-49968 | 7 | 61502 |
| ROM1 SEQ ID NO. 34801 | ROM1: NM_000327 SEQ ID NO. 34842 | 49969-50275 | 1 | 26665 |
| RDH5 SEQ ID NO. 34802 | RDH5: NM_002905 SEQ ID NO. 34843 | 50276-50489 | 1 | 26704 |
| | | 50490-50633 | 2 | 26666 |
| | RDH5: NM_001199771 SEQ ID NO. 34844 | 50634-50846 | 1 | 26709 |
| | | 50847-50991 | 2 | 26684 |
| RDH12 SEQ ID NO. 34803 | RDH12: NM_152443 SEQ ID NO. 34845 | 50992-51247 | 7 | 26693 |
| NR2E3 SEQ ID NO. 34804 | NR2E3: NM_014249 SEQ ID NO. 34846 | 51248-51450 | 1 | 26702 |
| | | 51451-51061 | 2 | 26660 |
| | | 51517-51587 | 3 | 26705 |
| | | 51588-51679 | 4 | 26698 |
| | | 51680-51916 | 5 | 26658 |
| | | 51917-51958 | 6 | 26676 |
| | | 51959-52043 | 7 | 26712 |
| | NR2E3: NM_016346 SEQ ID NO. 34847 | 52044-52246 | 1 | 26702 |
| | | 52247-52312 | 2 | 26660 |
| | | 52313-52383 | 3 | 26705 |
| | | 52384-52475 | 4 | 26698 |
| | | 52476-52712 | 5 | 26658 |
| | | 52713-52754 | 6 | 26676 |
| | | 52755-52998 | 7 | 26701 |
| RLBP1 SEQ ID NO. 34805 | RLBP1: NM_000326 SEQ ID NO. 34848 | 52999-53172 | 2 | 26673 |
| | | 53173-53427 | 5 | 26667 |
| CTNS SEQ ID NO. 34806 | CTNS: NM_004937 SEQ ID NO. 34849 | 53428-53650 | 9 | 26690 |
| | | 53651-53875 | 10 | 26692 |
| | CTNS: NM_001031681 SEQ ID NO. 34850 | 53876-54098 | 9 | 26690 |
| | | 54099-54323 | 10 | 26692 |
| PER1 SEQ ID NO. 34807 | PER1: NM_002616 SEQ ID NO. 34851 | 54324-54571 | 1 | 26682 |
| | | 54572-54634 | 14 | 26710 |
| FSCN2 SEQ ID NO. 34808 | FSCN2: NM_012418 SEQ ID NO. 34852 | 54635-55021 | 1 | 26670 |
| | | 55022-55136 | 3 | 26662 |
| | FSCN2: NM_001077182 SEQ ID NO. 34853 | 55137-55523 | 1 | 26670 |
| | | 55524-55638 | 3 | 26661 |
| TCF4 SEQ ID NO. 34809 | TCF4: NM_001243236 SEQ ID NO. 34854 | 55639-55880 | 9 | 26688 |
| | TCF4: NM_001243235 SEQ ID NO. 34855 | 55881-56122 | 9 | 26688 |
| | TCF4: NM_001243234 SEQ ID NO. 34856 | 56123-56366 | 9 | 26689 |
| | TCF4: NM_001243233 SEQ ID NO. 34857 | 56367-56608 | 12 | 26688 |
| | TCF4: NM_001243232 SEQ ID NO. 34858 | 56609-56852 | 12 | 26689 |
| | TCF4: NM_001243231 SEQ ID NO. 34859 | 56853-57094 | 14 | 26688 |
| | TCF4: NM_003199 SEQ ID NO. 34860 | 57095-57336 | 16 | 26688 |
| | TCF4: NM_001306207 SEQ ID NO. 34861 | 57337-57578 | 15 | 26688 |
| | TCF4: NM_001306208 SEQ ID NO. 34862 | 57579-57820 | 12 | 26688 |

TABLE 9-continued

| Gene SEQ ID NO. | Pre-mRNA SEQ ID NO. | ASOs SEQ ID NO. | Retained Intron | Target Sequence SEQ ID NO. |
|---|---|---|---|---|
| | TCF4: NM_001243227 SEQ ID NO. 34863 | 57821-58064 | 15 | 26689 |
| | TCF4: NM_001243228 SEQ ID NO. 34864 | 58065-58308 | 16 | 26689 |
| | TCF4: NM_001243230 SEQ ID NO. 34865 | 58309-58550 | 15 | 26688 |
| | TCF4: NM_001243226 SEQ ID NO. 34866 | 58551-58794 | 17 | 26689 |
| | TCF4: NM_001083962 SEQ ID NO. 34867 | 58795-59038 | 16 | 26689 |
| | TCF4: NM_001330605 SEQ ID NO. 34868 | 59039-59282 | 11 | 26689 |
| | TCF4: NM_001330604 SEQ ID NO. 34869 | 59283-59526 | 16 | 26689 |
| RDH8 SEQ ID NO. 34810 | RDH8: NM_015725 SEQ ID NO. 34870 | 59527-59662 | 4 | 26680 |
| NXNL1 SEQ ID NO. 34811 | NXNL1: NM_138454 SEQ ID NO. 34871 | 59663-60020 | 1 | 26699 |
| CRX SEQ ID NO. 34812 | CRX: NM_000554 SEQ ID NO. 34872 | 60021-60254 | 1 | 26675 |
| | | 60255-60484 | 2 | 26695 |
| | | 60485-61443 | 3 | 26686 |

Figure 82:
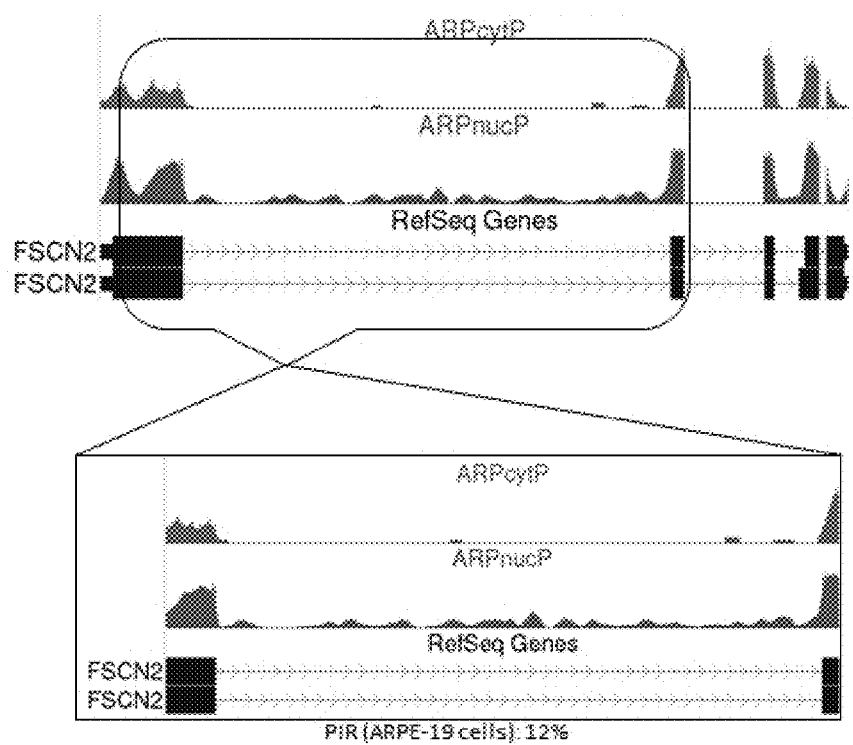
FIG. 82 depicts a schematic of the RefSeq Genes for FSCN2 corresponding to NM_012418 and NM_001077182. The Percent Intron Retention (PIR) of the circled intron is shown.
Figure 83:
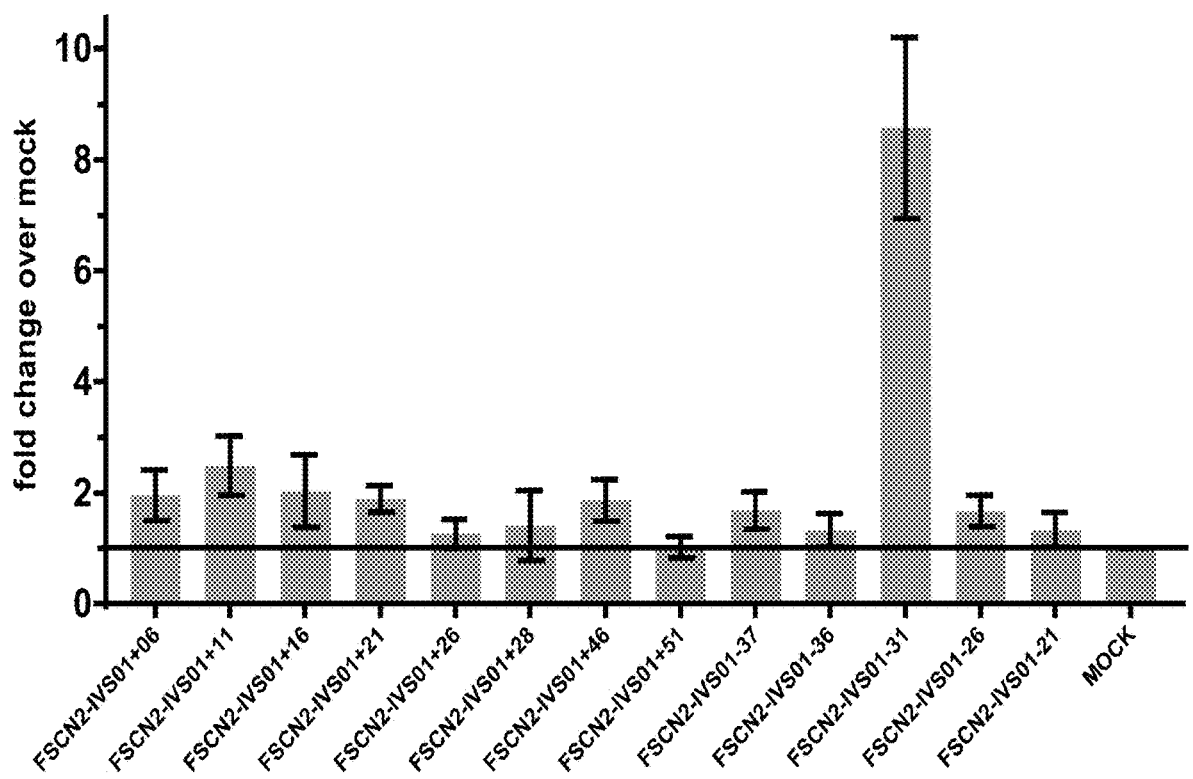
FIG. 83 depicts an exemplary graph showing the fold change in expression levels of FSCN2 mRNA without intron 1 in ARPE-19 cells treated for 24 hrs with 80 nM of the indicated ASOs over mock treated cells. Data is normalized to RPL32 expression.
Figure 84:
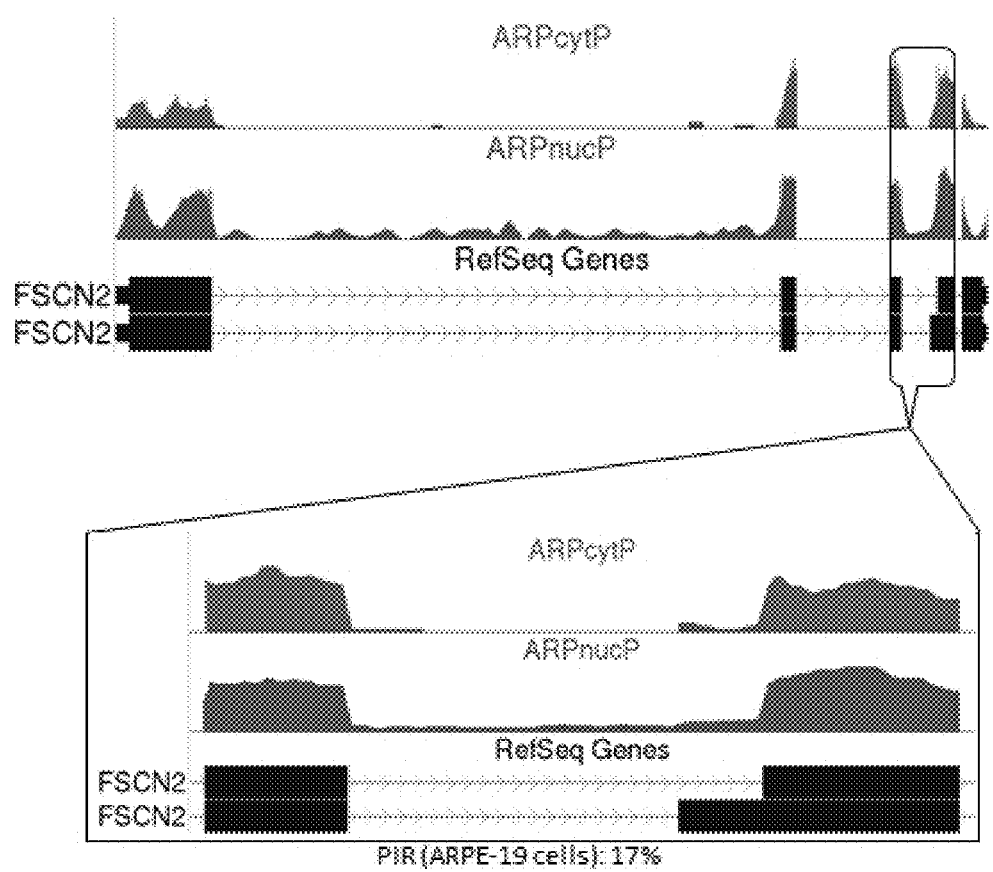
FIG. 84 depicts a schematic of the RefSeq Genes for FSCN2 corresponding to NM_012418 and NM_001077182. The Percent Intron Retention (PIR) of the circled intron is shown.
Figure 85:
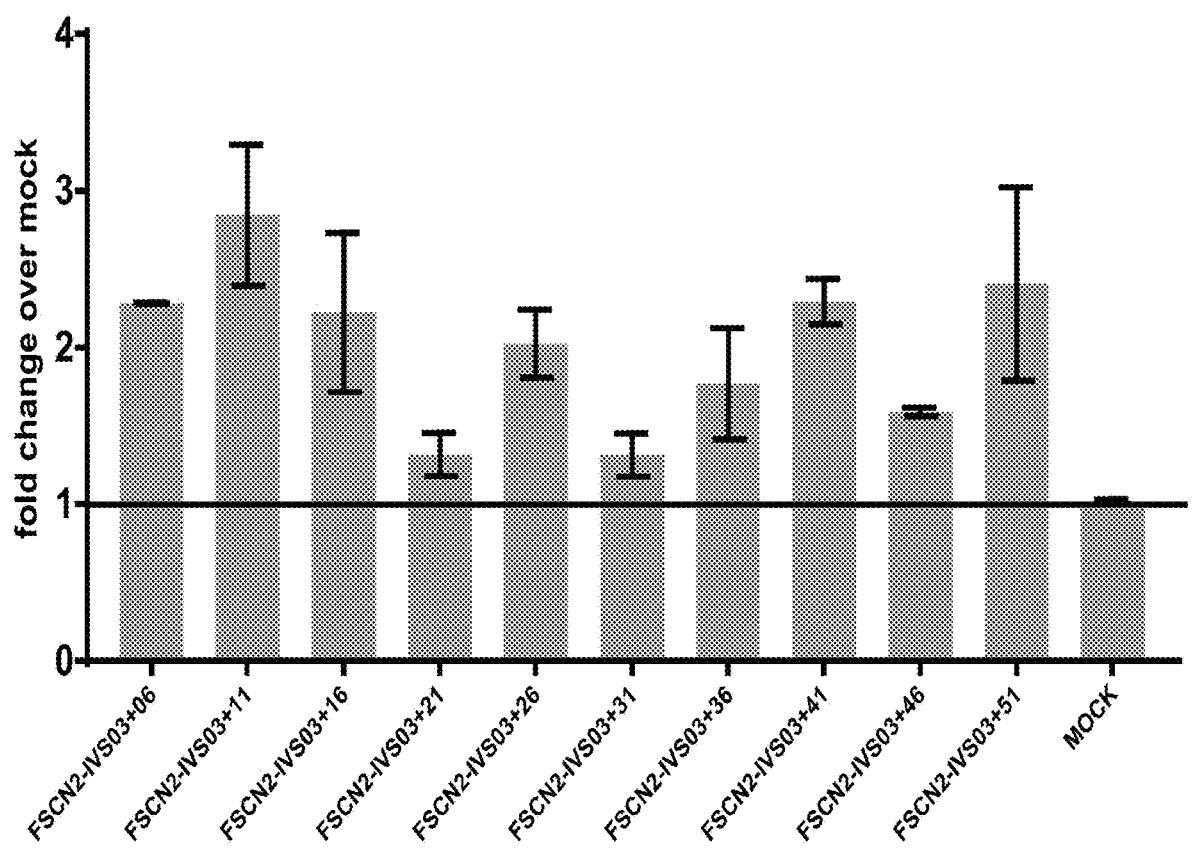
FIG. 85 depicts an exemplary graph showing the fold change in expression levels of FSCN2 mRNA without intron 3 in ARPE-19 cells treated for 24 hrs with 80 nM of the indicated ASOs over mock treated cells. Data is normalized to RPL32 expression.
Figure 86:
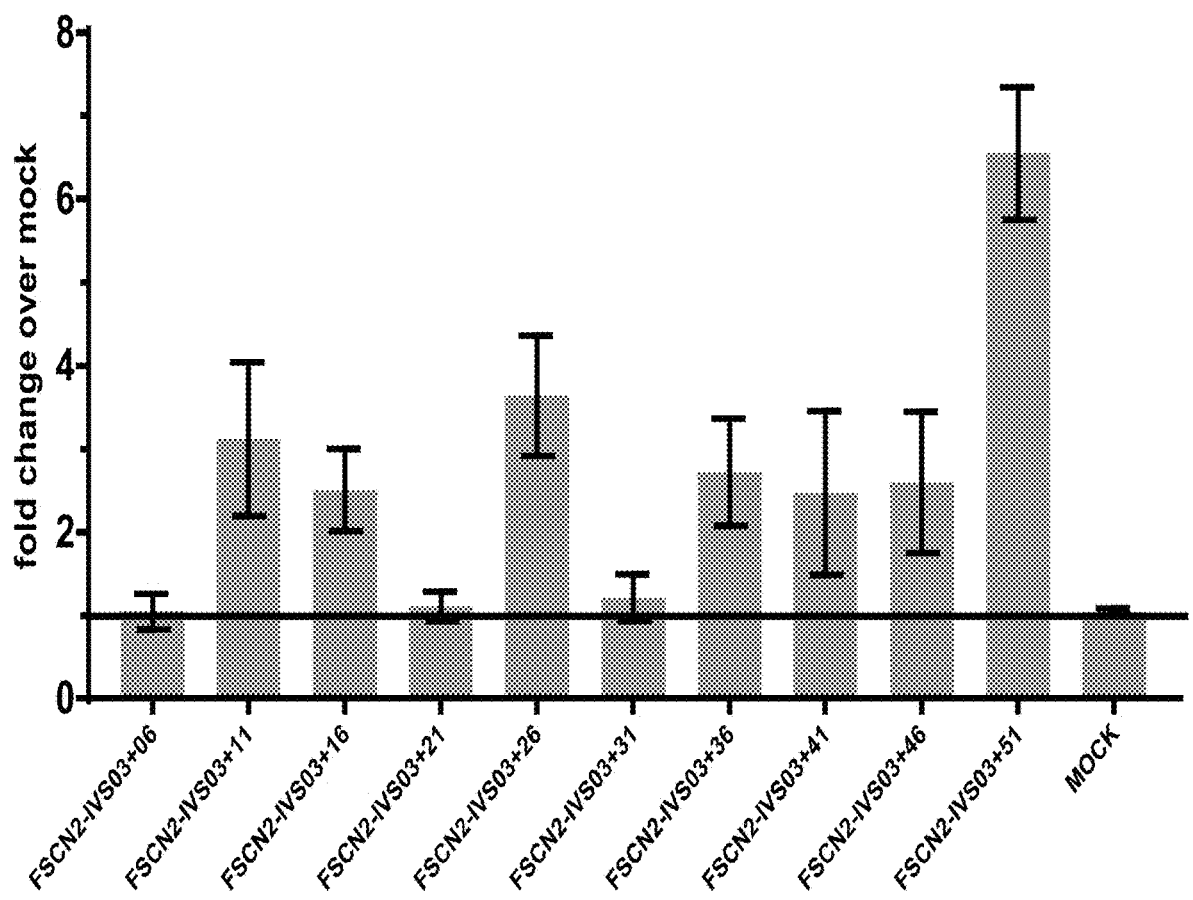
FIG. 86 depicts an exemplary graph showing the fold change in expression levels of FSCN2 mRNA without intron 3 in ARPE-19 cells treated for 24 hrs with 80 nM of the indicated ASOs over mock treated cells. Data is normalized to RPL32 expression.
Figure 87:
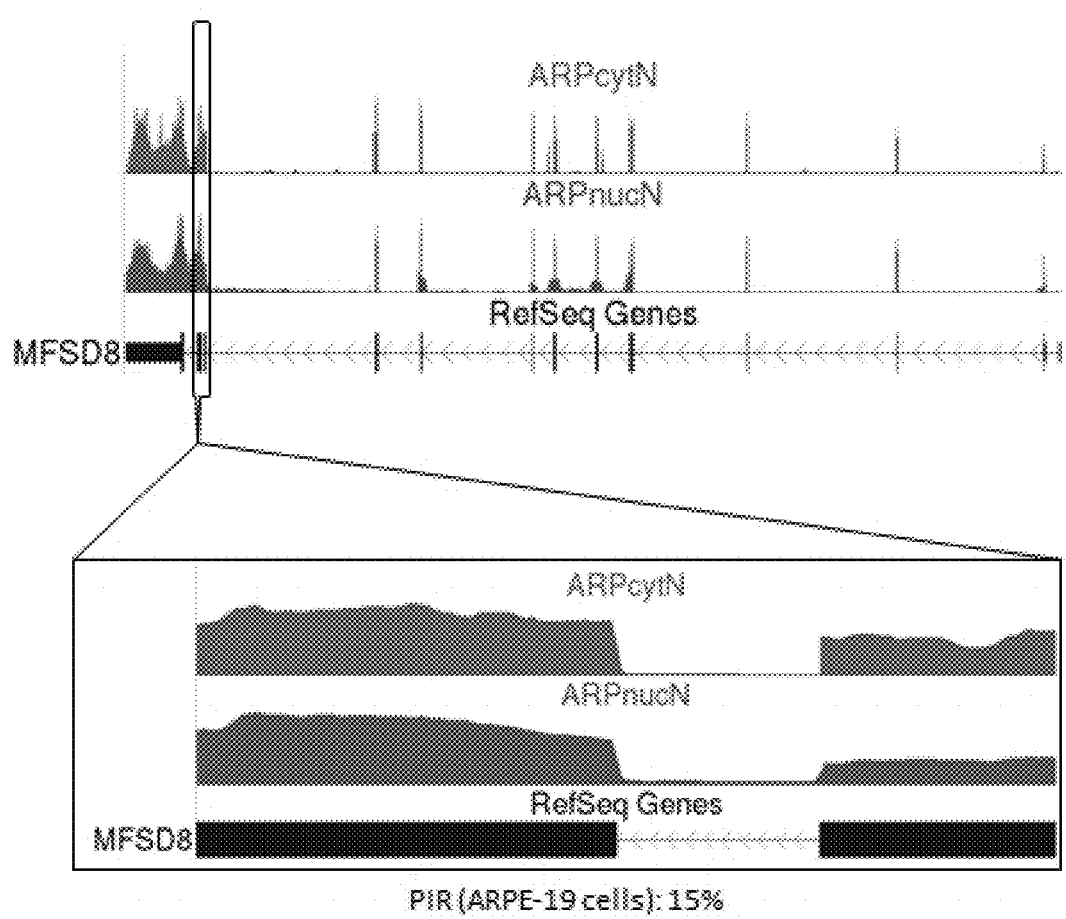
FIG. 87 depicts a schematic of the RefSeq Genes for MFSD8 corresponding to NM_152778. The Percent Intron Retention (PIR) of the circled intron is shown.

Example 26: Improved Splicing Efficiency Via ASO-Targeting of a Retained Intron Increases FSCN2 Transcript Levels To determine an increase in target gene intron splicing efficiency with ASOs we used the method described herein. ARPE-19 cells, a human retinal epithelium cell line (American Type Culture Collection (ATCC), USA) were mock-transfected, or transfected with the targeting ASOs described in Table 9. Cells were transfected using Lipofectamine RNAiMax transfection reagent (Thermo Fisher) according to vendor's specifications. Briefly, ASOs were plated in 96-well tissue culture plates and combined with RNAiMax diluted in Opti-MEM. Cells were detached using trypsin and resuspended in full medium, and approximately 25,000 cells were added the ASO-transfection mixture. Transfection experiments were carried out in triplicate plate replicates. Final ASO concentration was 80 nM. Media was changed 6h post-transfection, and cells harvested at 24h, using the Cells-to-Ct lysis reagent, supplemented with DNAse (Thermo Fisher), according to vendor's specifications. cDNA was generated with Cells-to-Ct RT reagents (Thermo Fisher) according to vendor's specifications. To quantify the amount of splicing at the intron of interest, quantitative PCR was carried out using Taqman assays with probes spanning the corresponding exon-exon junction (Thermo Fisher). Taqman assays were carried out according to vendor's specifications, on a QuantStudio 7 Flex Real-Time PCR system (Thermo Fisher). Target gene assay values were normalized to RPL32 (deltaCt) and plate-matched mock transfected samples (delta-delta Ct), generating fold-change over mock quantitation (2^-(delta-deltaCt). Average fold-change over mock of the three plate replicates is plotted (FIG. 83, FIG. 85, and FIG. 86). Several ASOs were identified that increased the target gene expression, as shown in FIG. 83, FIG. 85, and FIG. 86, implying an increase in splicing at that target intron. Together with whole transcriptome data confirming retention of the target intron (FIG. 82 and FIG. 84), these results confirm that ASOs can improve the splicing efficiency of a rate limiting intron.

Figure 88:
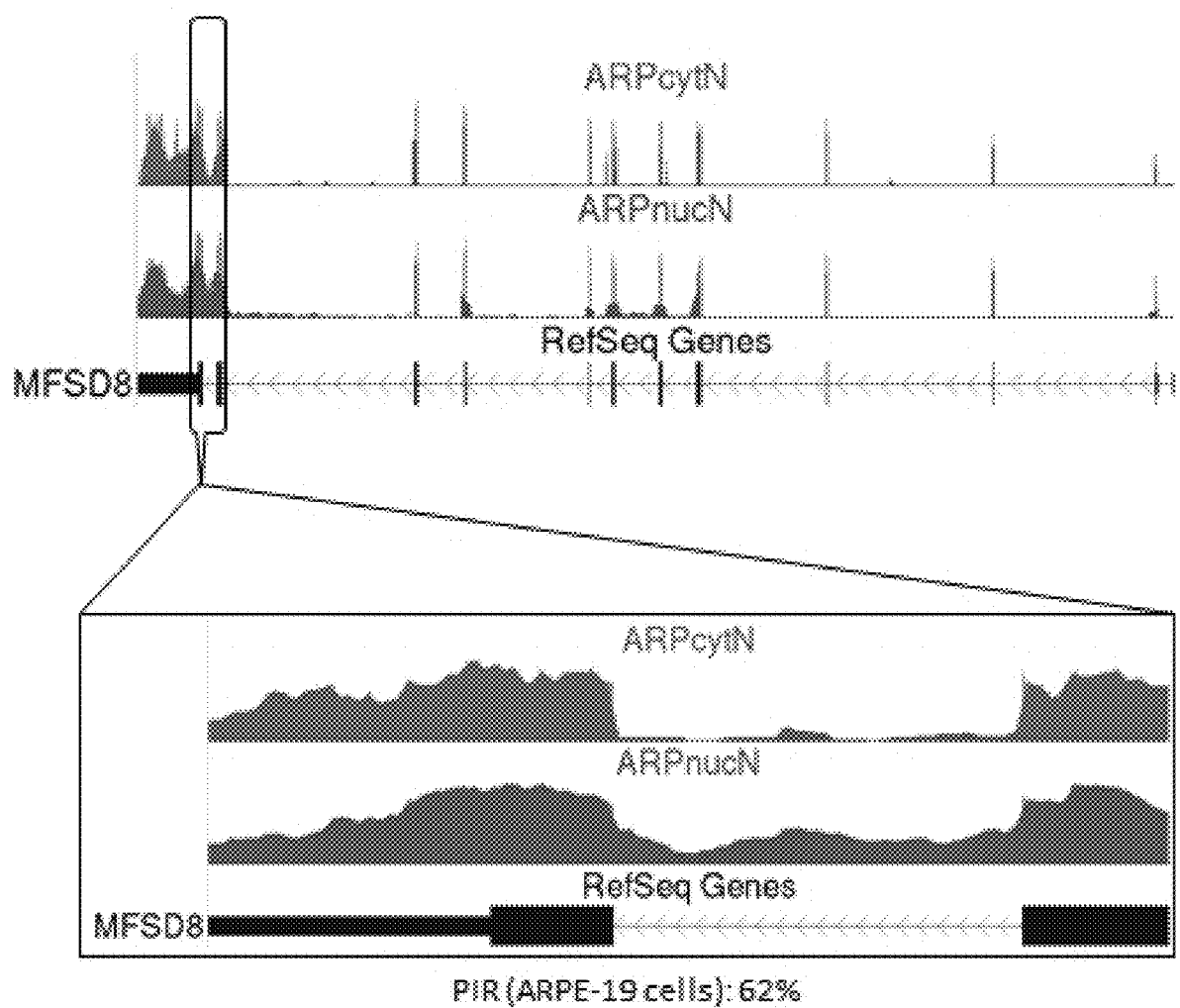
FIG. 88 depicts a schematic of the RefSeq Genes for MFSD8 corresponding to NM_152778. The Percent Intron Retention (PIR) of the circled intron is shown.
Figure 89:
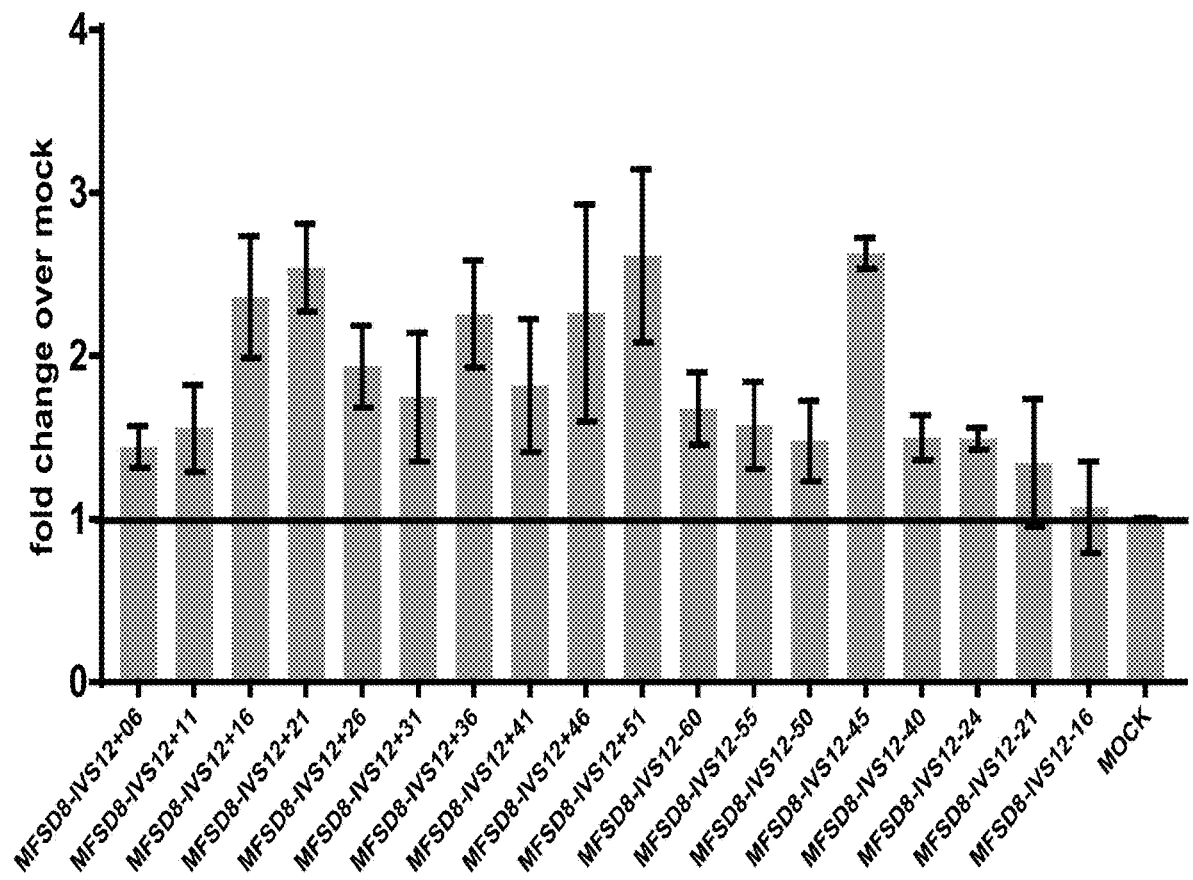
FIG. 89 depicts an exemplary graph showing the fold change in expression levels of MFSD8 mRNA without intron 12 in ARPE-19 cells treated for 24 hrs with 80 nM of the indicated ASOs over mock treated cells. Data is normalized to RPL32 expression.

Example 27: Improved Splicing Efficiency Via ASO-Targeting of a Retained Intron Increases MFSD8 Transcript Levels To determine an increase in target gene intron splicing efficiency with ASOs we used the method described herein. ARPE-19 cells, a human retinal epithelium cell line (American Type Culture Collection (ATCC), USA) were mock-transfected, or transfected with the targeting ASOs described in Table 9. Cells were transfected using Lipofectamine RNAiMax transfection reagent (Thermo Fisher) according to vendor's specifications. Briefly, ASOs were plated in 96-well tissue culture plates and combined with RNAiMax diluted in Opti-MEM. Cells were detached using trypsin and resuspended in full medium, and approximately 25,000 cells were added the ASO-transfection mixture. Transfection experiments were carried out in triplicate plate replicates. Final ASO concentration was 80 nM. Media was changed 6h post-transfection, and cells harvested at 24h, using the Cells-to-Ct lysis reagent, supplemented with DNAse (Thermo Fisher), according to vendor's specifications. cDNA was generated with Cells-to-Ct RT reagents (Thermo Fisher) according to vendor's specifications. To quantify the amount of splicing at the intron of interest, quantitative PCR was carried out using Taqman assays with probes spanning the corresponding exon-exon junction (Thermo Fisher). Taqman assays were carried out according to vendor's specifications, on a QuantStudio 7 Flex Real-Time PCR system (Thermo Fisher). Target gene assay values were normalized to RPL32 (deltaCt) and plate-matched mock transfected samples (delta-delta Ct), generating fold-change over mock quantitation (2^-(delta-deltaCt). Average fold-change over mock of the three plate replicates is plotted (FIG. 89). Several ASOs were identified that increased the target gene expression, as shown in FIG. 89, implying an increase in splicing at that target intron. Together with whole transcriptome data confirming retention of the target intron (FIG. 86 and FIG. 88), these results confirm that ASOs can improve the splicing efficiency of a rate limiting intron.

Figure 90:
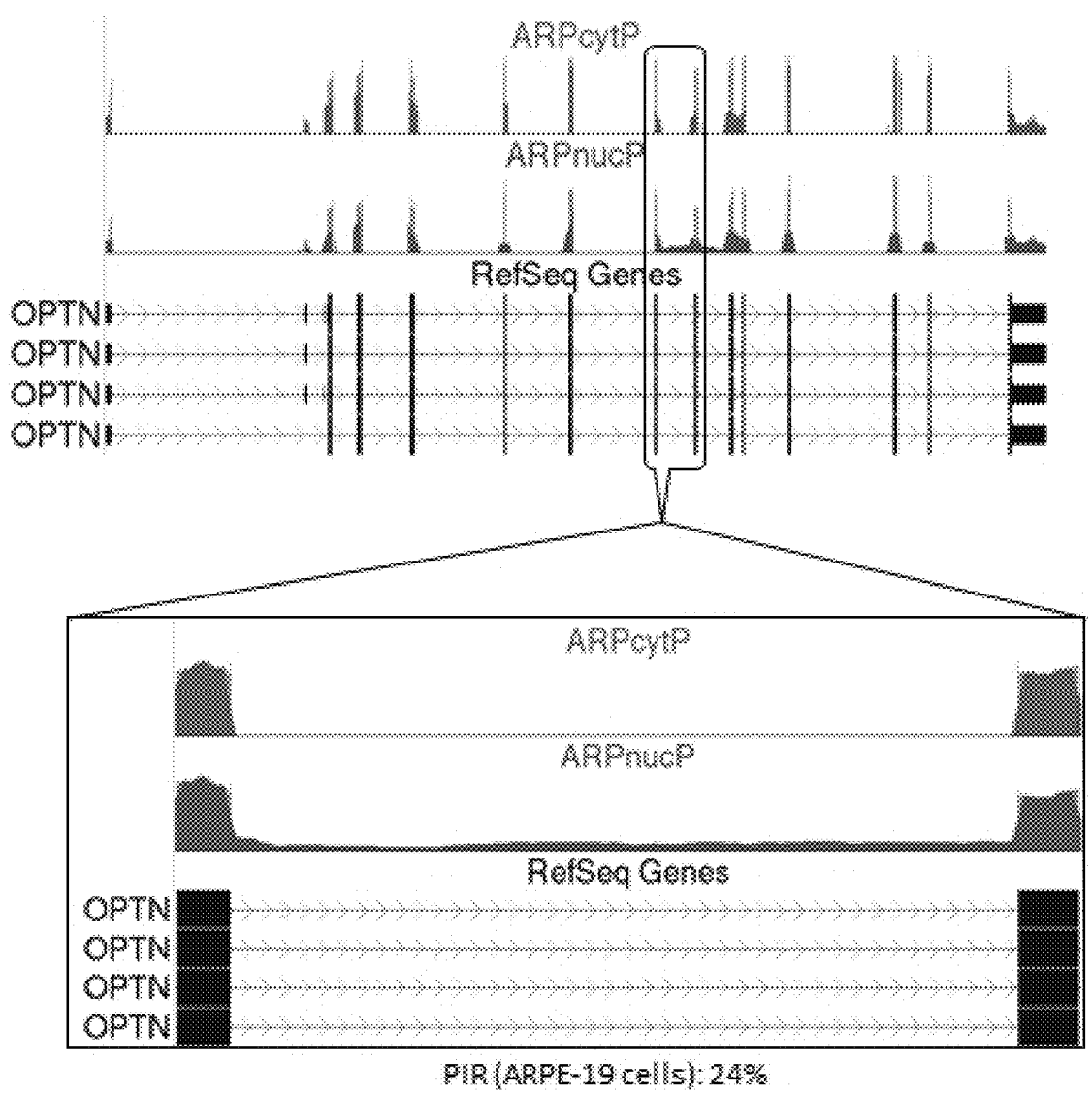
FIG. 90 depicts a schematic of the RefSeq Genes for OPTN corresponding to NM_001008211, NM_00100212, NM_001008213, and NM_021980. The Percent Intron Retention (PIR) of the circled intron is shown.
Figure 91:
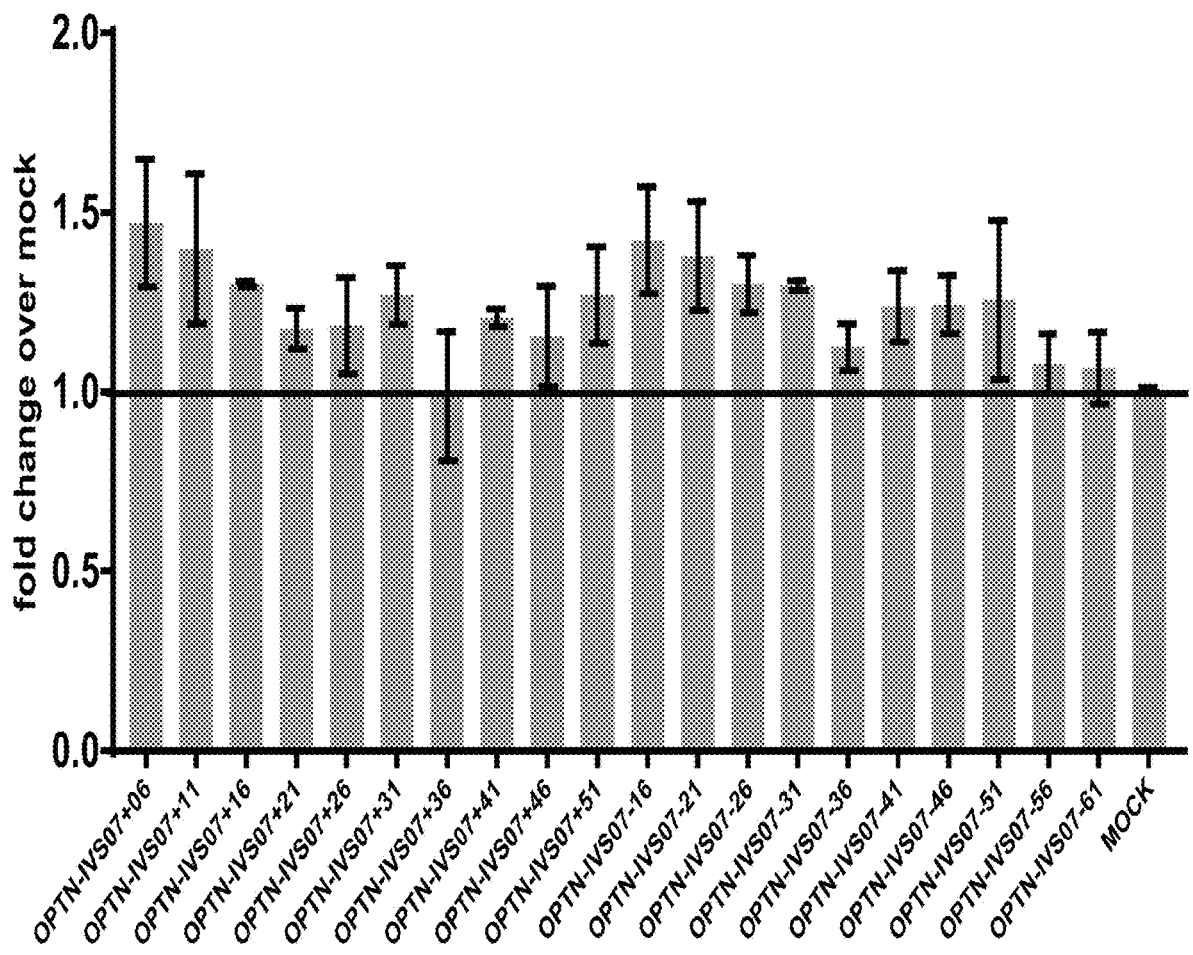
FIG. 91 depicts an exemplary graph showing the fold change in expression levels of OPTN mRNA without intron 7 in ARPE-19 cells treated for 24 hrs with 80 nM of the indicated ASOs over mock treated cells. Data is normalized to RPL32 expression.

Example 28: Improved Splicing Efficiency Via ASO-Targeting of a Retained Intron Increases OPTN Transcript Levels To determine an increase in target gene intron splicing efficiency with ASOs we used the method described herein. ARPE-19 cells, a human retinal epithelium cell line (American Type Culture Collection (ATCC), USA) were mock-transfected, or transfected with the targeting ASOs described in Table 9. Cells were transfected using Lipofectamine RNAiMax transfection reagent (Thermo Fisher) according to vendor's specifications. Briefly, ASOs were plated in 96-well tissue culture plates and combined with RNAiMax diluted in Opti-MEM. Cells were detached using trypsin and resuspended in full medium, and approximately 25,000 cells were added the ASO-transfection mixture. Transfection experiments were carried out in triplicate plate replicates. Final ASO concentration was 80 nM. Media was changed 6h post-transfection, and cells harvested at 24h, using the Cells-to-Ct lysis reagent, supplemented with DNAse (Thermo Fisher), according to vendor's specifications. cDNA was generated with Cells-to-Ct RT reagents (Thermo Fisher) according to vendor's specifications. To quantify the amount of splicing at the intron of interest, quantitative PCR was carried out using Taqman assays with probes spanning the corresponding exon-exon junction (Thermo Fisher). Taqman assays were carried out according to vendor's specifications, on a QuantStudio 7 Flex Real-Time PCR system (Thermo Fisher). Target gene assay values were normalized to RPL32 (deltaCt) and plate-matched mock transfected samples (delta-delta Ct), generating fold-change over mock quantitation (2^-(delta-deltaCt). Average fold-change over mock of the three plate replicates is plotted (FIG. 91). Several ASOs were identified that increased the target gene expression, as shown in FIG. 91, implying an increase in splicing at that target intron. Together with whole transcriptome data confirming retention of the target intron (FIG. 90), these results confirm that ASOs can improve the splicing efficiency of a rate limiting intron.

Figure 92:
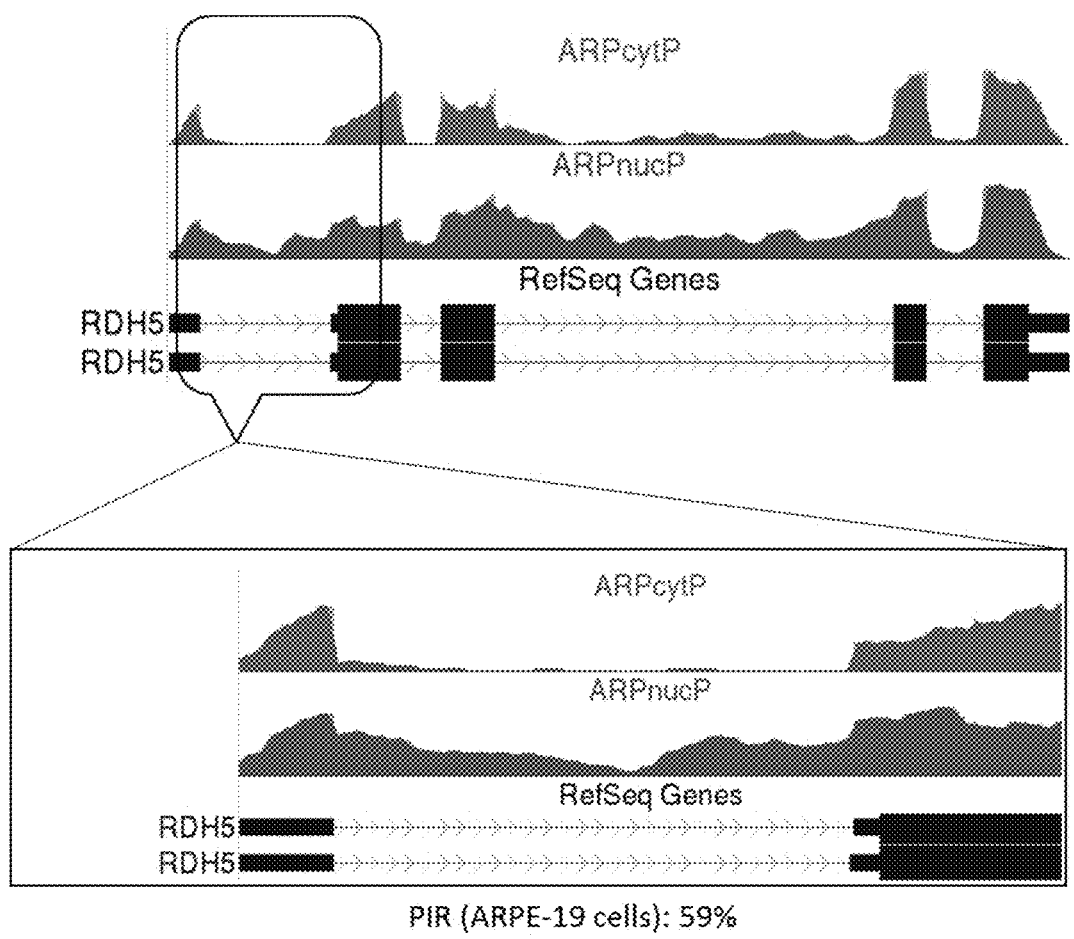
FIG. 92 depicts a schematic of the RefSeq Genes for RDH5 corresponding to NM_002905 and NM_001199771. The Percent Intron Retention (PIR) of the circled intron is shown.
Figure 93:
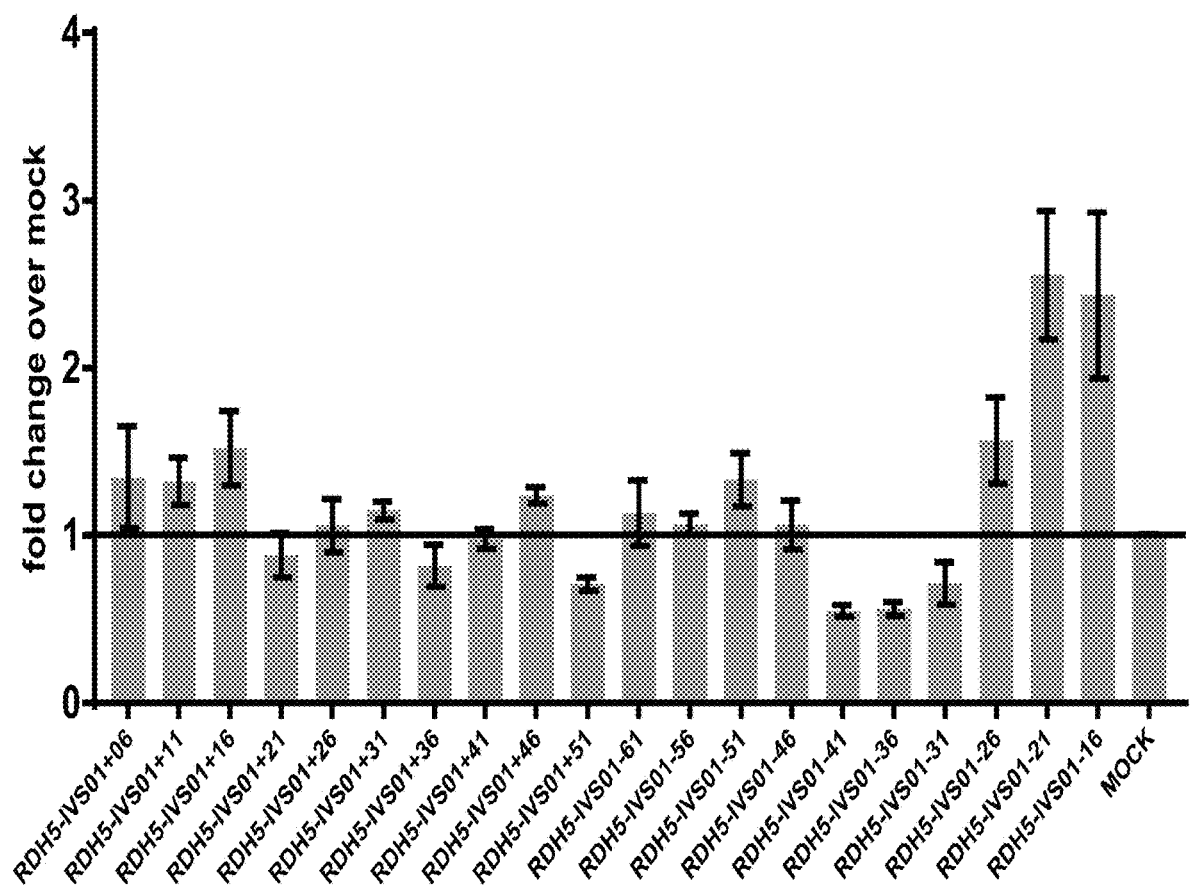
FIG. 93 depicts an exemplary graph showing the fold change in expression levels of RDH5 mRNA without intron 1 in ARPE-19 cells treated for 24 hrs with 80 nM of the indicated ASOs over mock treated cells. Data is normalized to RPL32 expression.
Figure 94:
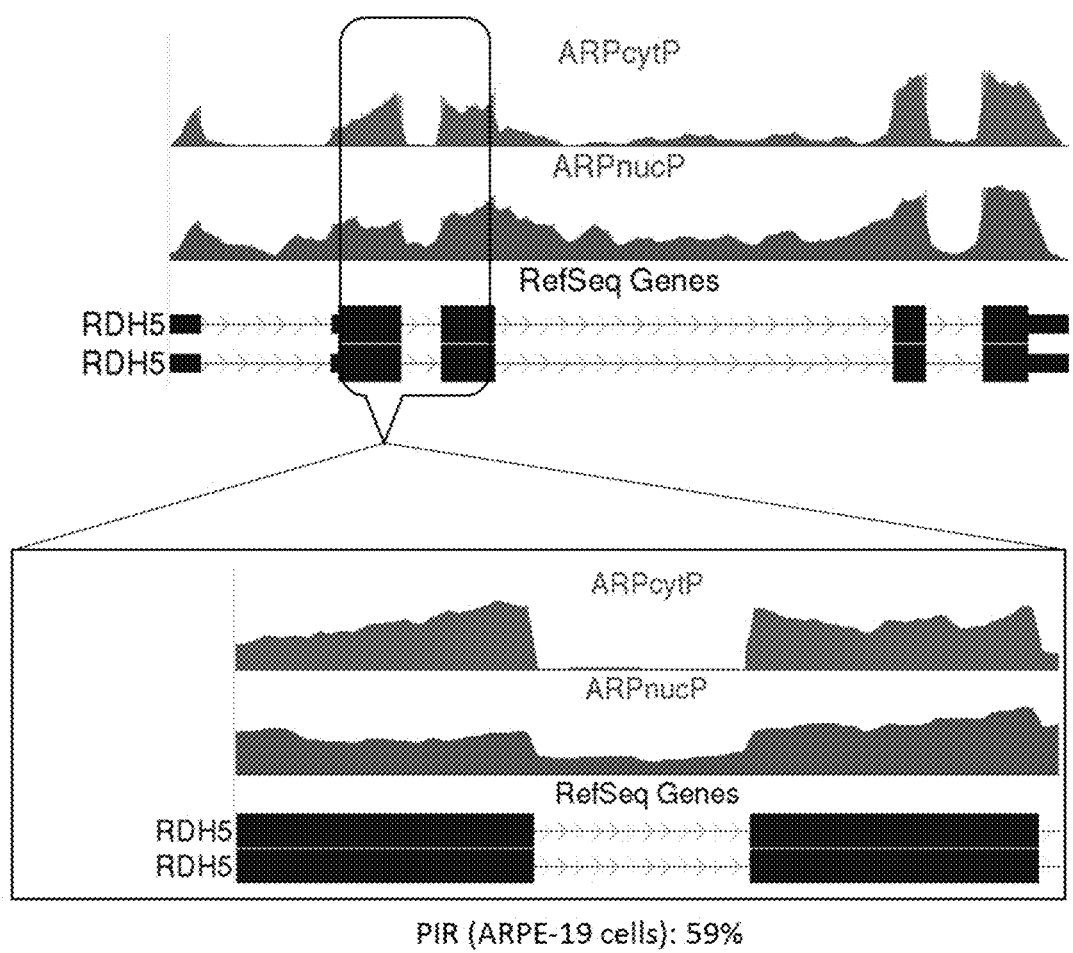
FIG. 94 depicts a schematic of the RefSeq Genes for RDH5 corresponding to NM_002905 and NM_001199771. The Percent Intron Retention (PIR) of the circled intron is shown.

Example 29: Improved Splicing Efficiency Via ASO-Targeting of a Retained Intron Increases RDH5 Transcript Levels To determine an increase in target gene intron splicing efficiency with ASOs we used the method described herein. ARPE-19 cells, a human retinal epithelium cell line (American Type Culture Collection (ATCC), USA) were mock-transfected, or transfected with the targeting ASOs described in Table 9. Cells were transfected using Lipofectamine RNAiMax transfection reagent (Thermo Fisher) according to vendor's specifications. Briefly, ASOs were plated in 96-well tissue culture plates and combined with RNAiMax diluted in Opti-MEM. Cells were detached using trypsin and resuspended in full medium, and approximately 25,000 cells were added the ASO-transfection mixture. Transfection experiments were carried out in triplicate plate replicates. Final ASO concentration was 80 nM. Media was changed 6h post-transfection, and cells harvested at 24h, using the Cells-to-Ct lysis reagent, supplemented with DNAse (Thermo Fisher), according to vendor's specifications. cDNA was generated with Cells-to-Ct RT reagents (Thermo Fisher) according to vendor's specifications. To quantify the amount of splicing at the intron of interest, quantitative PCR was carried out using Taqman assays with probes spanning the corresponding exon-exon junction (Thermo Fisher). Taqman assays were carried out according to vendor's specifications, on a QuantStudio 7 Flex Real-Time PCR system (Thermo Fisher). Target gene assay values were normalized to RPL32 (deltaCt) and plate-matched mock transfected samples (delta-delta Ct), generating fold-change over mock quantitation (2^-(delta-deltaCt). Average fold-change over mock of the three plate replicates is plotted (FIG. 93). Several ASOs were identified that increased the target gene expression, as shown in FIG. 93, implying an increase in splicing at that target intron. Together with whole transcriptome data confirming retention of the target intron (FIG. 92 and FIG. 94), these results confirm that ASOs can improve the splicing efficiency of a rate limiting intron.

Figure 95:
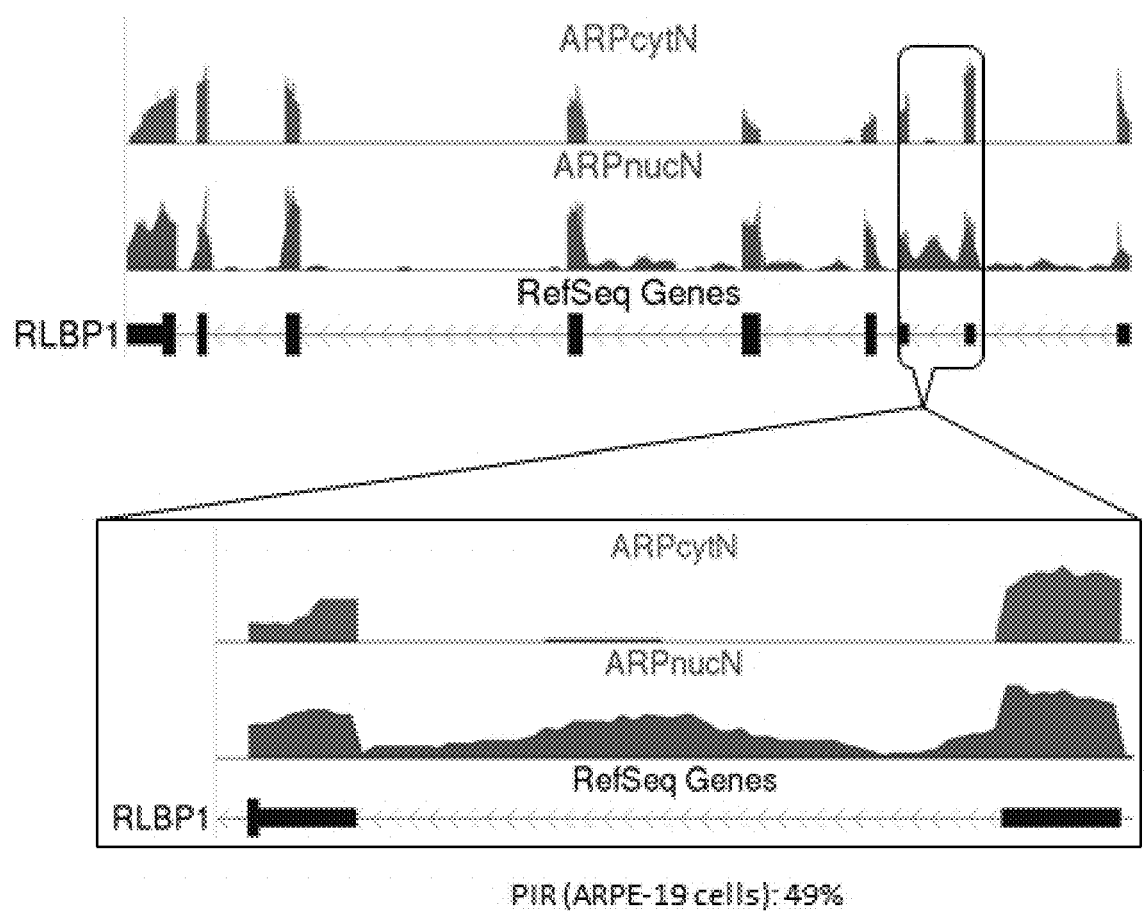
FIG. 95 depicts a schematic of the RefSeq Genes for RLBP1 corresponding to NM_000326. The Percent Intron Retention (PIR) of the circled intron is shown.
Figure 96:
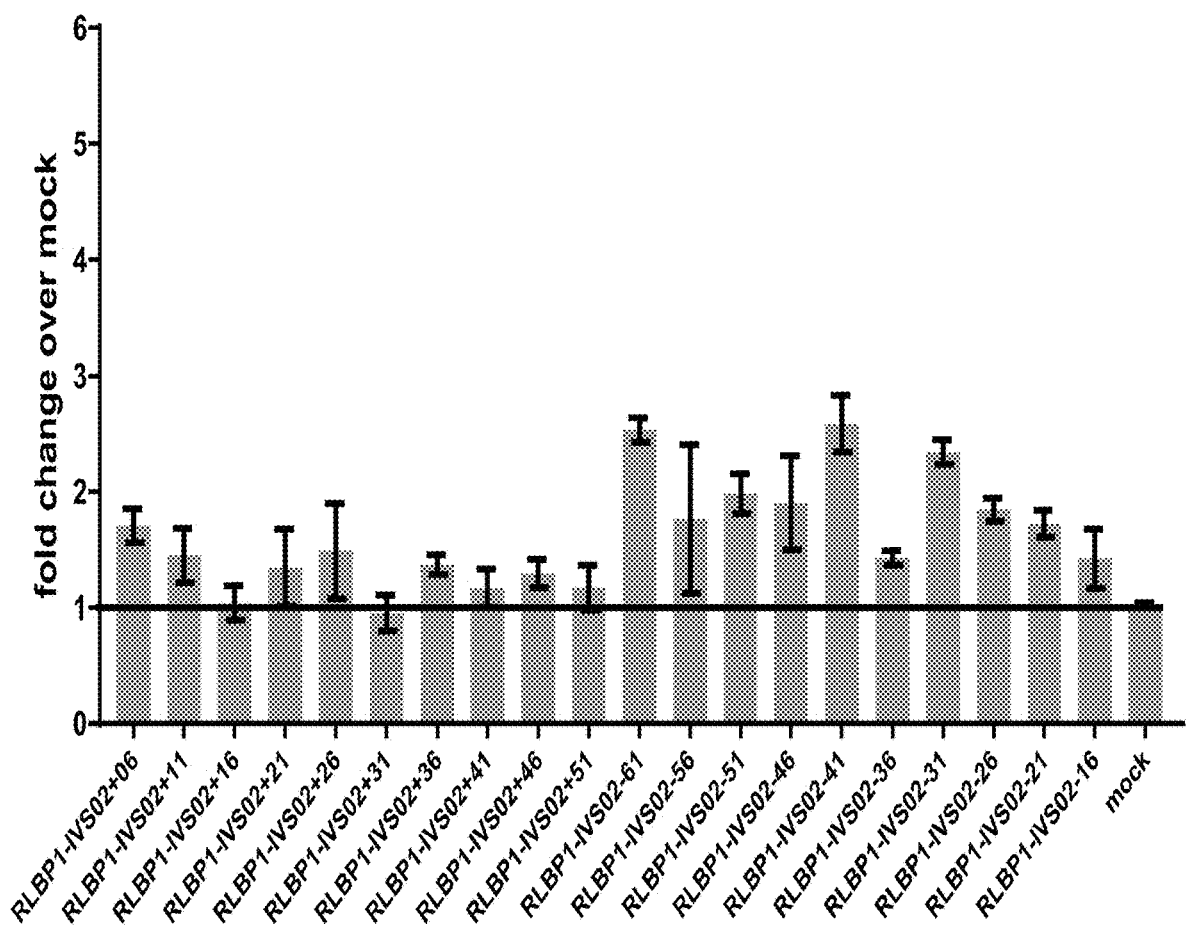
FIG. 96 depicts an exemplary graph showing the fold change in expression levels of RLBP1 mRNA without intron 2 in ARPE-19 cells treated for 24 hrs with 80 nM of the indicated ASOs over mock treated cells. Data is normalized to RPL32 expression.
Figure 97:
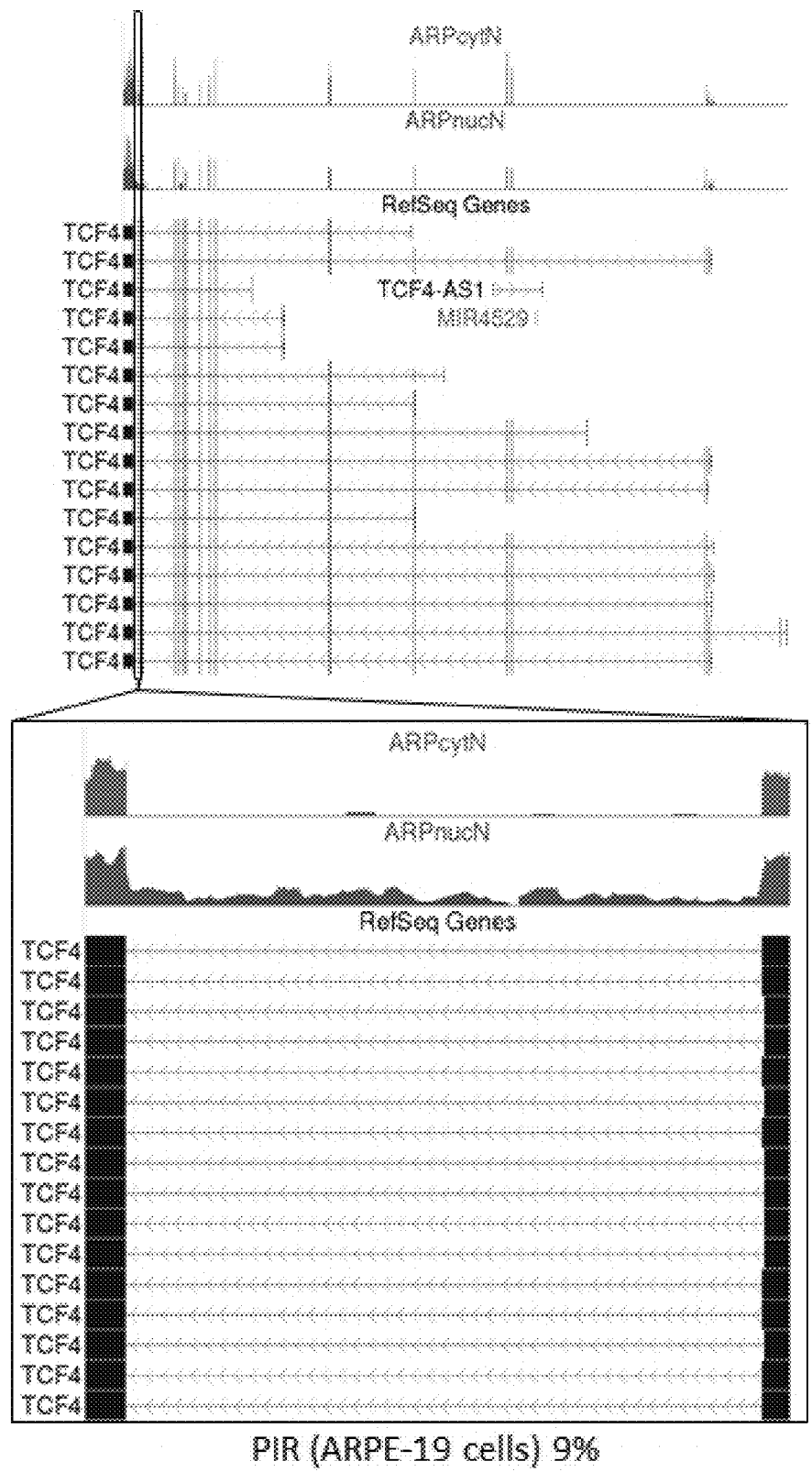
FIG. 97 depicts a schematic of the RefSeq Genes for TCF4 corresponding to NM_001243236, NM_00123235, NM_001243234, NM_001243233, NM_001243232, NM_001243231, NM_003199, NM_001306207, NM_001306208, NM_001243227, NM_001243228, NM_001243230, NM_001243226, NM_001083962, NM_001330605, and NM_001330604. The Percent Intron Retention (PIR) of the circled intron is shown.
Figure 98:
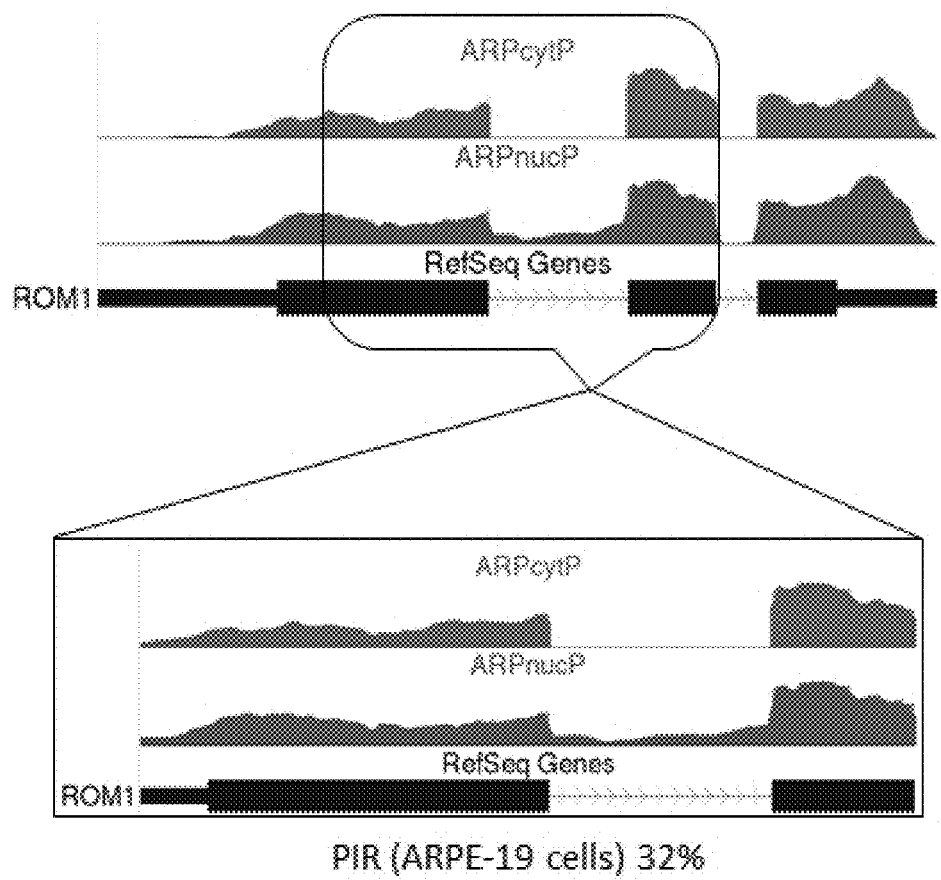
FIG. 98 depicts a schematic of the RefSeq Genes for ROM1 corresponding to NM_000327. The Percent Intron Retention (PIR) of the circled intron is shown.
Figure 99:
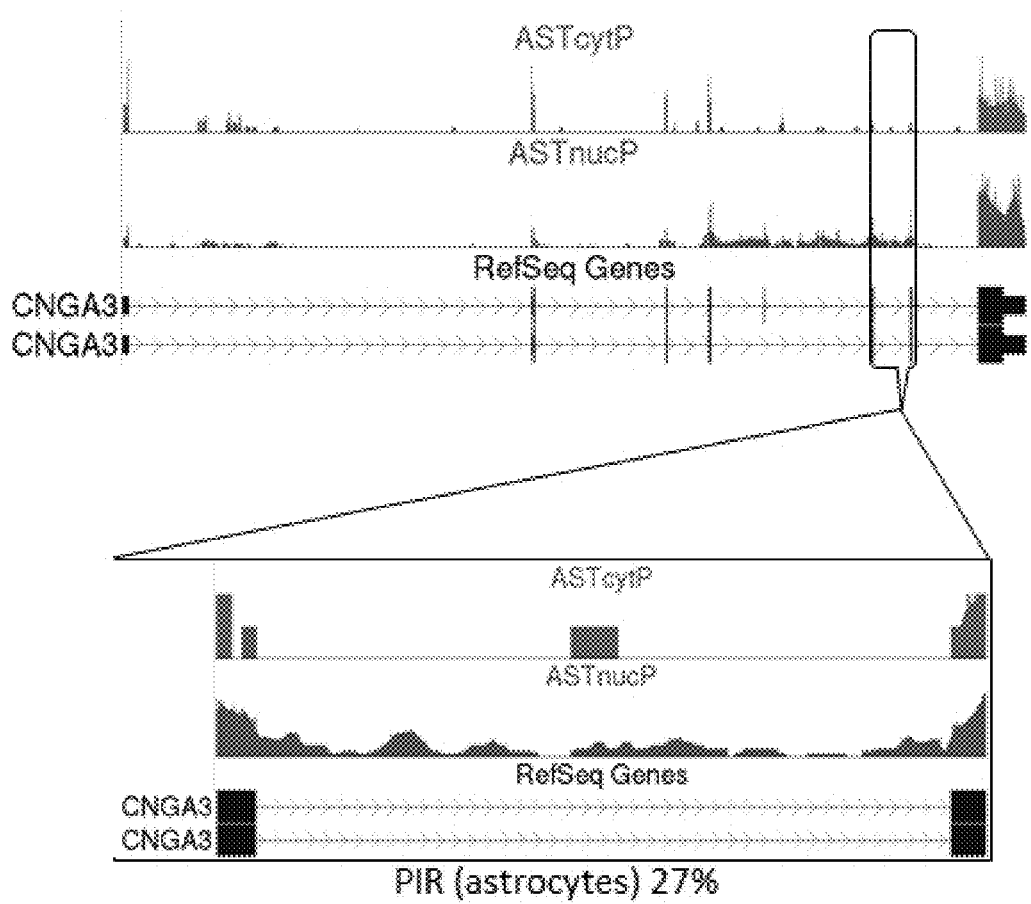
FIG. 99 depicts a schematic of the RefSeq Genes for CNGA3 corresponding to NM_001298 and NM_001079878. The Percent Intron Retention (PIR) of the circled intron is shown.
Figure 100:
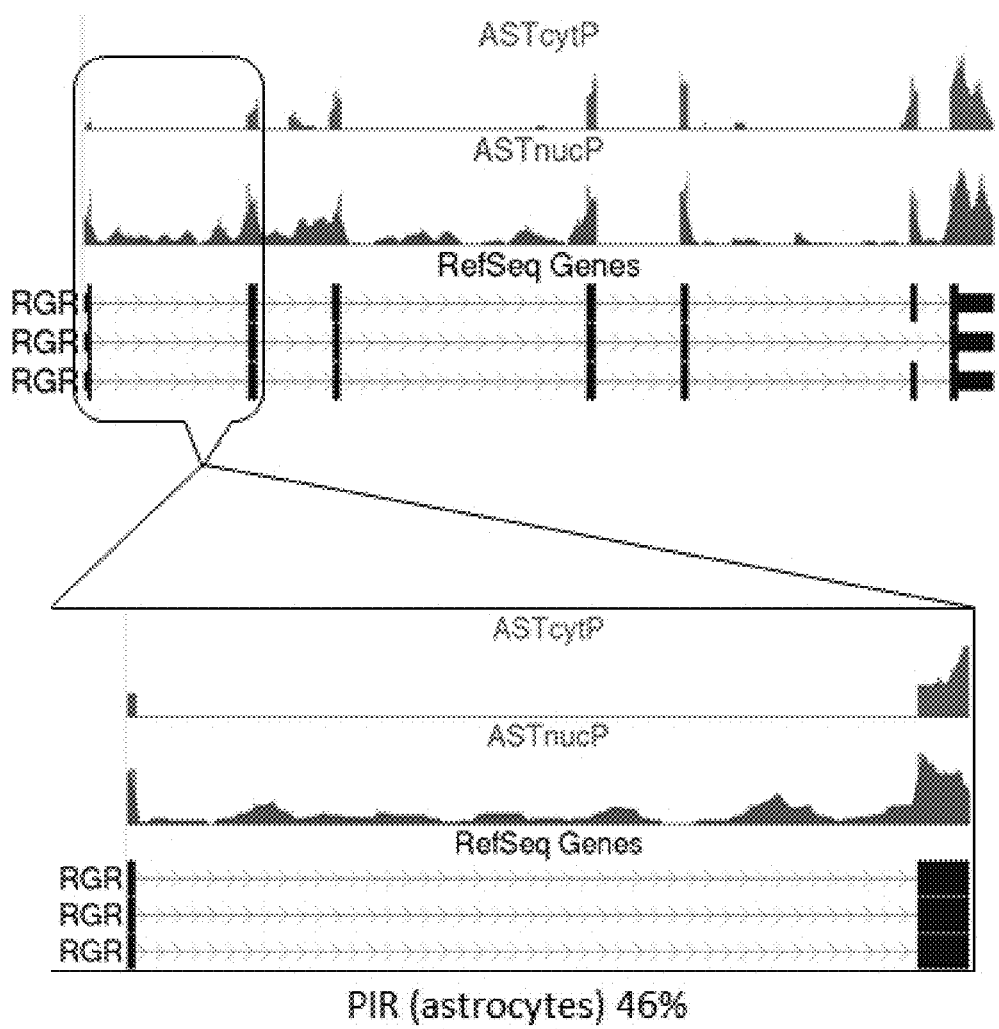
FIG. 100 depicts a schematic of the RefSeq Genes for RGR corresponding to NM_002921, NM_001012722, and NM_001012720. The Percent Intron Retention (PIR) of the circled intron is shown.
Figure 101:
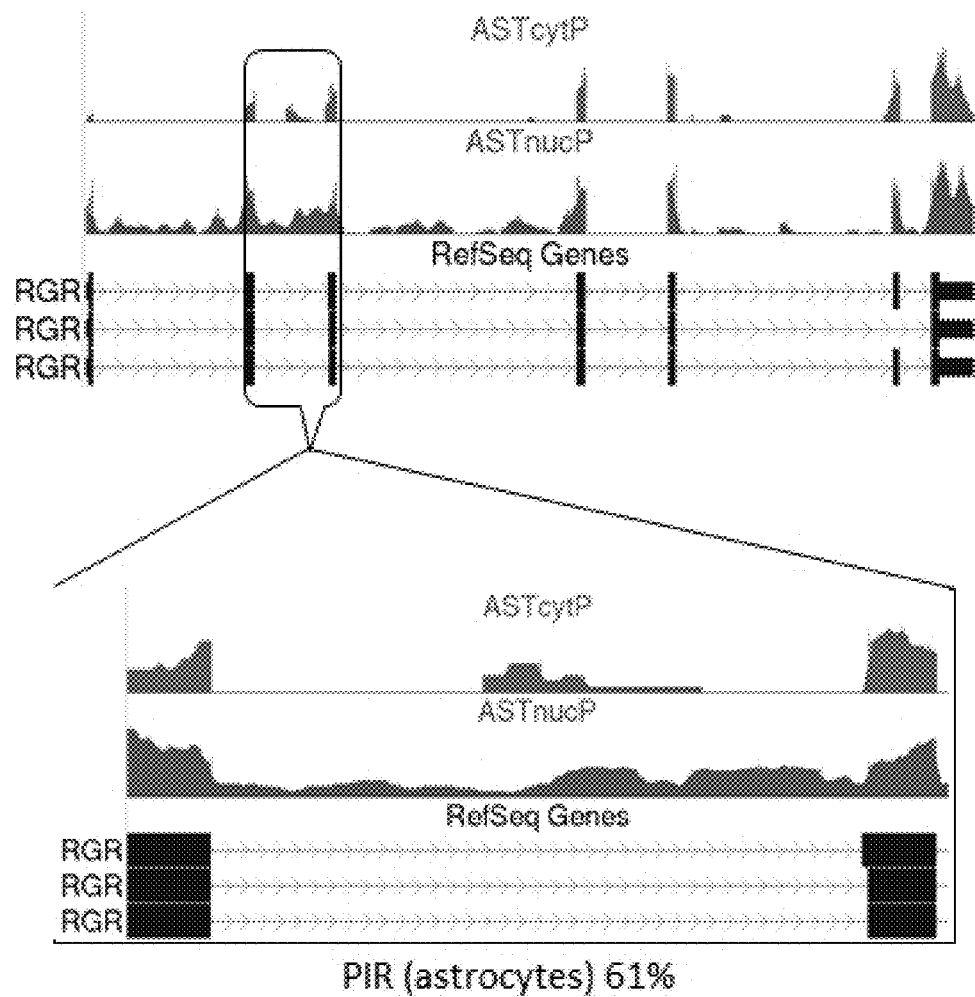
FIG. 101 depicts a schematic of the RefSeq Genes for RGR corresponding to NM_002921, NM_001012722, and NM_001012720. The Percent Intron Retention (PIR) of the circled intron is shown.
Figure 102:
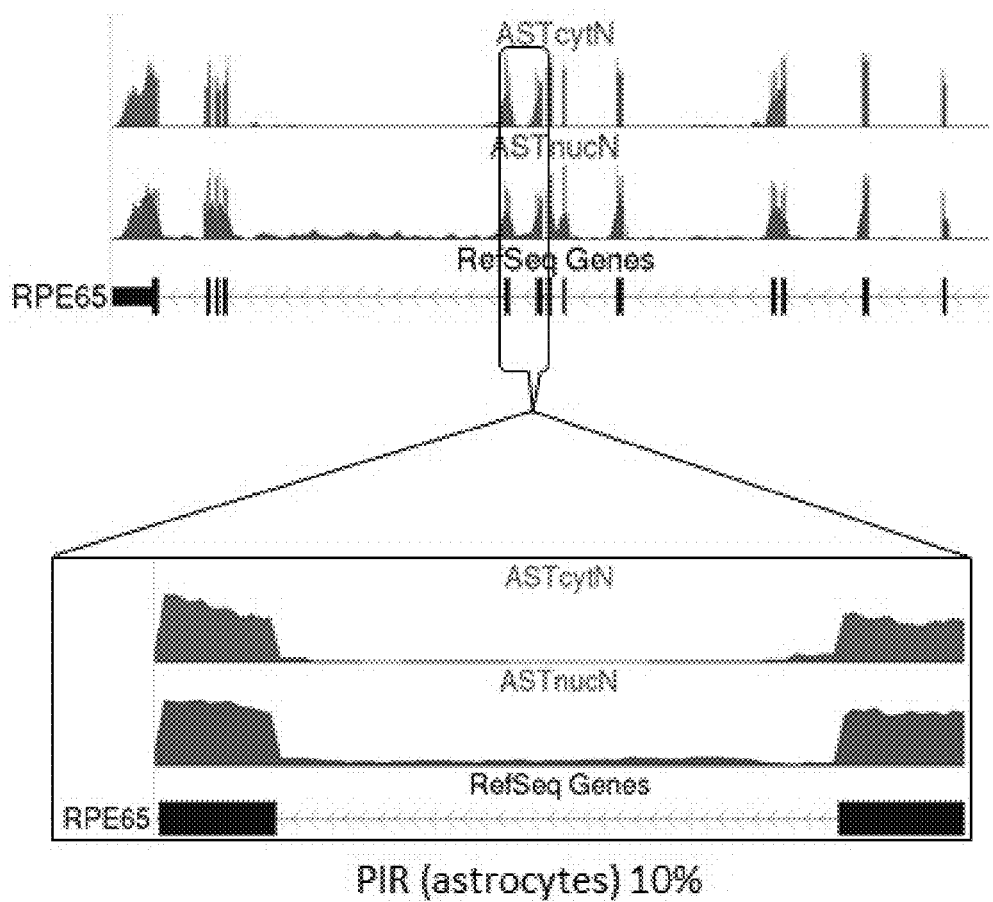
FIG. 102 depicts a schematic of the RefSeq Genes for RPE65 corresponding to NM_000329. The Percent Intron Retention (PIR) of the circled intron is shown.
Figure 103:
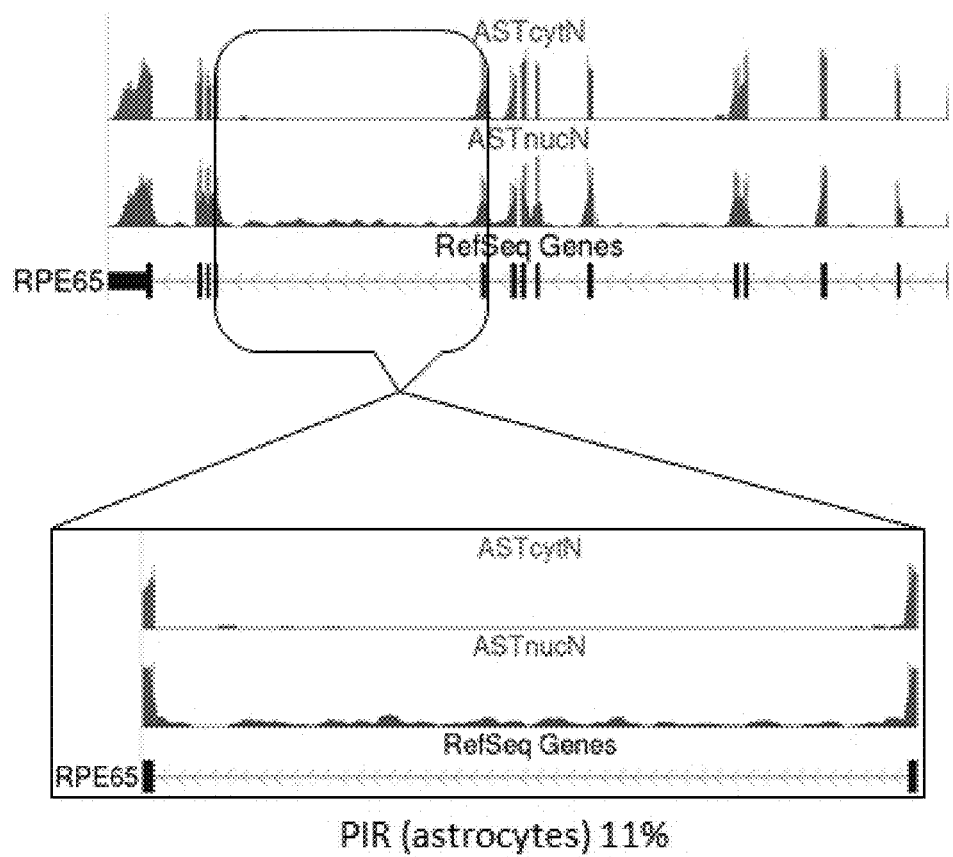
FIG. 103 depicts a schematic of the RefSeq Genes for RPE65 corresponding to NM_000329. The Percent Intron Retention (PIR) of the circled intron is shown.
Figure 104:
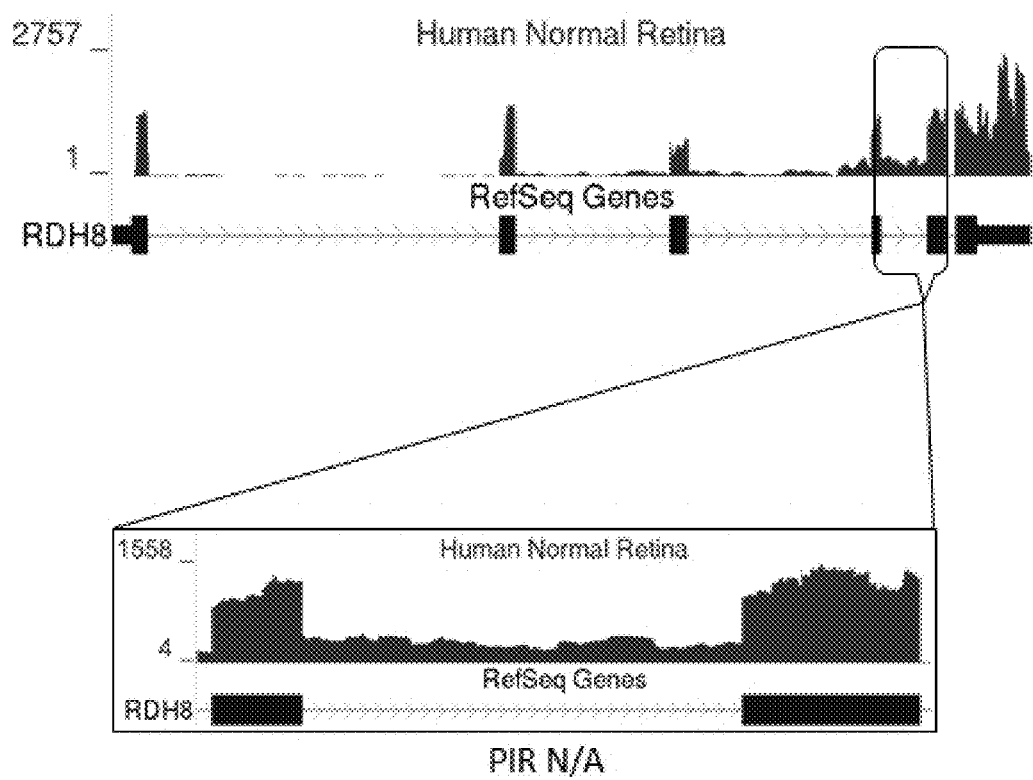
FIG. 104 depicts a schematic of the RefSeq Genes for RDH8 corresponding to NM_015725. The Percent Intron Retention (PIR) of the circled intron is shown.
Figure 105:
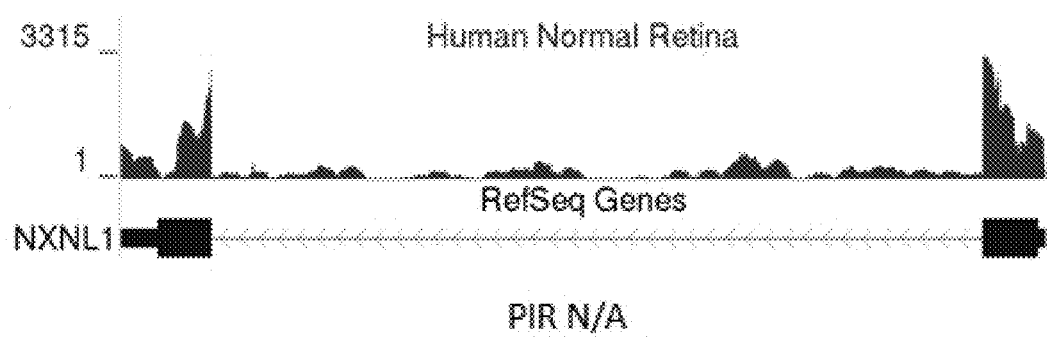
FIG. 105 depicts a schematic of the RefSeq Genes for NXNL1 corresponding to NM_138454. The Percent Intron Retention (PIR) of the circled intron is shown.
Figure 106:
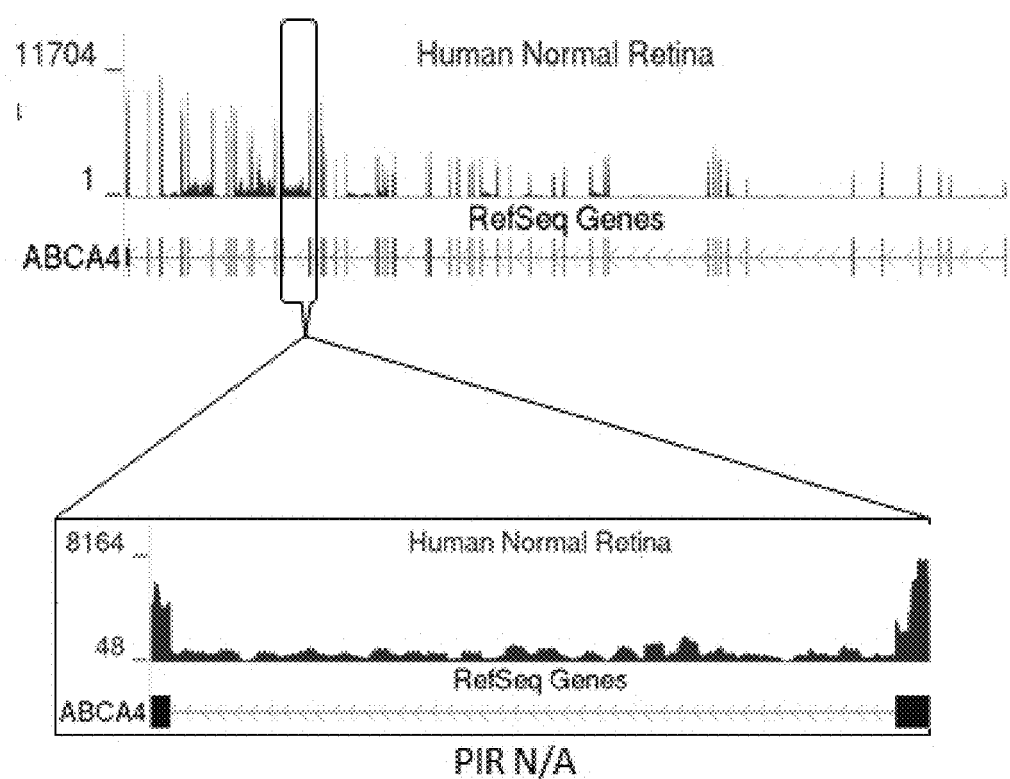
FIG. 106 depicts a schematic of the RefSeq Genes for ABCA4 corresponding to NM_000350. The Percent Intron Retention (PIR) of the circled intron is shown.
Figure 107:
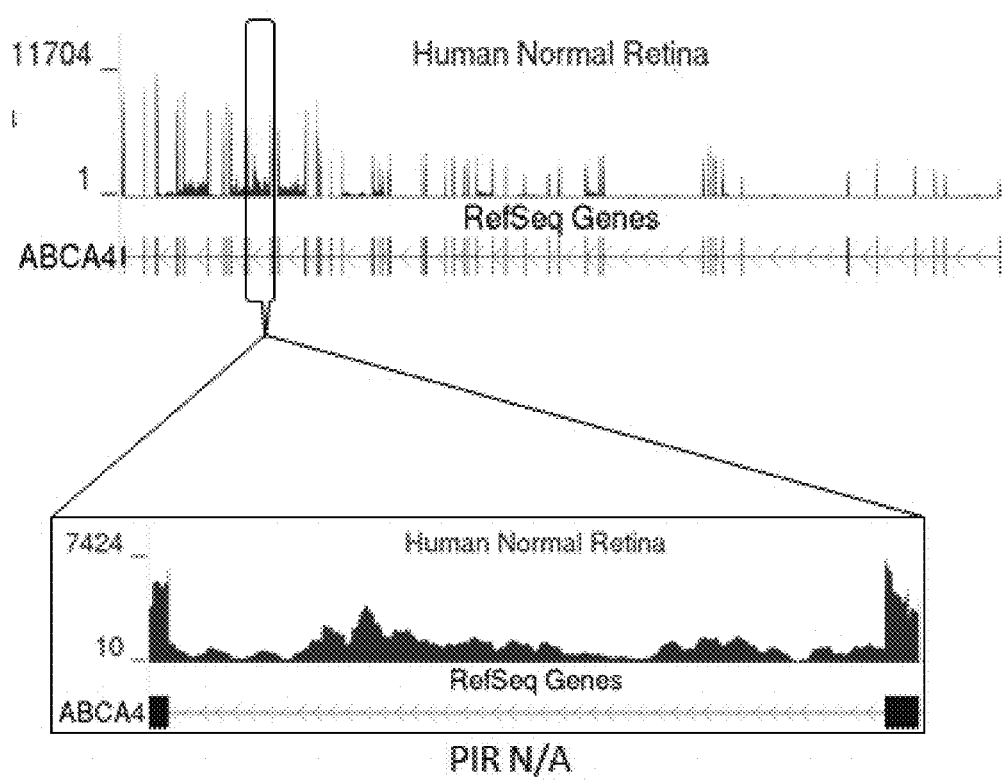
FIG. 107 depicts a schematic of the RefSeq Genes for ABCA4 corresponding to NM_000350. The Percent Intron Retention (PIR) of the circled intron is shown.

Example 30: Improved Splicing Efficiency Via ASO-Targeting of a Retained Intron Increases RLBP1 Transcript Levels To determine an increase in target gene intron splicing efficiency with ASOs we used the method described herein. ARPE-19 cells, a human retinal epithelium cell line (American Type Culture Collection (ATCC), USA) were mock-transfected, or transfected with the targeting ASOs described in Table 9. Cells were transfected using Lipofectamine RNAiMax transfection reagent (Thermo Fisher) according to vendor's specifications. Briefly, ASOs were plated in 96-well tissue culture plates and combined with RNAiMax diluted in Opti-MEM. Cells were detached using trypsin and resuspended in full medium, and approximately 25,000 cells were added the ASO-transfection mixture. Transfection experiments were carried out in triplicate plate replicates. Final ASO concentration was 80 nM. Media was changed 6h post-transfection, and cells harvested at 24h, using the Cells-to-Ct lysis reagent, supplemented with DNAse (Thermo Fisher), according to vendor's specifications. cDNA was generated with Cells-to-Ct RT reagents (Thermo Fisher) according to vendor's specifications. To quantify the amount of splicing at the intron of interest, quantitative PCR was carried out using Taqman assays with probes spanning the corresponding exon-exon junction (Thermo Fisher). Taqman assays were carried out according to vendor's specifications, on a QuantStudio 7 Flex Real-Time PCR system (Thermo Fisher). Target gene assay values were normalized to RPL32 (deltaCt) and plate-matched mock transfected samples (delta-delta Ct), generating fold-change over mock quantitation (2^-(delta-deltaCt). Average fold-change over mock of the three plate replicates is plotted (FIG. 96). Several ASOs were identified that increased the target gene expression, as shown in FIG. 96, implying an increase in splicing at that target intron. Together with whole transcriptome data confirming retention of the target intron (FIG. 95), these results confirm that ASOs can improve the splicing efficiency of a rate limiting intron.

Figure 108:
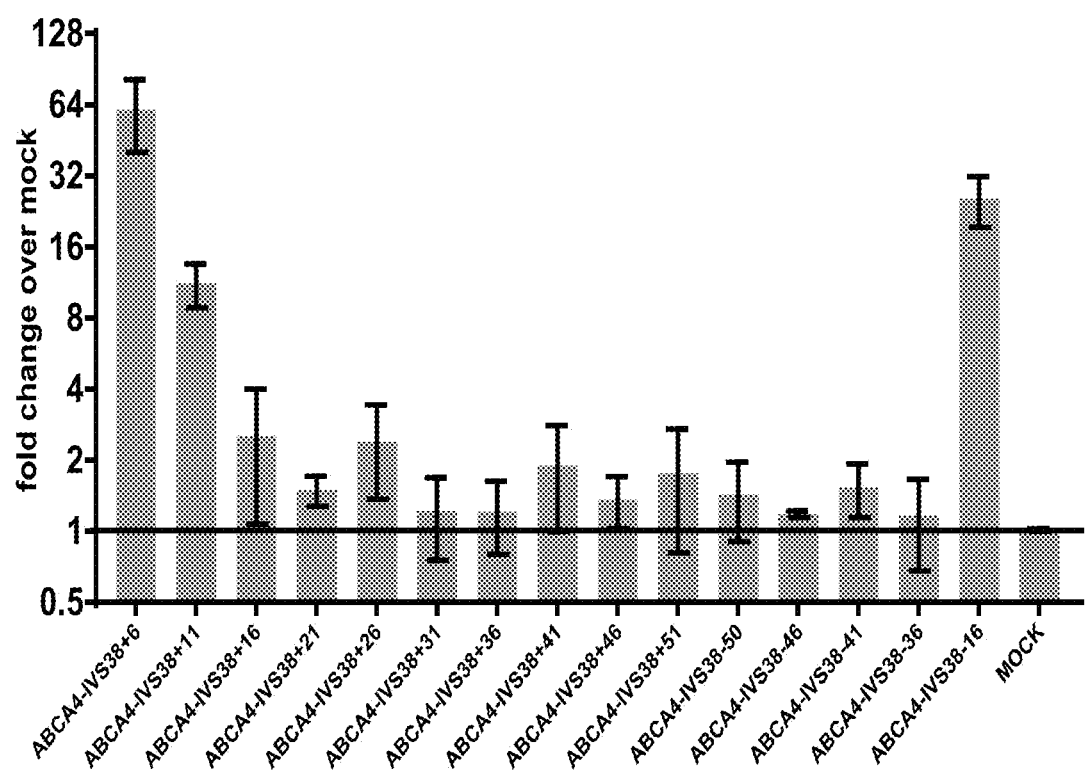
FIG. 108 depicts an exemplary graph showing the fold change in expression levels of ABCA4 mRNA without intron 38 in ARPE-19 cells treated for 24 hrs with 80 nM of the indicated ASOs over mock treated cells. Data is normalized to RPL32 expression.
Figure 109:
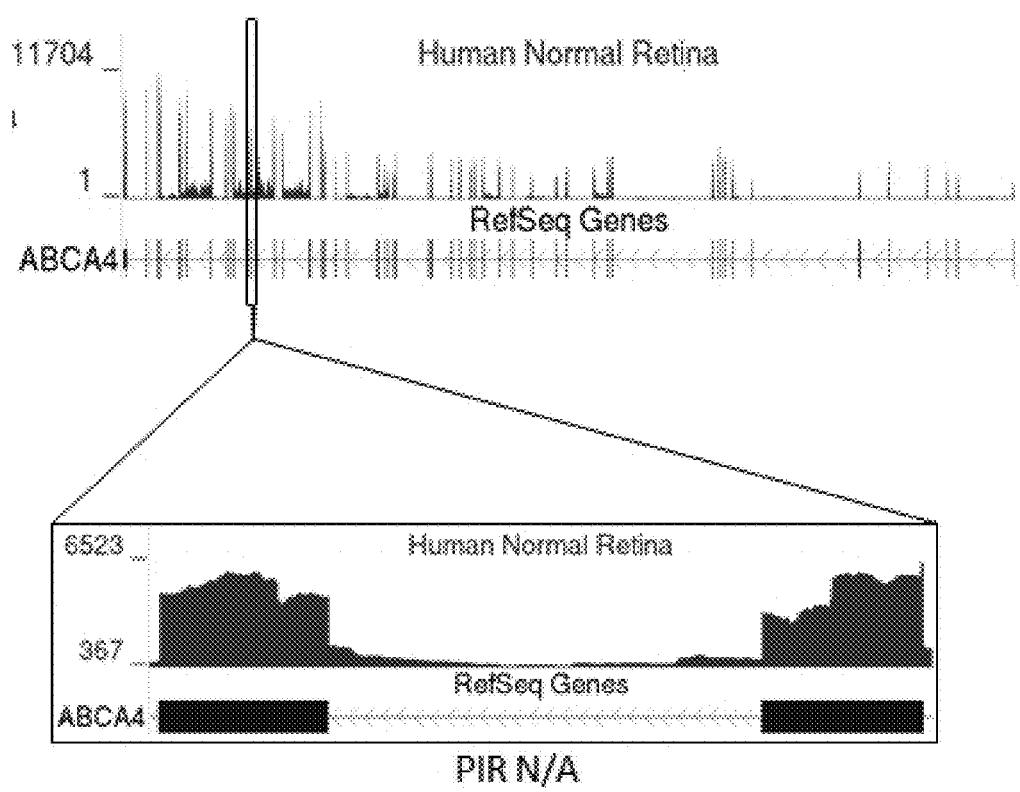
FIG. 109 depicts a schematic of the RefSeq Genes for ABCA4 corresponding to NM_000350. The Percent Intron Retention (PIR) of the circled intron is shown.
Figure 110:
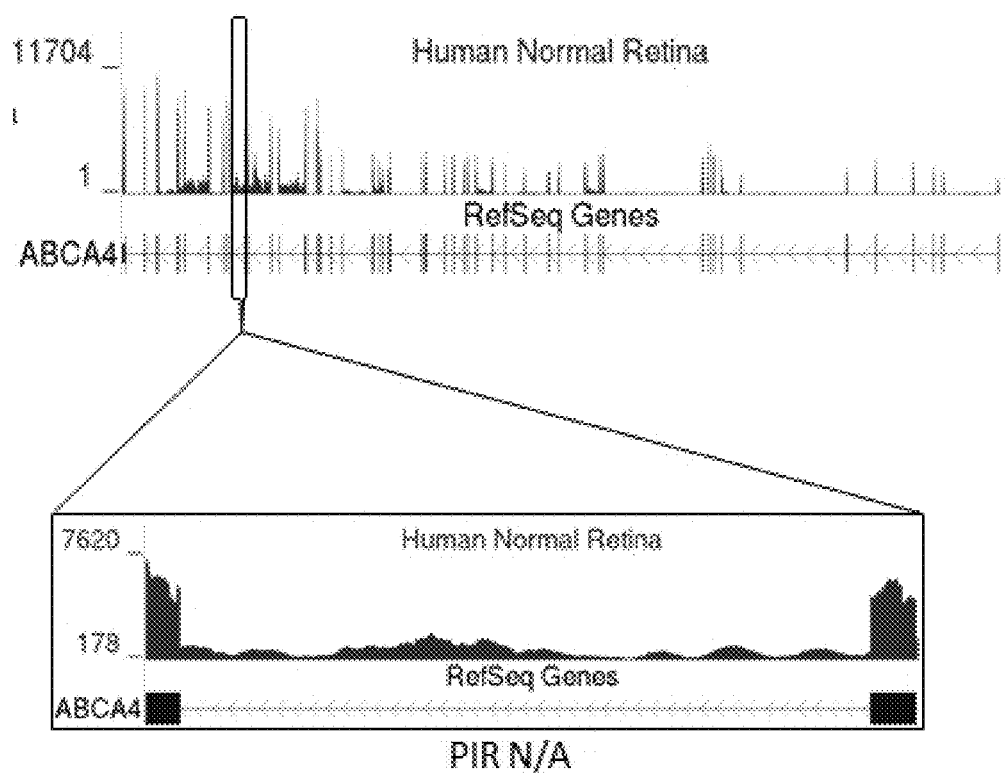
FIG. 110 depicts a schematic of the RefSeq Genes for ABCA4 corresponding to NM_000350. The Percent Intron Retention (PIR) of the circled intron is shown.
Figure 111:
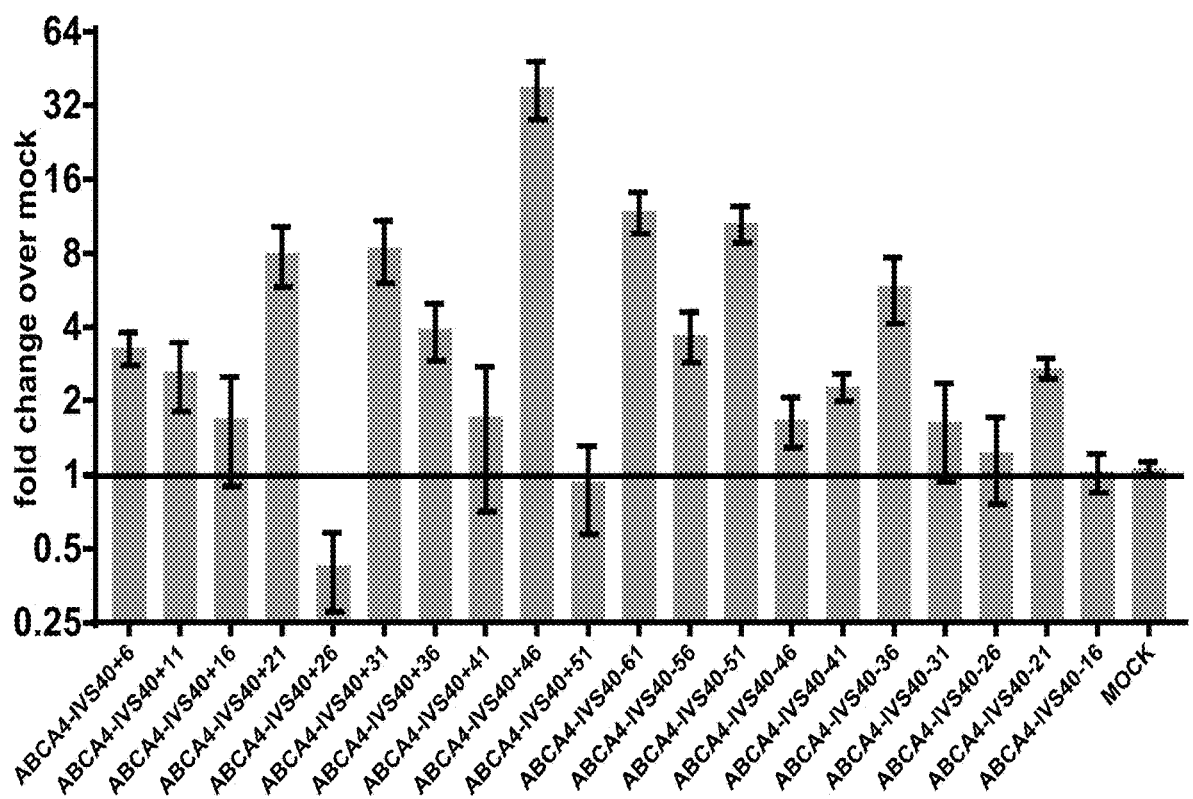
FIG. 111 depicts an exemplary graph showing the fold change in expression levels of ABCA4 mRNA without intron 40 in ARPE-19 cells treated for 24 hrs with 80 nM of the indicated ASOs over mock treated cells. Data is normalized to RPL32 expression.
Figure 112:
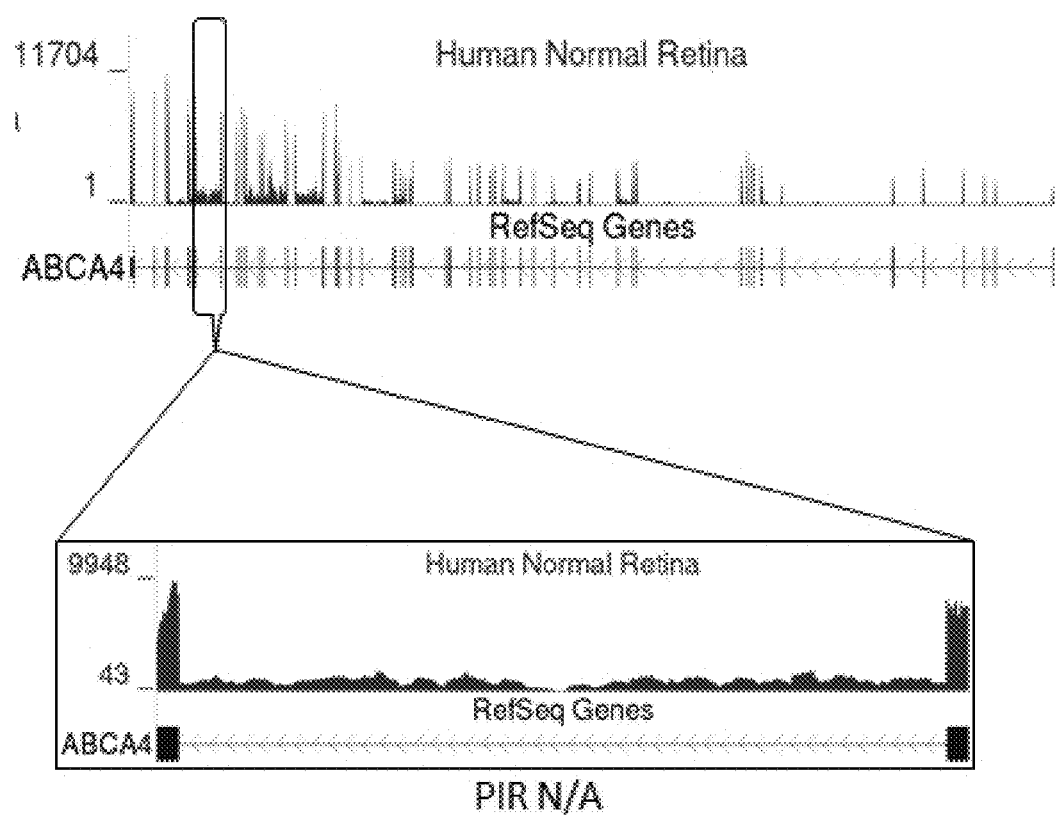
FIG. 112 depicts a schematic of the RefSeq Genes for ABCA4 corresponding to NM_000350. The Percent Intron Retention (PIR) of the circled intron is shown
Figure 113:
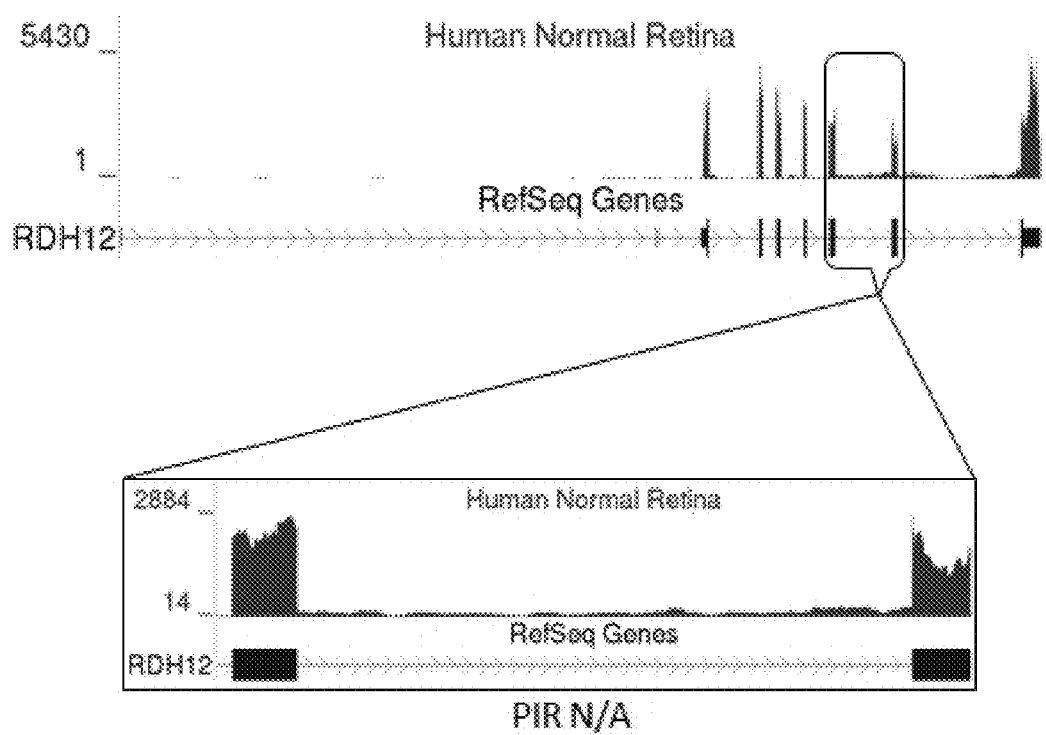
FIG. 113 depicts a schematic of the RefSeq Genes for RDH12 corresponding to NM_152443. The Percent Intron Retention (PIR) of the circled intron is shown.
Figure 114:
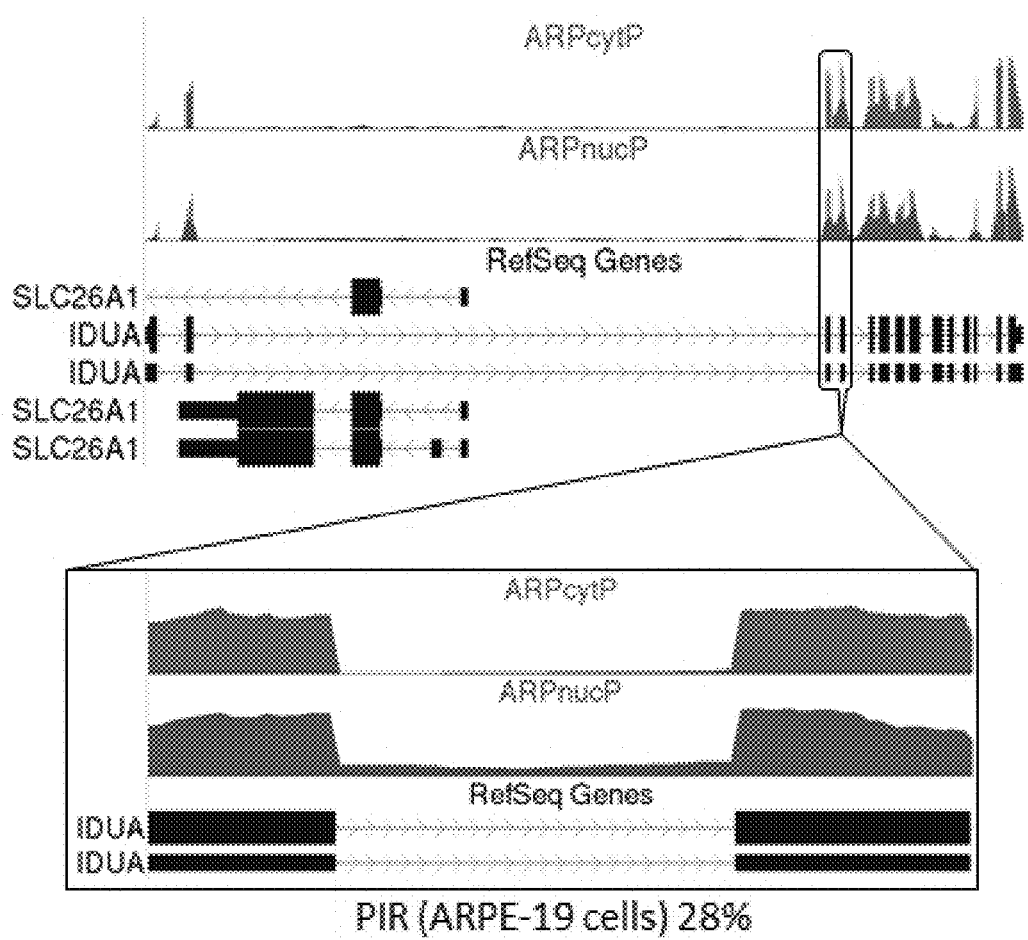
FIG. 114 depicts a schematic of the RefSeq Genes for IDUA corresponding to NM_000203 and NR_110313. The Percent Intron Retention (PIR) of the circled intron is shown.

Example 31: Improved Splicing Efficiency Via ASO-Targeting of a Retained Intron Increases ABCA4 Transcript Levels To determine an increase in target gene intron splicing efficiency with ASOs we used the method described herein. ARPE-19 cells, a human retinal epithelium cell line (American Type Culture Collection (ATCC), USA) were mock-transfected, or transfected with the targeting ASOs described in Table 9. Cells were transfected using Lipofectamine RNAiMax transfection reagent (Thermo Fisher) according to vendor's specifications. Briefly, ASOs were plated in 96-well tissue culture plates and combined with RNAiMax diluted in Opti-MEM. Cells were detached using trypsin and resuspended in full medium, and approximately 25,000 cells were added the ASO-transfection mixture. Transfection experiments were carried out in triplicate plate replicates. Final ASO concentration was 80 nM. Media was changed 6h post-transfection, and cells harvested at 24h, using the Cells-to-Ct lysis reagent, supplemented with DNAse (Thermo Fisher), according to vendor's specifications. cDNA was generated with Cells-to-Ct RT reagents (Thermo Fisher) according to vendor's specifications. To quantify the amount of splicing at the intron of interest, quantitative PCR was carried out using Taqman assays with probes spanning the corresponding exon-exon junction (Thermo Fisher). Taqman assays were carried out according to vendor's specifications, on a QuantStudio 7 Flex Real-Time PCR system (Thermo Fisher). Target gene assay values were normalized to RPL32 (deltaCt) and plate-matched mock transfected samples (delta-delta Ct), generating fold-change over mock quantitation (2^-(delta-deltaCt). Average fold-change over mock of the three plate replicates is plotted (FIG. 108 and FIG. 111). Several ASOs were identified that increased the target gene expression, as shown in FIG. 108 and FIG. 111, implying an increase in splicing at that target intron. These results confirm that ASOs can improve the splicing efficiency of a rate limiting intron.

Figure 115:
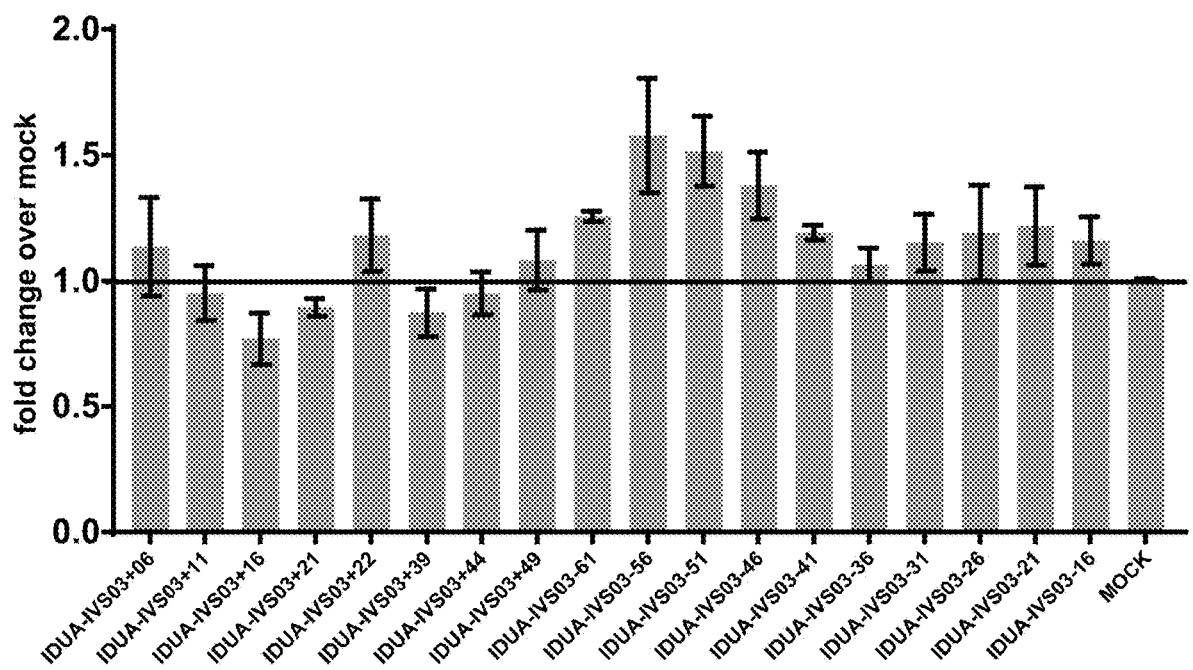
FIG. 115 depicts an exemplary graph showing the fold change in expression levels of IDUA mRNA without intron 3 in ARPE-19 cells treated for 24 hrs with 80 nM of the indicated ASOs over mock treated cells. Data is normalized to RPL32 expression.
Figure 116:
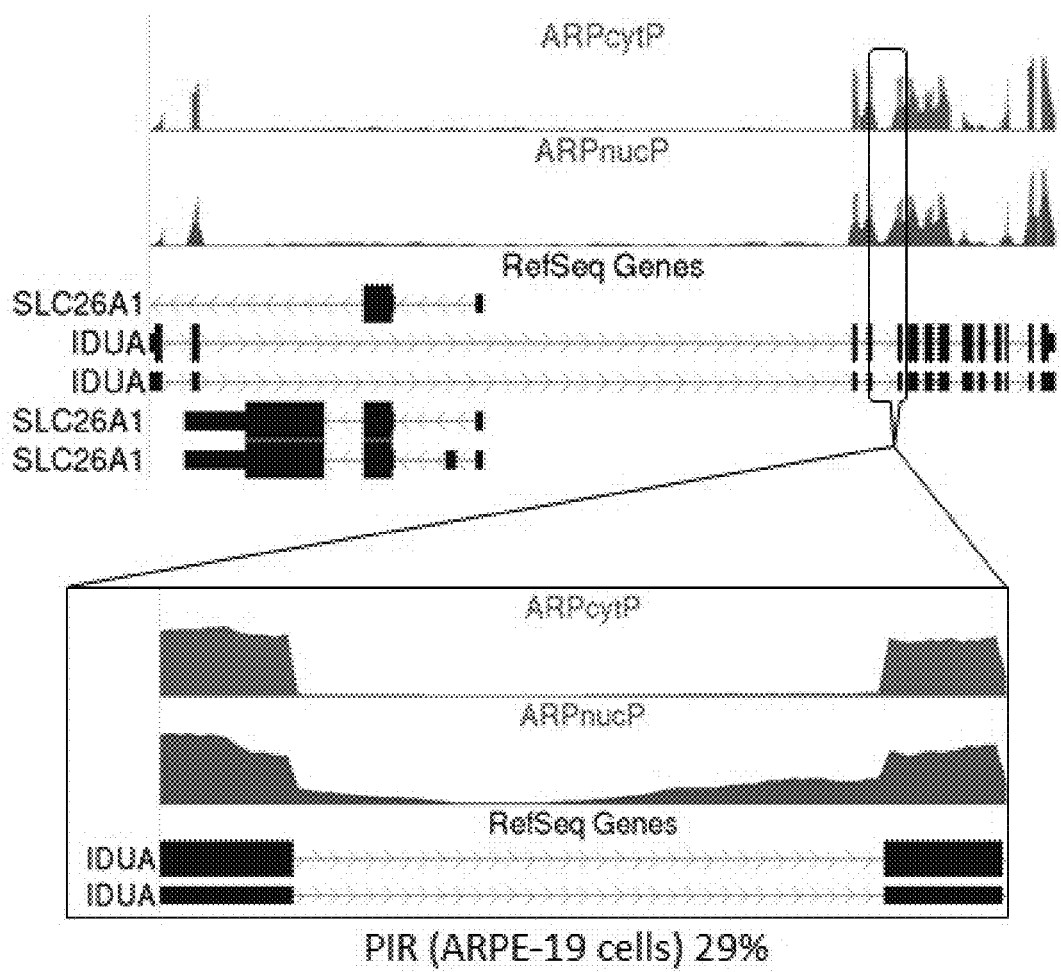
FIG. 116 depicts a schematic of the RefSeq Genes for IDUA corresponding to NM_000203 and NR_110313. The Percent Intron Retention (PIR) of the circled intron is shown.
Figure 117:
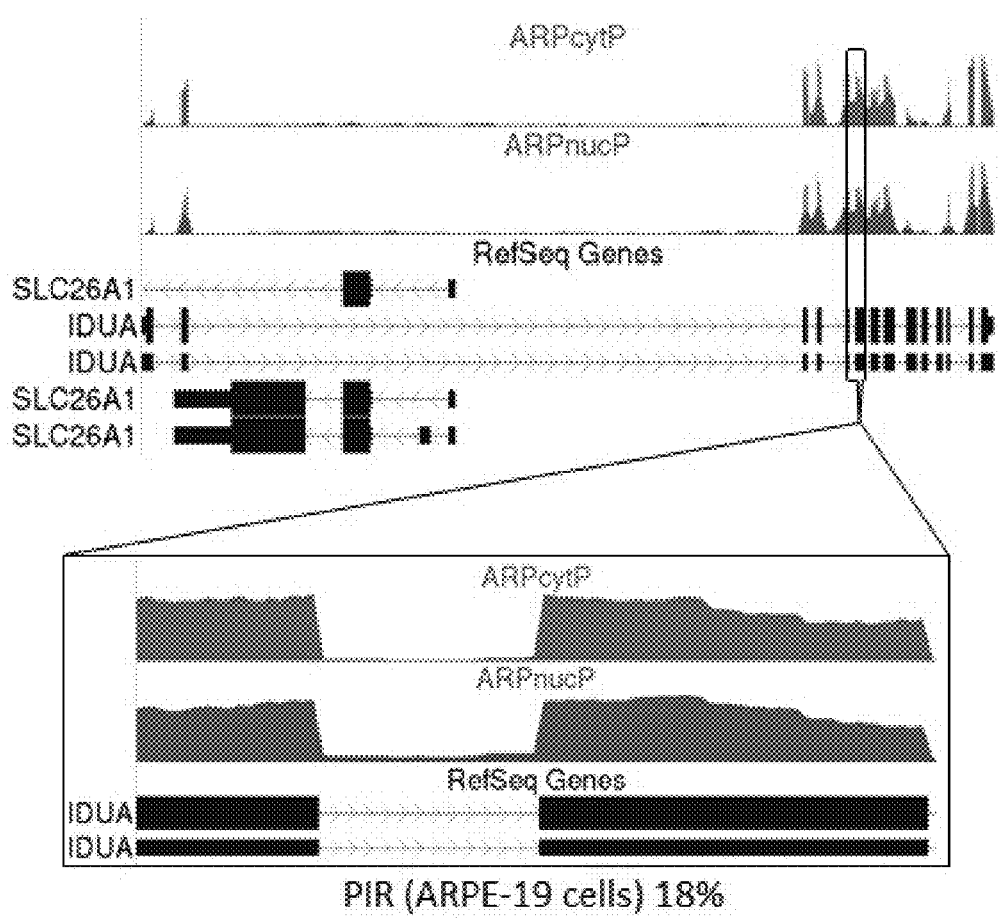
FIG. 117 depicts a schematic of the RefSeq Genes for IDUA corresponding to NM_000203 and NR_110313. The Percent Intron Retention (PIR) of the circled intron is shown.
Figure 118:
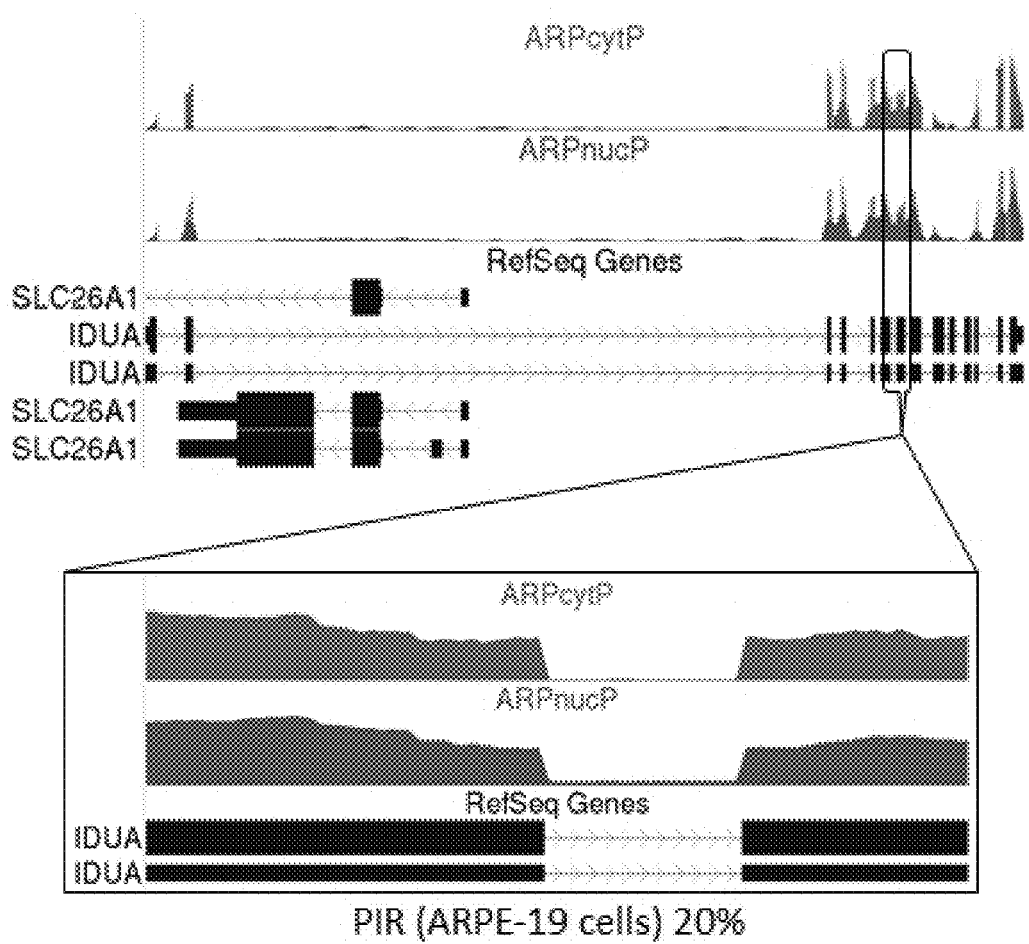
FIG. 118 depicts a schematic of the RefSeq Genes for IDUA corresponding to NM_000203 and NR_110313. The Percent Intron Retention (PIR) of the circled intron is shown.
Figure 119:
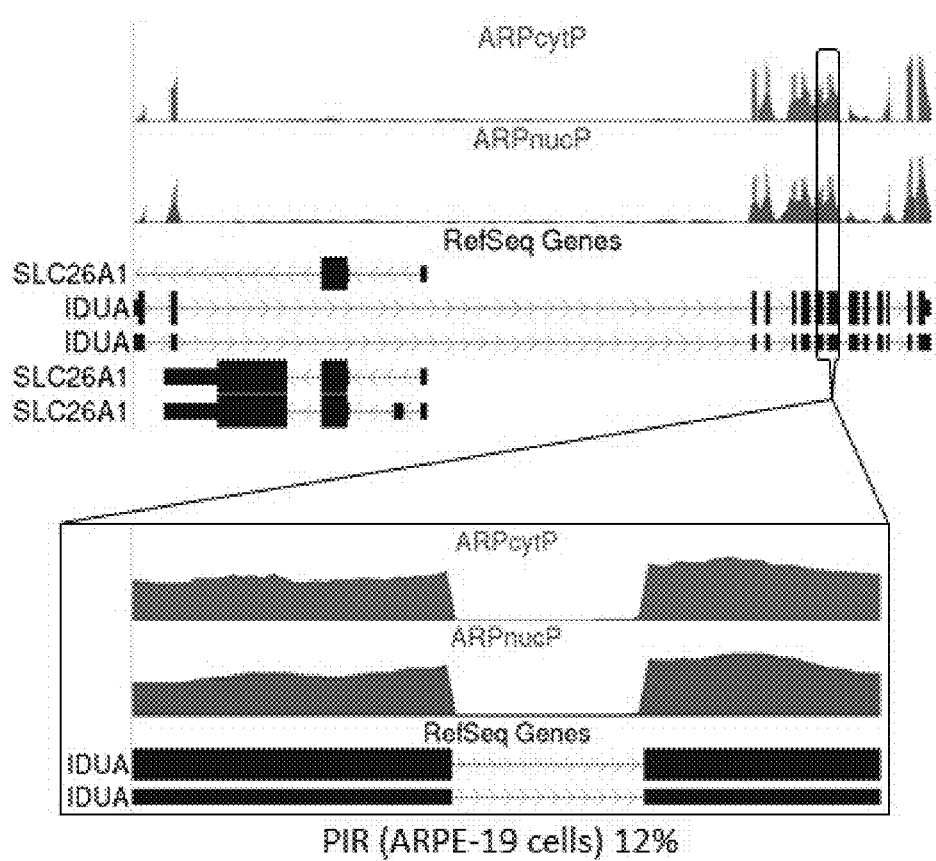
FIG. 119 depicts a schematic of the RefSeq Genes for IDUA corresponding to NM_000203 and NR_110313. The Percent Intron Retention (PIR) of the circled intron is shown.

Example 32: Improved Splicing Efficiency Via ASO-Targeting of a Retained Intron Increases IDUA Transcript Levels To determine an increase in target gene intron splicing efficiency with ASOs we used the method described herein. ARPE-19 cells, a human retinal epithelium cell line (American Type Culture Collection (ATCC), USA) were mock-transfected, or transfected with the targeting ASOs described in Table 9. Cells were transfected using Lipofectamine RNAiMax transfection reagent (Thermo Fisher) according to vendor's specifications. Briefly, ASOs were plated in 96-well tissue culture plates and combined with RNAiMax diluted in Opti-MEM. Cells were detached using trypsin and resuspended in full medium, and approximately 25,000 cells were added the ASO-transfection mixture. Transfection experiments were carried out in triplicate plate replicates. Final ASO concentration was 80 nM. Media was changed 6h post-transfection, and cells harvested at 24h, using the Cells-to-Ct lysis reagent, supplemented with DNAse (Thermo Fisher), according to vendor's specifications. cDNA was generated with Cells-to-Ct RT reagents (Thermo Fisher) according to vendor's specifications. To quantify the amount of splicing at the intron of interest, quantitative PCR was carried out using Taqman assays with probes spanning the corresponding exon-exon junction (Thermo Fisher). Taqman assays were carried out according to vendor's specifications, on a QuantStudio 7 Flex Real-Time PCR system (Thermo Fisher). Target gene assay values were normalized to RPL32 (deltaCt) and plate-matched mock transfected samples (delta-delta Ct), generating fold-change over mock quantitation (2^-(delta-deltaCt). Average fold-change over mock of the three plate replicates is plotted (FIG. 115). Several ASOs were identified that increased the target gene expression, as shown in FIG. 115, implying an increase in splicing at that target intron. Together with whole transcriptome data confirming retention of the target intron (FIG. 114, FIG. 116, FIG. 117, FIG. 118, and FIG. 119), these results confirm that ASOs can improve the splicing efficiency of a rate limiting intron.

Figure 120:
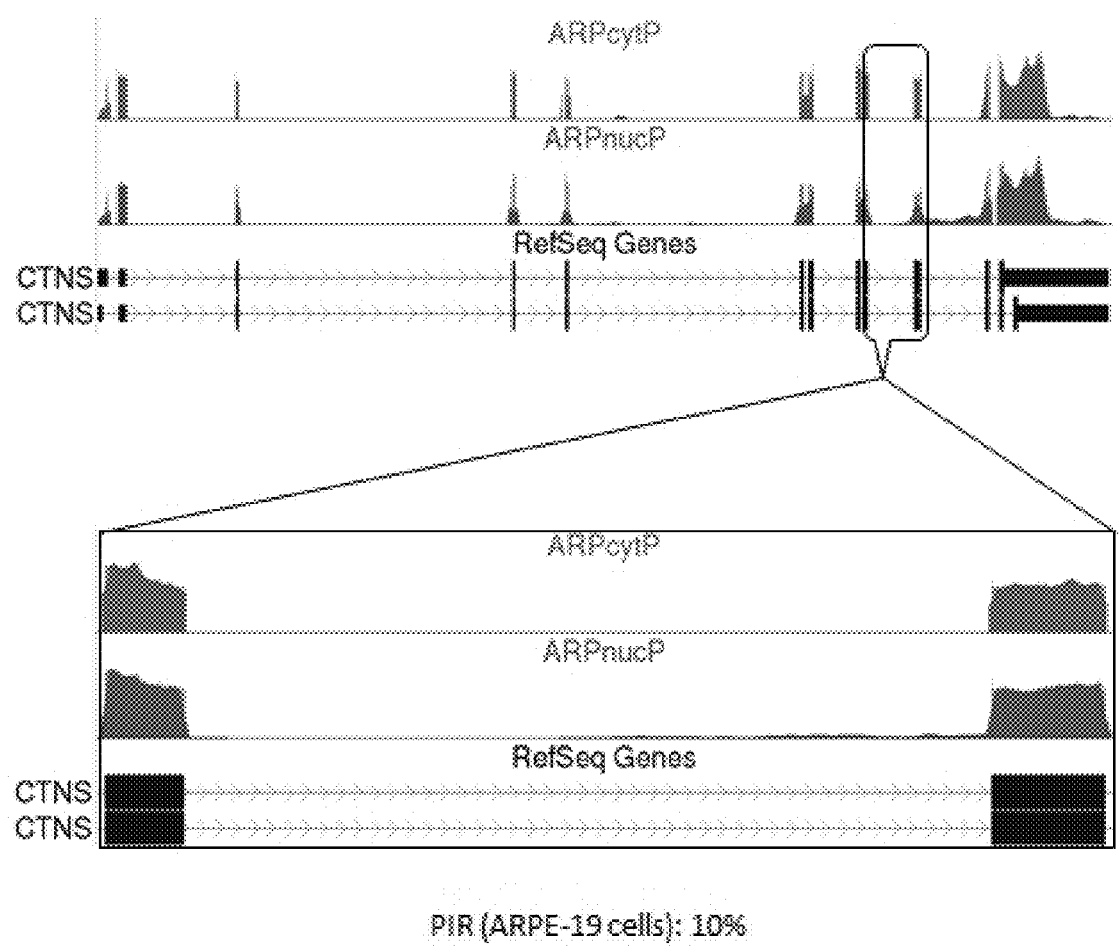
FIG. 120 depicts a schematic of the RefSeq Genes for CTNS corresponding to NM_004937 and NM_001031681. The Percent Intron Retention (PIR) of the circled intron is shown.
Figure 121:
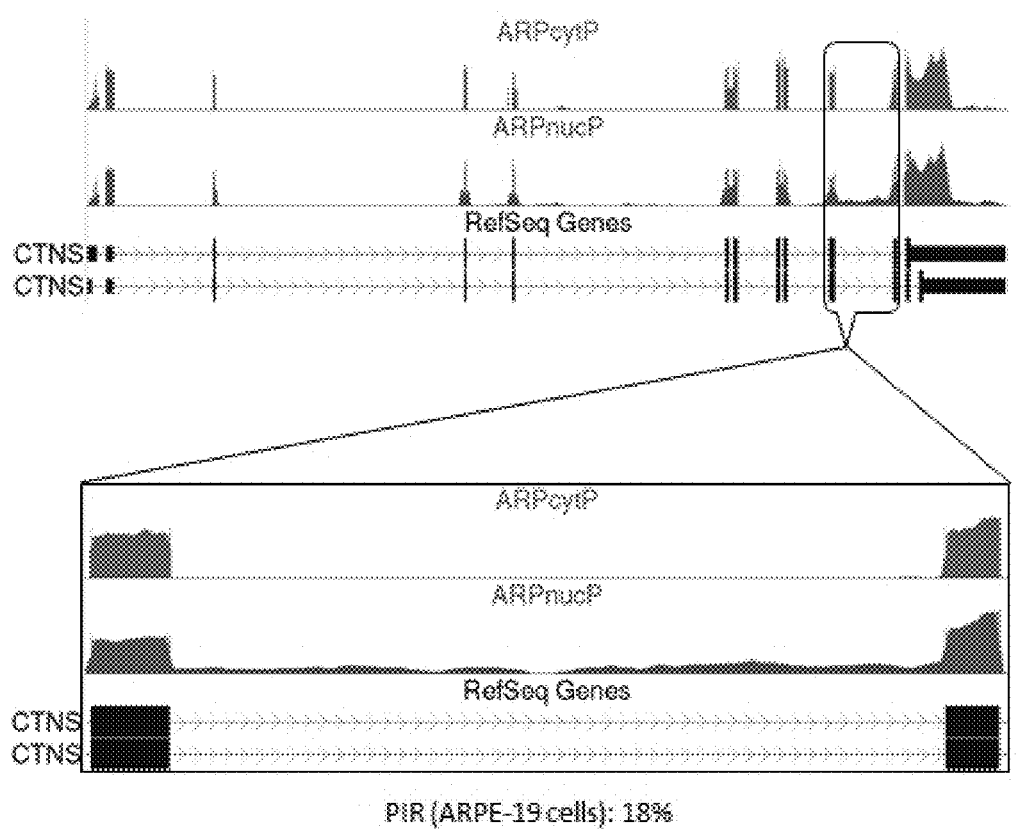

Example 33: Improved Splicing Efficiency Via ASO-Targeting of a Retained Intron Increases CTNS Transcript Levels To determine an increase in target gene intron splicing efficiency with ASOs we used the method described herein. ARPE-19 cells, a human retinal epithelium cell line (American Type Culture Collection (ATCC), USA) were mock-transfected, or transfected with the targeting ASOs described in Table 9. Cells were transfected using Lipofectamine RNAiMax transfection reagent (Thermo Fisher) according to vendor's specifications. Briefly, ASOs were plated in 96-well tissue culture plates and combined with RNAiMax diluted in Opti-MEM. Cells were detached using trypsin and resuspended in full medium, and approximately 25,000 cells were added the ASO-transfection mixture. Transfection experiments were carried out in triplicate plate replicates. Final ASO concentration was 80 nM. Media was changed 6h post-transfection, and cells harvested at 24h, using the Cells-to-Ct lysis reagent, supplemented with DNAse (Thermo Fisher), according to vendor's specifications. cDNA was generated with Cells-to-Ct RT reagents (Thermo Fisher) according to vendor's specifications. To quantify the amount of splicing at the intron of interest, quantitative PCR was carried out using Taqman assays with probes spanning the corresponding exon-exon junction (Thermo Fisher). Taqman assays were carried out according to vendor's specifications, on a QuantStudio 7 Flex Real-Time PCR system (Thermo Fisher). Target gene assay values were normalized to RPL32 (deltaCt) and plate-matched mock transfected samples (delta-delta Ct), generating fold-change over mock quantitation (2^-(delta-deltaCt). Average fold-change over mock of the three plate replicates is plotted (FIG. 122). Several ASOs were identified that increased the target gene expression, as shown in FIG. 122, implying an increase in splicing at that target intron. Together with whole transcriptome data confirming retention of the target intron (FIG. 120 and FIG. 121), these results confirm that ASOs can improve the splicing efficiency of a rate limiting intron.

Example 34: Identification of Intron Retention Events in AMT, ADA, PPDX, UROD, HMBS, ACADVL, PC, IVD, GALT, LDLRAP1, POGLUT1, PIK3R1, TRIB1, TGFB1, PNPLA3, ATP7B, FAH, ASL, HFE, ALMS1, PPARD, IL6, HSD3B7, CERS2 and NCOA5 Transcripts by RNAseq Using Next Generation Sequencing Whole transcriptome shotgun sequencing was carried out using next generation sequencing to reveal a snapshot of transcripts produced by the AMT, ADA, PPDX, UROD, HMBS, ACADVL, PC, IVD, GALT, LDLRAP1, POGLUT1, PIK3R1, TRIB1, TGFB1, PNPLA3, ATP7B, FAH, ASL, HFE, ALMS1, PPARD, IL6, HSD3B7, CERS2 and NCOA5 genes described herein to identify intron-retention events. For this purpose, polyA+ RNA from nuclear and cytoplasmic fractions of THLE-3 (human liver epithelial) cells was isolated and cDNA libraries constructed using Illumina's TruSeq Stranded mRNA library Prep Kit. The libraries were pair-end sequenced resulting in 100-nucleotide reads that were mapped to the human genome (February 2009, GRCh37/hg19 assembly). The mapped reads were visualized using the UCSC genome browser (operated by the UCSC Genome Informatics Group (Center for Biomolecular Science & Engineering, University of California, Santa Cruz, 1156 High Street, Santa Cruz, Calif. 95064) and described by, e.g., Rosenbloom, et al., 2015, "The UCSC Genome Browser database: 2015 update," Nucleic Acids Research 43, Database Issue, doi: 10.1093/nar/gku1177) and the coverage and number of reads were inferred by the peak signals. The height of the peaks indicates the level of expression given by the density of the reads in a particular region. A schematic representation of the gene was provided by the UCSC genome browser so that peaks could be matched to the exonic and intronic regions. Based on this display, introns were identified that have high read density in the nuclear fraction of THLE-3 cells, but have very low to no reads in the cytoplasmic fraction of these cells (see Table 10 and 11 and FIGS. for percent intron retention (PIR) data obtained). This indicated that these introns were retained and that the intron-containing transcripts remain in the nucleus, and suggested that these retained RIC pre-mRNAs are non-productive, as they were not exported out to the cytoplasm.

Example 35: Identification of Intron Retention Events in APOA5, HNF4A, GCK, HNF1A, HAMP, and THPO Transcripts by RNAseq Using Next Generation Sequencing Whole transcriptome shotgun sequencing was carried out using next generation sequencing to reveal a snapshot of transcripts, e.g., those produced by the APOA5, HNF4A, GCK, HNF1A, HAMP, and THPO genes described herein, to identify intron-retention events. For this purpose, polyA+ RNA from nuclear and cytoplasmic fractions of THLE-3 (human liver epithelial) cells was isolated and cDNA libraries constructed using Illumina's TruSeq Stranded mRNA library Prep Kit. The libraries were pair-end sequenced resulting in 100-nucleotide reads that were mapped to the human genome (February 2009, GRCh37/hg19 assembly). The mapped reads were visualized using the UCSC genome browser (operated by the UCSC Genome Informatics Group (Center for Biomolecular Science & Engineering, University of California, Santa Cruz, 1156 High Street, Santa Cruz, Calif. 95064) and described by, e.g., Rosenbloom, et al., 2015, "The UCSC Genome Browser database: 2015 update," Nucleic Acids Research 43, Database Issue, doi: 10.1093/nar/gku1177) and the coverage and number of reads were inferred by the peak signals. The height of the peaks indicated the level of expression given by the density of the reads in a particular region. A schematic representation of the gene was provided by the UCSC genome browser so that peaks could be matched to the exonic and intronic regions. Based on this display, introns were identified that have high read density in the nuclear fraction of THLE-3 cells, but have very low to no reads in the cytoplasmic fraction of these cells (see Table 10 and 11 and FIGS. for percent intron retention (PIR) data obtained). This indicated that these introns were retained and that the intron-containing transcripts remained in the nucleus, and suggested that these retained RIC pre-mRNAs were non-productive, as they were not exported out to the cytoplasm.

Example 36: Design of ASO-Walk Targeting a Retained Intron

An ASO walk was designed to target a retained intron using the method described herein. A region immediately downstream of the intron 5' splice site, e.g., spanning nucleotides +6 to +69 and a region immediately upstream of intron 3' splice site, e.g., spanning nucleotides −16 to −79 of the intron was targeted with 2'-O-Me RNA, PS backbone, 18-mer ASOs shifted by 5-nucleotide intervals. Table 10 lists retained introns in genes of interest in THLE-3 cells. Table 11 lists exemplary ASOs that were designed and their target sequences.

TABLE 10

| Gene Symbol | Gene ID | RNA Accession Number | Retained Intron (Percent Intron Retention) |
|---|---|---|---|
| AMT | 275 | NM_000481 | Intron 4 (39%) |
|  |  |  | Intron 6 (15%) |
| ADA | 100 | NM_000022 | Intron 4 (11%) |
|  |  |  | Intron 11 (12%) |
|  |  |  | Intron 7 (N/A) |
| PPOX | 5498 | NM_000309 | Intron 5 (59%) |
|  |  |  | Intron 4 (22%) |
|  |  |  | Intron 8 (18%) |
|  |  |  | Intron 12 (18%) |
| UROD | 7389 | NM_000374 | Intron 3 (20%) |
|  |  |  | Intron 4 (17%) |
|  |  |  | Intron 5 (14%) |
|  |  |  | Intron 6 (19%) |
|  |  |  | Intron 7 (18%) |
| HMBS | 3145 | NM_000190 | Intron 8 (15%) |
|  |  |  | Intron 9 (12%) |
| ACADVL | 37 | NM_000018 | Intron 3 (N/A) |
|  |  |  | Intron 5 (N/A) |
|  |  |  | Intron 8 (N/A) |
|  |  |  | Intron 9 (N/A) |
|  |  |  | Intron 10 (15%) |
|  |  |  | Intron 13 (15%) |
| PC | 5091 | NM_022172 | Intron 16 (25%) |
| IVD | 3712 | NM_002225 | Intron 7 (22%) |
|  |  |  | Intron 9 (13%) |
|  |  |  | Intron 11 (23%) |
| APOA5 | 116519 | No reads | No reads |
| GALT | 2592 | NM_000155 | Intron 5 (13%) |
|  |  |  | Intron 7 (21%) |
|  |  |  | Intron 10 (15%) |
|  |  |  | Intron 2 (N/A) |
|  |  |  | Intron 3 (N/A) |
|  |  |  | Intron 4 (N/A) |
|  |  |  | Intron 8 (N/A) |
|  |  |  | Intron 9 (N/A) |
| LDLRAP1 | 26119 | NM_015627 | Intron 1 (12%) |
|  |  |  | Intron 8 (12%) |
| GCK | 2645 | No reads | No reads |
| POTGLUT1 | 56983 | NM_152305 | Intron 1 (18%) |
| POTGLUT1 | 56983 | NR_024265 | Intron 4 (47%) |
|  |  |  | Intron 5 (44%) |
| PIK3R1 | 5295 | NM_181523 | Intron 3 (7%) |
|  |  |  | Intron 9 (11%) |
| HNF1A | 6927 | No reads | No reads |
| TRIB1 | 10221 | NM_025195 | Intron 2 (48%) |
|  |  |  | Intron 1 (N/A) |
| TGFB1 | 7040 | NM_000660 | Intron 4 (N/A) |
| HAMP | 57817 | No reads | No reads |
| THPO | 7066 | No reads | No reads |
| PNPLA3 | 80339 | NM_025225 | Intron 1 (8%) |
|  |  |  | Intron 4 (34%) |
|  |  |  | Intron 5 (16%) |
|  |  |  | Intron 7 (41%) |
| ATP7B | 540 | NM_000053 | Intron 7 (N/A) |
|  |  |  | Intron 13 (8%) |
| FAH | 2184 | NM_000137 | Intron 1 (N/A) |
| ASL | 435 | NM_000048 | Intron 7 (24%) |
|  |  |  | Intron 8 (N/A) |
|  |  |  | Intron 9 (23%) |
|  |  |  | Intron 16 (16%) |
| HFE | 3077 | NM_000410 | Intron 2 (N/A) |
| ALMS1 | 7840 | NM_015120 | Intron 21 (60%) |
| PPARD | 5467 | NM_006238 | Intron 3 (20%) |
|  |  |  | Intron 4 (18%) |
|  |  |  | Intron 5 (12%) |
|  |  |  | Intron 6 (17%) |
|  |  |  | Intron 7 (N/A) |
| IL6 | 3569 | NM_000600 | Intron 1 (N/A) |
|  |  |  | Intron 2 (10%) |
|  |  |  | Intron 3 (10%) |
|  |  |  | Intron 4 (N/A) |

TABLE 10-continued

| Gene Symbol | Gene ID | RNA Accession Number | Retained Intron (Percent Intron Retention) |
|---|---|---|---|
| HSD3B7 | 80270 | NM_001142777 | Intron 1 (74%) |
| | | | Intron 2 (25%) |
| | | | Intron 3 (14%) |
| | | | Intron 4 (22%) |

TABLE 10-continued

| Gene Symbol | Gene ID | RNA Accession Number | Retained Intron (Percent Intron Retention) |
|---|---|---|---|
| HSD3B7 | 80270 | NM_025193 | Intron 5 (12%) |
| | | | Intron 6 (24%) |
| CERS2 | 29956 | NM_022075 | Intron 6 (13%) |
| NCOA5 | 57727 | NM_020967 | Intron 2 (22%) |

TABLE 11

| Gene SEQ ID NO. | Pre-mRNA SEQ ID NO. | ASOs SEQ ID NOs. | Retained Intron | Target Sequence SEQ ID NO. |
|---|---|---|---|---|
| LDLRAP1 SEQ ID NO. 61504 | LDLRAP1: NM_015627 SEQ ID NO. 61535 | 61634-62185 | 8 | 139857 |
| | | 62186-62428 | 1 | 139962 |
| UROD SEQ ID NO. 61505 | UROD: NM_000374 SEQ ID NO. 61536 | 62429-62467 | 3 | 139913 |
| | | 62468-62562 | 4 | 139889 |
| | | 62563-62653 | 5 | 139914 |
| | | 62654-62782 | 6 | 139963 |
| | | 62783-62855 | 7 | 139966 |
| | UROD: NR_036510 SEQ ID NO. 61537 | 62856-62894 | 3 | 139913 |
| | | 62895-62989 | 4 | 139889 |
| | | 62990-63080 | 5 | 139914 |
| | | 63081-63209 | 6 | 139963 |
| | | 63210-63282 | 7 | 139966 |
| CERS2 SEQ ID NO. 61506 | CERS2: NM_022075 SEQ ID NO. 61538 | 63283-63342 | 6 | 139950 |
| | CERS2: NM_181746 SEQ ID NO. 61539 | 63343-63402 | 6 | 139950 |
| PPOX SEQ ID NO. 61507 | PPOX: NM_000309 SEQ ID NO. 61540 | 63403-63462 | 8 | 139964 |
| | | 63463-63563 | 5 | 139976 |
| | | 63664-63613 | 12 | 139983 |
| | | 63614-63752 | 4 | 139924 |
| | PPOX: NM_001122764 SEQ ID NO. 61541 | 63753-63812 | 8 | 139964 |
| | | 63813-63913 | 5 | 139976 |
| | | 63914-63963 | 12 | 139983 |
| | | 63964-64102 | 4 | 139924 |
| ALMS1 SEQ ID NO. 61508 | ALMS1: NM_015120 SEQ ID NO. 61542 | 64103-64315 | 21 | 139902 |
| AMT SEQ ID NO. 61509 | AMT: NM_001164710 SEQ ID NO. 61543 | 64316-64530 | 3 | 139986 |
| | | 64531-64613 | 5 | 139968 |
| | AMT: NM_001164711 SEQ ID NO. 61544 | 64614-64730 | 3 | 139937 |
| | | 64731-64813 | 5 | 139968 |
| | AMT: NM_001164712 SEQ ID NO. 61545 | 64814-64930 | 4 | 139937 |
| | | 64931-65013 | 6 | 139968 |
| | AMT: NM_000481 SEQ ID NO. 61546 | 65014-65130 | 4 | 139937 |
| | | 65131-65213 | 6 | 139968 |
| | AMT: NR_028435 SEQ ID NO. 61547 | 65214-65330 | 4 | 139937 |
| | | 65331-65413 | 6 | 139968 |
| POGLUT1 SEQ ID NO. 61510 | POGLUT1: NM_152305 SEQ ID NO. 61548 | 65414-65595 | 1 | 61503 |
| | | 65596-65836 | 4 | 139853 |
| | | 65837-66062 | 5 | 139935 |
| | POGLUT1: NR_024265 SEQ ID NO. 61549 | 66063-66234 | 1 | 61503 |
| | | 66235-66513 | 4 | 139942 |
| | | 66514-66767 | 5 | 139892 |
| THPO SEQ ID NO. 61511 | THPO: NM_001289998 SEQ ID NO. 61550 | 66768-67028 | 2 | 139928 |
| | | 67029-67119 | 3 | 139903 |
| | | 67120-67207 | 4 | 139896 |
| | | 67208-67446 | 5 | 139854 |
| | | 67447-67747 | 6 | 139884 |
| | THPO: NM_001177598 SEQ ID NO. 61551 | 67748-67976 | 1 | 139869 |
| | | 67977-68067 | 2 | 139903 |
| | | 68068-68155 | 3 | 139896 |
| | | 68156-68394 | 4 | 139854 |
| | | 68395-68695 | 5 | 139960 |
| | THPO: NM_001290022 SEQ ID NO. 61552 | 68696-68956 | 2 | 139928 |
| | | 68957-69047 | 3 | 139903 |
| | | 69048-69135 | 4 | 139896 |
| | | 69136-69373 | 5 | 139854 |
| | | 69374-69675 | 6 | 139946 |

TABLE 11-continued

| Gene SEQ ID NO. | Pre-mRNA SEQ ID NO. | ASOs SEQ ID NOs. | Retained Intron | Target Sequence SEQ ID NO. |
|---|---|---|---|---|
| | THPO: NM_001290003 SEQ ID NO. 61553 | 69676-69936 | 2 | 139928 |
| | | 69937-70027 | 3 | 139903 |
| | | 70028-70115 | 4 | 139896 |
| | | 70116-70354 | 5 | 139854 |
| | | 70355-70655 | 6 | 139884 |
| | THPO: NM_001289997 SEQ ID NO. 61554 | 70656-70884 | 1 | 139869 |
| | | 70885-70975 | 2 | 139903 |
| | | 70976-71063 | 3 | 139896 |
| | | 71064-71302 | 4 | 139854 |
| | | 71303-71391 | 5 | 139865 |
| | THPO: NM_000460 SEQ ID NO. 61555 | 71392-71620 | 1 | 139869 |
| | | 71621-71711 | 2 | 139903 |
| | | 71711-71799 | 3 | 139896 |
| | | 71800-72038 | 4 | 139854 |
| | | 72039-72339 | 5 | 139884 |
| | THPO: NM_001177597 SEQ ID NO. 61556 | 72340-72568 | 1 | 139869 |
| | | 72569-72659 | 2 | 139903 |
| | | 72660-72747 | 3 | 139896 |
| | | 72748-72986 | 4 | 139854 |
| | | 72987-73287 | 5 | 139946 |
| | THPO: NM_001290028 SEQ ID NO. 61557 | 73288-73508 | 1 | 139949 |
| | | 73509-73599 | 2 | 139903 |
| | | 73600-73687 | 3 | 139896 |
| | | 73688-73926 | 4 | 139854 |
| | | 73927-74227 | 5 | 139884 |
| | THPO: NM_001290027 SEQ ID NO. 61558 | 74228-74488 | 2 | 139928 |
| | | 74489-74579 | 3 | 139903 |
| | | 74580-74667 | 4 | 139896 |
| | | 74668-74906 | 5 | 139854 |
| | | 74907-74995 | 6 | 139865 |
| | THPO: NM_001290026 SEQ ID NO. 61559 | 74996-75256 | 2 | 139928 |
| | | 75257-75347 | 3 | 139903 |
| | | 75348-75435 | 4 | 139896 |
| | | 75436-75674 | 5 | 139854 |
| | | 75675-75975 | 6 | 139960 |
| PIK3R1 SEQ ID NO. 61512 | PIK3R1: NM_181523 SEQ ID NO. 61560 | 75976-76047 | 9 | 139893 |
| | | 76048-76163 | 3 | 139921 |
| | PIK3R1: NM_181524 SEQ ID NO. 61561 | 76164-76235 | 3 | 139893 |
| | PIK3R1: NM_181504 SEQ ID NO. 61562 | 76236-76307 | 3 | 139893 |
| | PIK3R1: NM_001242466 SEQ ID NO. 61563 | 76308-76379 | 2 | 139893 |
| PPARD SEQ ID NO. 61513 | PPARD: NM_006238 SEQ ID NO. 61564 | 76380-76636 | 3 | 139917 |
| | | 76637-76879 | 4 | 139981 |
| | | 76880-77131 | 5 | 139975 |
| | | 77132-77291 | 6 | 139860 |
| | | 77292-77982 | 7 | 139898 |
| | PPARD: NM_177435 SEQ ID NO. 61565 | 77983-78239 | 3 | 139917 |
| | | 78240-78482 | 4 | 139981 |
| | | 78483-78734 | 5 | 139975 |
| | | 78735-79015 | 6 | 139862 |
| | PPARD: NM_001171818 SEQ ID NO. 61566 | 79016-79706 | 8 | 139898 |
| | | 79707-79963 | 4 | 139917 |
| | | 79964-80206 | 5 | 139981 |
| | | 80207-80458 | 6 | 139975 |
| | | 80459-80618 | 7 | 139860 |
| | PPARD: NM_001171819 SEQ ID NO. 61567 | 80619-80848 | 2 | 139877 |
| | | 80849-81091 | 3 | 139981 |
| | | 81092-81343 | 4 | 139975 |
| | | 81344-81503 | 5 | 139860 |
| | | 81504-82194 | 6 | 139898 |
| | PPARD: NM_001171820 SEQ ID NO. 61568 | 82195-82461 | 3 | 139993 |
| | | 82462-82621 | 4 | 139860 |
| | | 82622-83312 | 5 | 139898 |
| HFE SEQ ID NO. 61514 | HFE: NM_139007 SEQ ID NO. 61569 | 83313-83586 | 1 | 139922 |
| | HFE: NM_139006 SEQ ID NO. 61570 | 83587-83730 | 2 | 139887 |
| | HFE: NM_139004 SEQ ID NO. 61571 | 83731-84016 | 2 | 140003 |

TABLE 11-continued

| Gene SEQ ID NO. | Pre-mRNA SEQ ID NO. | ASOs SEQ ID NOs. | Retained Intron | Target Sequence SEQ ID NO. |
|---|---|---|---|---|
| | HFE: NM_139003 SEQ ID NO. 61572 | 84017-84296 | 2 | 139927 |
| | HFE: NM_001300749 SEQ ID NO. 61573 | 84297-84440 | 2 | 139887 |
| | HFE: NM_139009 SEQ ID NO. 61574 | 84441-84570 | 2 | 139969 |
| | HFE: NM_139008 SEQ ID NO. 61575 | 84571-84844 | 1 | 139922 |
| | HFE: NM_000410 SEQ ID NO. 61576 | 84845-84988 | 2 | 139887 |
| IL6 SEQ ID NO. 61515 | IL6: NM_001318095 SEQ ID NO. 61577 | 84989-85209 | 1 | 139939 |
| | | 85210-85394 | 2 | 139916 |
| | | 85395-85725 | 3 | 139918 |
| | IL6: NM_000600 SEQ ID NO. 61578 | 85726-85808 | 1 | 139901 |
| | | 85809-86044 | 2 | 139906 |
| | | 86045-86229 | 3 | 139916 |
| | | 86230-86560 | 4 | 139918 |
| GCK SEQ ID NO. 61516 | GCK: NM_033508 SEQ ID NO. 61579 | 86561-86788 | 1 | 139948 |
| | | 86789-86998 | 2 | 139984 |
| | | 86999-87216 | 3 | 139882 |
| | | 87217-87444 | 4 | 139934 |
| | | 87445-87647 | 5 | 139972 |
| | | 87648-87700 | 6 | 139911 |
| | | 87701-87934 | 7 | 139880 |
| | | 87935-88177 | 8 | 139920 |
| | | 88178-88385 | 9 | 139890 |
| | | 88386-88646 | 10 | 139958 |
| | GCK: NM_000162 SEQ ID NO. 61580 | 88647-88937 | 1 | 139987 |
| | | 88938-89155 | 2 | 139882 |
| | | 89156-89383 | 3 | 139934 |
| | | 89384-89586 | 4 | 139972 |
| | | 89587-89639 | 5 | 139911 |
| | | 89640-89873 | 6 | 139880 |
| | | 89874-90116 | 7 | 139920 |
| | | 90117-90324 | 8 | 139890 |
| | | 90325-90585 | 9 | 139958 |
| | GCK: NM_033507 SEQ ID NO. 61581 | 90586-90831 | 1 | 139873 |
| | | 90832-91049 | 2 | 139882 |
| | | 91050-91277 | 3 | 139934 |
| | | 91278-91480 | 4 | 139972 |
| | | 91481-91533 | 5 | 139911 |
| | | 91534-91767 | 6 | 139880 |
| | | 91768-92010 | 7 | 139920 |
| | | 92011-92218 | 8 | 139890 |
| | | 92219-92479 | 9 | 139958 |
| ASL SEQ ID NO. 61517 | ASL: NM_000048 SEQ ID NO. 61582 | 92480-92597 | 8 | 139997 |
| | | 92598-92672 | 9 | 139907 |
| | | 92673-92815 | 16 | 139874 |
| | | 92816-92855 | 7 | 139868 |
| | ASL: NM_001024943 SEQ ID NO. 61583 | 92856-92930 | 8 | 139907 |
| | | 92931-93073 | 15 | 139874 |
| | | 93074-93113 | 6 | 139868 |
| | | 93114-93231 | 7 | 139997 |
| | ASL: NM_001024944 SEQ ID NO. 61584 | 93232-93306 | 8 | 139907 |
| | | 93307-93346 | 6 | 139868 |
| | | 93347-93489 | 14 | 139874 |
| | | 93490-93607 | 7 | 139997 |
| | ASL: NM_001024946 SEQ ID NO. 61585 | 93608-93750 | 14 | 139874 |
| | | 93751-93896 | 6 | 139856 |
| | | 93897-386184 | 7 | 139907 |
| TRIB1 SEQ ID NO. 61518 | TRIB1: NM_025195 SEQ ID NO. 61586 | 93972-94373 | 1 | 139990 |
| | | 94374-95069 | 2 | 139989 |
| | TRIB1: NM_001282985 SEQ ID NO. 61587 | 95070-95327 | 1 | 139989 |
| | | 95328-96023 | 2 | 139989 |
| GALT SEQ ID NO. 61519 | GALT: NM_000155 SEQ ID NO. 61588 | 96024-96104 | 2 | 139992 |
| | | 96105-96137 | 3 | 139919 |
| | | 96138-96188 | 4 | 139919 |
| | | 96189-96243 | 5 | 139855 |
| | | 96244-96338 | 7 | 139938 |
| | | 96339-96387 | 8 | 139996 |
| | | 96388-96491 | 9 | 139926 |
| | | 96492-96719 | 10 | 139940 |

TABLE 11-continued

| Gene SEQ ID NO. | Pre-mRNA SEQ ID NO. | ASOs SEQ ID NOs. | Retained Intron | Target Sequence SEQ ID NO. |
|---|---|---|---|---|
| | GALT: NM_001258332 SEQ ID NO. 61589 | 96720-96871 | 2 | 139952 |
| | | 96872-96926 | 3 | 139855 |
| | | 96927-97021 | 5 | 139938 |
| | | 97022-97070 | 6 | 139996 |
| | | 97071-97174 | 7 | 139926 |
| | | 97175-97402 | 8 | 139940 |
| PC SEQ ID NO. 61520 | PC: NM_000920 SEQ ID NO. 61590 | 97403-97533 | 17 | 139998 |
| | PC: NM_001040716 SEQ ID NO. 61591 | 97534-97664 | 18 | 139998 |
| | PC: NM_022172 SEQ ID NO. 61592 | 97665-97795 | 16 | 139998 |
| APOA5 SEQ ID NO. 61521 | APOA5: NM_052968 SEQ ID NO. 61593 | 97796-97900 | 1 | 139910 |
| | | 97901-97958 | 2 | 140002 |
| | | 97959-98393 | 3 | 139923 |
| | APOA5: NM_001166598 SEQ ID NO. 61594 | 98394-98497 | 1 | 139875 |
| | | 98498-98550 | 2 | 139900 |
| | | 98551-98985 | 3 | 139923 |
| HMBS SEQ ID NO. 61522 | HMBS: NM_000190 SEQ ID NO. 61595 | 98986-99057 | 10 | 139858 |
| | | 99058-99135 | 11 | 139970 |
| | HMBS: NM_001258208 SEQ ID NO. 61596 | 99136-99266 | 10 | 139957 |
| | HMBS: NM_001024382 SEQ ID NO. 61597 | 99267-99338 | 10 | 139858 |
| | | 99339-99416 | 11 | 139970 |
| | HMBS: NM_001258209 SEQ ID NO. 61598 | 99417-99547 | 10 | 139957 |
| HNF1A SEQ ID NO. 61523 | HNF1A: NM_000545 SEQ ID NO. 61599 | 99548-99864 | 1 | 139956 |
| | | 99865-100124 | 2 | 139864 |
| | | 100125-100281 | 3 | 139866 |
| | | 100282-100533 | 4 | 139936 |
| | | 100534-100610 | 5 | 139941 |
| | | 100611-100812 | 6 | 139933 |
| | | 100813-101046 | 7 | 139991 |
| | | 101047-101101 | 8 | 139965 |
| | | 101102-101576 | 9 | 139971 |
| | HNF1A: NM_001306179 SEQ ID NO. 61600 | 101577-101893 | 1 | 139956 |
| | | 101894-102153 | 2 | 139864 |
| | | 102154-102310 | 3 | 139866 |
| | | 102311-103012 | 4 | 139936 |
| | | 103013-102639 | 5 | 139941 |
| | | 102640-102841 | 6 | 139933 |
| | | 102842-103075 | 7 | 139991 |
| | | 103076-103131 | 8 | 139908 |
| | | 103132-103608 | 9 | 139995 |
| ATP7B SEQ ID NO. 61524 | ATP7B: NM_001243182 SEQ ID NO. 61601 | 103609-103870 | 8 | 139930 |
| | | 103871-104118 | 14 | 139886 |
| | ATP7B: NM_000053 SEQ ID NO. 61602 | 104119-104366 | 13 | 139886 |
| | | 104367-104628 | 7 | 139930 |
| | ATP7B: NM_001005918 SEQ ID NO. 61603 | 104629-104876 | 9 | 139886 |
| | ATP7B: NM_001330579 SEQ ID NO. 61604 | 104877-105124 | 11 | 139886 |
| | | 105125-105389 | 5 | 139947 |
| | ATP7B: NM_001330578 SEQ ID NO. 61605 | 105390-105637 | 12 | 139886 |
| | | 105638-105873 | 7 | 139897 |
| FAH SEQ ID NO. 61525 | FAH: NM_000137 SEQ ID NO. 61606 | 105874-106128 | 1 | 139885 |
| IVD SEQ ID NO. 61526 | IVD: NM_001159508 SEQ ID NO. 61607 | 106129-106278 | 8 | 139967 |
| | | 106279-107101 | 10 | 139878 |
| | | 107102-107322 | 6 | 139883 |
| | IVD: NM_002225 SEQ ID NO. 61608 | 107323-107472 | 9 | 139967 |
| | | 107473-108295 | 11 | 139878 |
| | | 108296-108516 | 7 | 139883 |
| HSD3B7 SEQ ID NO. 61527 | HSD3B7: NM_001142777 SEQ ID NO. 61609 | 108517-108618 | 1 | 139852 |
| | | 108619-108747 | 2 | 139973 |
| | | 108748-108828 | 3 | 140001 |
| | | 108829-108873 | 4 | 139909 |
| | | 108874-109328 | 5 | 139945 |

TABLE 11-continued

| Gene SEQ ID NO. | Pre-mRNA SEQ ID NO. | ASOs SEQ ID NOs. | Retained Intron | Target Sequence SEQ ID NO. |
|---|---|---|---|---|
| | HSD3B7: NM_001142778 SEQ ID NO. 61610 | 109329-109427 | 1 | 139954 |
| | | 109428-109524 | 2 | 139899 |
| | | 109525-109605 | 3 | 140001 |
| | | 109606-109650 | 4 | 139909 |
| | | 109651-110105 | 5 | 139945 |
| | HSD3B7: NM_025193 SEQ ID NO. 61611 | 110106-110204 | 1 | 139954 |
| | | 110205-110301 | 2 | 139899 |
| | | 110302-110382 | 3 | 140001 |
| | | 110383-110427 | 4 | 139909 |
| | | 110428-110492 | 5 | 139912 |
| | | 110493-110925 | 6 | 139881 |
| ACADVL SEQ ID NO. 61528 | ACADVL: NM_001270448 SEQ ID NO. 61612 | 110926-110961 | 2 | 139870 |
| | | 110962-111015 | 4 | 139879 |
| | | 111016-111068 | 7 | 139943 |
| | | 111069-111200 | 8 | 139951 |
| | | 111201-111303 | 9 | 139980 |
| | | 111304-111349 | 12 | 139988 |
| | | 111350-111393 | 17 | 139999 |
| | | 111394-111472 | 18 | 139925 |
| | ACADVL: NM_001270447 SEQ ID NO. 61613 | 111473-111508 | 4 | 139870 |
| | | 111509-111562 | 6 | 139879 |
| | | 111563-111615 | 9 | 139943 |
| | | 111616-111747 | 10 | 139951 |
| | | 111748-111850 | 11 | 139980 |
| | | 111851-111896 | 14 | 139988 |
| | | 111897-111940 | 19 | 139999 |
| | | 111941-112019 | 20 | 139925 |
| | ACADVL: NM_000018 SEQ ID NO. 61614 | 112020-112055 | 3 | 139870 |
| | | 112056-112109 | 5 | 139879 |
| | | 112110-112162 | 8 | 139943 |
| | | 112163-112294 | 9 | 139951 |
| | | 112295-112397 | 10 | 139980 |
| | | 112398-112443 | 13 | 139988 |
| | | 112444-112487 | 18 | 139999 |
| | | 112488-112566 | 19 | 139925 |
| | ACADVL: NM_001033859 SEQ ID NO. 61615 | 112567-112661 | 2 | 139915 |
| | | 112662-112715 | 4 | 139879 |
| | | 112716-112768 | 7 | 139943 |
| | | 112769-112900 | 8 | 139951 |
| | | 112901-113003 | 9 | 139980 |
| | | 113004-113049 | 12 | 139988 |
| | | 113050-113093 | 17 | 139999 |
| | | 113094-113172 | 18 | 139925 |
| HAMP SEQ ID NO. 61529 | HAMP: NM_021175 SEQ ID NO. 61616 | 113173-113424 | 1 | 140000 |
| | | 113425-113474 | 2 | 139929 |
| TGFB1 SEQ ID NO. 61530 | TGFB1: NM_000660 SEQ ID NO. 61617 | 113475-113528 | 4 | 139961 |
| HNF4A SEQ ID NO. 61531 | HNF4A: NM_001287184 SEQ ID NO. 61618 | 113529-113770 | 2 | 139895 |
| | | 113771-114002 | 3 | 139959 |
| | | 114003-114202 | 4 | 139931 |
| | | 114203-114380 | 5 | 139994 |
| | | 114381-114614 | 6 | 140004 |
| | | 114615-114851 | 7 | 139863 |
| | | 114852-115179 | 8 | 139944 |
| | HNF4A: NM_001287183 SEQ ID NO. 61619 | 115180-115421 | 2 | 139895 |
| | | 115422-115653 | 3 | 139959 |
| | | 115654-115853 | 4 | 139931 |
| | | 115854-116031 | 5 | 139994 |
| | | 116032-116265 | 6 | 140004 |
| | | 116266-116502 | 7 | 139863 |
| | | 116503-116758 | 8 | 139932 |
| | | 116759-117011 | 9 | 139861 |
| | | 117012-117834 | 10 | 139867 |
| | HNF4A: NM_175914 SEQ ID NO. 61620 | 117835-118047 | 1 | 139978 |
| | | 118048-118279 | 2 | 139959 |
| | | 118280-118479 | 3 | 139931 |
| | | 118480-118657 | 4 | 139994 |
| | | 118658-118891 | 5 | 140004 |
| | | 118892-119128 | 6 | 139863 |
| | | 119129-119384 | 7 | 139932 |
| | | 119385-119637 | 8 | 139861 |
| | | 119638-120460 | 9 | 139867 |

TABLE 11-continued

| Gene SEQ ID NO. | Pre-mRNA SEQ ID NO. | ASOs SEQ ID NOs. | Retained Intron | Target Sequence SEQ ID NO. |
|---|---|---|---|---|
| | HNF4A: | 120461-120673 | 1 | 139978 |
| | NM_001030004 | 120674-120905 | 2 | 139959 |
| | SEQ ID NO. 61621 | 120906-121105 | 3 | 139931 |
| | | 121106-121283 | 4 | 139994 |
| | | 121284-121517 | 5 | 140004 |
| | | 121518-121754 | 6 | 139863 |
| | | 121755-122082 | 7 | 139944 |
| | HNF4A: | 122083-122324 | 2 | 139895 |
| | NM_001287182 | 122325-122556 | 3 | 139959 |
| | SEQ ID NO. 61622 | 122557-122756 | 4 | 139931 |
| | | 122757-122934 | 5 | 139994 |
| | | 122935-123168 | 6 | 140004 |
| | | 123169-123405 | 7 | 139863 |
| | | 123406-123661 | 8 | 139932 |
| | | 123662-123911 | 9 | 139894 |
| | | 123912-124730 | 10 | 139982 |
| | HNF4A: | 124731-124943 | 1 | 139978 |
| | NM_001030003 | 124944-125175 | 2 | 139959 |
| | SEQ ID NO. 61623 | 125176-125375 | 3 | 139931 |
| | | 125376-125553 | 4 | 139994 |
| | | 125554-125787 | 5 | 140004 |
| | | 125788-126024 | 6 | 139863 |
| | | 126025-126280 | 7 | 139932 |
| | | 126281-126530 | 8 | 139894 |
| | | 126531-127349 | 9 | 139982 |
| | HNF4A: | 129035-129283 | 1 | 139904 |
| | NM_000457 | 129284-129515 | 2 | 139959 |
| | SEQ ID NO. 61624 | 129516-129715 | 3 | 139931 |
| | | 129716-129893 | 4 | 139994 |
| | | 129894-130127 | 5 | 140004 |
| | | 130128-130364 | 6 | 139863 |
| | | 130365-130620 | 7 | 139932 |
| | | 130621-130873 | 8 | 139861 |
| | | 130874-131696 | 9 | 139867 |
| | HNF4A: | 131697-131939 | 1 | 139876 |
| | NM_001258355 | 131940-132151 | 2 | 139953 |
| | SEQ ID NO. 61625 | 132152-132383 | 3 | 139959 |
| | | 132384-132583 | 4 | 139931 |
| | | 132584-132761 | 5 | 139994 |
| | | 132762-132995 | 6 | 140004 |
| | | 132996-133232 | 7 | 139863 |
| | | 133233-133488 | 8 | 139932 |
| | | 133489-133741 | 9 | 139861 |
| | | 133742-134564 | 10 | 139867 |
| | HNF4A: | 134565-134813 | 1 | 139904 |
| | NM_178850 | 134814-135045 | 2 | 139959 |
| | SEQ ID NO. 61626 | 135046-135245 | 3 | 139931 |
| | | 135246-135423 | 4 | 139994 |
| | | 135424-135657 | 5 | 140004 |
| | | 135658-135894 | 6 | 139863 |
| | | 135895-136222 | 7 | 139944 |
| | HNF4A: | 136223-136471 | 1 | 139904 |
| | NM_178849 | 136472-136703 | 2 | 139959 |
| | SEQ ID NO. 61627 | 136704-136903 | 3 | 139931 |
| | | 136904-137081 | 4 | 139994 |
| | | 137082-137315 | 5 | 140004 |
| | | 137316-137552 | 6 | 139863 |
| | | 137553-137808 | 7 | 139932 |
| | | 137809-138058 | 8 | 139894 |
| | | 138059-138877 | 9 | 139982 |
| ADA SEQ ID NO. 61532 | ADA: NM_001322051 SEQ ID NO. 61628 | 127350-127517 | 10 | 139985 |
| | | 127518-127695 | 4 | 139888 |
| | ADA: NM_000022 SEQ ID NO. 61629 | 127696-127863 | 11 | 139985 |
| | | 127864-128041 | 4 | 139888 |
| | ADA: NM_001322050 SEQ ID NO. 61630 | 128042-128209 | 10 | 139985 |
| | | 128210-128438 | 4 | 139872 |
| | ADA: NR_136160 SEQ ID NO. 61631 | 128439-128606 | 10 | 139985 |
| | | 128607-128784 | 4 | 139888 |

TABLE 11-continued

| Gene SEQ ID NO. | Pre-mRNA SEQ ID NO. | ASOs SEQ ID NOs. | Retained Intron | Target Sequence SEQ ID NO. |
|---|---|---|---|---|
| NCOA5 SEQ ID NO. 61533 | NCOA5: NM_020967 SEQ ID NO. 61632 | 128785-129034 | 2 | 139955 |
| PNPLA3 SEQ ID NO. 61534 | PNPLA3: NM_025225 SEQ ID NO. 61633 | 138878-139162 | 1 | 139891 |
| | | 139173-139394 | 4 | 139905 |
| | | 139395-139621 | 5 | 139974 |
| | | 139622-139851 | 7 | 139859 |

Example 37: Improved Splicing Efficiency Via ASO-Targeting of a Retained Intron Increases AMT Transcript Levels To determine whether an increase in expression of AMT could be achieved by improving splicing efficiency of a retained intron using ASOs, the methods described herein were used. ARPE-19 cells were mock-transfected, or transfected with AMT targeting ASOs, or a non-targeting ASO control, independently, using RNAiMAX (Invitrogen) delivery reagents. Experiments were performed using 80 nM ASOs for 24 hrs (FIGS. 123A and B). Taqman qPCR results showed that several targeting ASOs increase AMT gene transcript level compared to the mock-transfected. Ct values from AMT targeting-ASO-transfected cells are normalized to RPL32 and plotted relative to the normalized qPCR product from mock-treated cells. Results of this analysis indicated that several AMT targeting ASOs increase gene transcript levels. These results show that inducing splicing of a retained intron in the gene using ASOs leads to an increase in gene expression. Altogether, these results show that improving the splicing efficiency of a rate limiting intron in the AMT gene using ASOs led to an increase in AMT gene expression.

Example 38: Improved Splicing Efficiency Via ASO-Targeting of a Retained Intron Increases GALT Transcript Levels To determine whether an increase in expression of GALT could be achieved by improving splicing efficiency of a retained intron using ASOs, the methods described herein were used. ARPE-19 cells were mock-transfected, or transfected with GALT targeting ASOs, or a non-targeting ASO control, independently, using RNAiMAX (Invitrogen) delivery reagents. Experiments were performed using 80 nM ASOs for 24 hrs (FIGS. 124C and D; and FIGS. 124G and 4H). Taqman qPCR results showed that several targeting ASOs increase GALT gene transcript level compared to the mock-transfected. Ct values from GALT targeting-ASO-transfected cells are normalized to RPL32 and plotted relative to the normalized qPCR product from mock-treated cells. Results of this analysis indicated that several GALT targeting ASOs increase gene transcript levels. These results show that inducing splicing of a retained intron in the gene using ASOs leads to an increase in gene expression. Altogether, these results show that improving the splicing efficiency of a rate limiting intron in the GALT gene using ASOs led to an increase in GALT gene expression.

Example 39: Improved Splicing Efficiency Via ASO-Targeting of a Retained Intron Increases PC Transcript Levels To determine whether an increase in expression of PC could be achieved by improving splicing efficiency of a retained intron using ASOs, the methods described herein were used. ARPE-19 cells were mock-transfected, or transfected with PC targeting ASOs, or a non-targeting ASO control, independently, using RNAiMAX (Invitrogen) delivery reagents. Experiments were performed using 80 nM ASOs for 24 hrs (FIGS. 125A and B). Taqman qPCR results showed that several targeting ASOs increase PC gene transcript level compared to the mock-transfected. Ct values from PC targeting-ASO-transfected cells are normalized to RPL32 and plotted relative to the normalized qPCR product from mock-treated cells. Results of this analysis indicated that several PC targeting ASOs increase gene transcript levels. These results show that inducing splicing of a retained intron in the gene using ASOs leads to an increase in gene expression. Altogether, these results show that improving the splicing efficiency of a rate limiting intron in the PC gene using ASOs led to an increase in PC gene expression.

Example 40: Improved Splicing Efficiency Via ASO-Targeting of a Retained Intron Increases FAH Transcript Levels To determine whether an increase in expression of FAH could be achieved by improving splicing efficiency of a retained intron using ASOs, the methods described herein were used. ARPE-19 cells were mock-transfected, or transfected with FAH targeting ASOs, or a non-targeting ASO control, independently, using RNAiMAX (Invitrogen) delivery reagents. Experiments were performed using 80 nM ASOs for 24 hrs (FIGS. 126A and B). Taqman qPCR results showed that several targeting ASOs increase FAH gene transcript level compared to the mock-transfected. Ct values from FAH targeting-ASO-transfected cells are normalized to RPL32 and plotted relative to the normalized qPCR product from mock-treated cells. Results of this analysis indicated that several FAH targeting ASOs increase gene transcript levels. These results show that inducing splicing of a retained intron in the gene using ASOs leads to an increase in gene expression. Altogether, these results show that improving the splicing efficiency of a rate limiting intron in the FAH gene using ASOs led to an increase in FAH gene expression.

Example 41: Improved Splicing Efficiency Via ASO-Targeting of a Retained Intron Increases PPARD Transcript Levels To determine whether an increase in expression of PPARD could be achieved by improving splicing efficiency of a retained intron using ASOs, the methods described herein were used. ARPE-19 cells were mock-transfected, or transfected with PPARD targeting ASOs, or a non-targeting ASO control, independently, using RNAiMAX (Invitrogen)

delivery reagents. Experiments were performed using 80 nM ASOs for 24 hrs (FIGS. 127A and B, FIGS. 127E and F). Taqman qPCR results showed that several targeting ASOs increase PPARD gene transcript level compared to the mock-transfected. Ct values from PPARD targeting-ASO-transfected cells are normalized to RPL32 and plotted relative to the normalized qPCR product from mock-treated cells. Results of this analysis indicated that several PPARD targeting ASOs increase gene transcript levels. These results show that inducing splicing of a retained intron in the gene using ASOs leads to an increase in gene expression. Altogether, these results show that improving the splicing efficiency of a rate limiting intron in the PPARD gene using ASOs led to an increase in PPARD gene expression.

Example 42: Improved Splicing Efficiency Via ASO-Targeting of a Retained Intron Increases HMBS Transcript Levels To determine whether an increase in expression of HMBS could be achieved by improving splicing efficiency of a retained intron using ASOs, the methods described herein were used. ARPE-19 cells were mock-transfected, or transfected with HMBS targeting ASOs, or a non-targeting ASO control, independently, using RNAiMAX (Invitrogen) delivery reagents. Experiments were performed using 80 nM ASOs for 24 hrs (FIGS. 129A and B). Taqman qPCR results showed that several targeting ASOs increase HMBS gene transcript level compared to the mock-transfected. Ct values from HMBS targeting-ASO-transfected cells are normalized to RPL32 and plotted relative to the normalized qPCR product from mock-treated cells. Results of this analysis indicated that several HMBS targeting ASOs increase gene transcript levels. These results show that inducing splicing of a retained intron in the gene using ASOs leads to an increase in gene expression. Altogether, these results show that improving the splicing efficiency of a rate limiting intron in the HMBS gene using ASOs led to an increase in HMBS gene expression.

Example 43: Improved Splicing Efficiency Via ASO-Targeting of a Retained Intron Increases ALMS1 Transcript Levels To determine whether an increase in expression of ALMS1 could be achieved by improving splicing efficiency of a retained intron using ASOs, the methods described herein were used. ARPE-19 cells were mock-transfected, or transfected with ALMS1 targeting ASOs, or a non-targeting ASO control, independently, using RNAiMAX (Invitrogen) delivery reagents. Experiments were performed using 80 nM ASOs for 24 hrs (FIGS. 131A and B). Taqman qPCR results showed that several targeting ASOs increase ALMS1 gene transcript level compared to the mock-transfected. Ct values from ALMS1 targeting-ASO-transfected cells are normalized to RPL32 and plotted relative to the normalized qPCR product from mock-treated cells. Results of this analysis indicated that several ALMS1 targeting ASOs increase gene transcript levels. These results show that inducing splicing of a retained intron in the gene using ASOs leads to an increase in gene expression. Altogether, these results show that improving the splicing efficiency of a rate limiting intron in the ALMS1 gene using ASOs led to an increase in ALMS1 gene expression.

Example 44: Improved Splicing Efficiency Via ASO-Targeting of a Retained Intron Increases ASL Transcript Levels To determine whether an increase in expression of ASL could be achieved by improving splicing efficiency of a retained intron using ASOs, the methods described herein were used. ARPE-19 cells were mock-transfected, or transfected with ASL targeting ASOs, or a non-targeting ASO control, independently, using RNAiMAX (Invitrogen) delivery reagents. Experiments were performed using 80 nM ASOs for 24 hrs (FIGS. 132A and B, FIGS. 132C and D, FIGS. 132E and F). Taqman qPCR results showed that several targeting ASOs increase ASL gene transcript level compared to the mock-transfected. Ct values from ASL targeting-ASO-transfected cells are normalized to RPL32 and plotted relative to the normalized qPCR product from mock-treated cells. Results of this analysis indicated that several ASL targeting ASOs increase gene transcript levels. These results show that inducing splicing of a retained intron in the gene using ASOs leads to an increase in gene expression. Altogether, these results show that improving the splicing efficiency of a rate limiting intron in the ASL gene using ASOs led to an increase in ASL gene expression.

Example 45: Improved Splicing Efficiency Via ASO-Targeting of a Retained Intron Increases ATP7B Transcript Levels To determine whether an increase in expression of ATP7B could be achieved by improving splicing efficiency of a retained intron using ASOs, the methods described herein were used. ARPE-19 cells were mock-transfected, or transfected with ATP7B targeting ASOs, or a non-targeting ASO control, independently, using RNAiMAX (Invitrogen) delivery reagents. Experiments were performed using 80 nM ASOs for 24 hrs (FIGS. 133B and C). Taqman qPCR results showed that several targeting ASOs increase ATP7B gene transcript level compared to the mock-transfected. Ct values from ATP7B targeting-ASO-transfected cells are normalized to RPL32 and plotted relative to the normalized qPCR product from mock-treated cells. Results of this analysis indicated that several ATP7B targeting ASOs increase gene transcript levels. These results show that inducing splicing of a retained intron in the gene using ASOs leads to an increase in gene expression. Altogether, these results show that improving the splicing efficiency of a rate limiting intron in the ATP7B gene using ASOs led to an increase in ATP7B gene expression.

Example 46: Improved Splicing Efficiency Via ASO-Targeting of a Retained Intron Increases HSD3B7 Transcript Levels To determine whether an increase in expression of HSD3B7 could be achieved by improving splicing efficiency of a retained intron using ASOs, the methods described herein were used. ARPE-19 cells were mock-transfected, or transfected with HSD3B7 targeting ASOs, or a non-targeting ASO control, independently, using RNAiMAX (Invitrogen) delivery reagents. Experiments were performed using 80 nM ASOs for 24 hrs (FIGS. 135B and C, FIGS. 135E and F). Taqman qPCR results showed that several targeting ASOs increase HSD3B7 gene transcript level compared to the mock-transfected. Ct values from HSD3B7 targeting-ASO-transfected cells are normalized to RPL32 and plotted relative to the normalized qPCR product from mock-treated cells. Results of this analysis indicated that several HSD3B7 targeting ASOs increase gene transcript levels. These results show that inducing splicing of a retained intron in the gene using ASOs leads to an increase in gene expression. Altogether, these results show that improving the splicing efficiency of a rate limiting intron in the HSD3B7 gene using ASOs led to an increase in HSD3B7 gene expression.

Example 47: Improved Splicing Efficiency Via ASO-Targeting of a Retained Intron Increases Transcript Levels To determine whether an increase in expression of a target gene could be achieved by improving intron splicing efficiency with ASOs we used the method described herein. ARPE-19 cells, a human retinal epithelium cell line (American Type Culture Collection (ATCC), USA), or Huh-7, a human hepatoma cell line (NIBIOHN, Japan), or SK-N-AS, a human neuroblastoma cell line (ATCC) were mock-transfected, or transfected with the targeting ASOs described in FIGS. 123-137 and Tables 10 and 11. Cells were transfected using Lipofectamine RNAiMax transfection reagent (Thermo Fisher) according to vendor's specifications. Briefly, ASOs were plated in 96-well tissue culture plates and combined with RNAiMax diluted in Opti-MEM. Cells were detached using trypsin and resuspended in full medium, and approximately 25,000 cells were added the ASO-transfection mixture. Transfection experiments were carried out in triplicate plate replicates. Final ASO concentration was 80 nM. Media was changed 6h post-transfection, and cells harvested at 24h, using the Cells-to-Ct lysis reagent, supplemented with DNAse (Thermo Fisher), according to vendor's specifications. cDNA was generated with Cells-to-Ct RT reagents (Thermo Fisher) according to vendor's specifications. To quantify the amount of splicing at the intron of interest, quantitative PCR was carried out using Taqman assays with probes spanning the corresponding exon-exon junction (Thermo Fisher) of the retained intron listed in Tables 10 and 11. Taqman assays were carried out according to vendor's specifications, on a QuantStudio 7 Flex Real-Time PCR system (Thermo Fisher). Target gene assay values were normalized to RPL32 (deltaCt) and plate-matched mock transfected samples (delta-delta Ct), generating fold-change over mock quantitation ($2^\wedge$-(delta-deltaCt). Average fold-change over mock of the three plate replicates was plotted (FIG. 123B, FIG. 124D, FIG. 124H, FIG. 125B, FIG. 126B, FIG. 127F, FIG. 129B, FIG. 131B, FIG. 132B, FIG. 132D, FIG. 132F, FIG. 133C, FIG. 135C and FIG. 135F). Several ASOs were identified that increase the target gene expression, implying an increase in splicing at that target intron. Together with whole transcriptome data showing retention of the target intron (FIG. 123-137), these results confirm that ASOs can improve the splicing efficiency of a rate limiting intron.

Example 48: Identification of Intron Retention Events in Transcripts by RNAseq Using Next Generation Sequencing Whole transcriptome shotgun sequencing was carried out using next generation sequencing to reveal a snapshot of transcripts produced by a gene described herein to identify intron-retention events. For this purpose, polyA+ RNA from nuclear and cytoplasmic fractions of renal epithelial cells was isolated and cDNA libraries constructed using Illumina's TruSeq Stranded mRNA library Prep Kit. The libraries were pair-end sequenced resulting in 100-nucleotide reads that were mapped to the human genome (February 2009, GRCh37/hg19 assembly) The mapped reads were visualized using the UCSC genome browser (operated by the UCSC Genome Informatics Group (Center for Biomolecular Science & Engineering, University of California, Santa Cruz, 1156 High Street, Santa Cruz, Calif. 95064) and described by, e.g., Rosenbloom, et al., 2015, "The UCSC Genome Browser database: 2015 update," Nucleic Acids Research 43, Database Issue, doi: 10.1093/nar/gku1177) and the coverage and number of reads were inferred by the peak signals. The height of the peaks indicates the level of expression given by the density of the reads in a particular region. A schematic representation of the gene (drawn to scale) was provided by the UCSC genome browser (below the read signals) so that peaks can be matched to the exonic and intronic regions. Based on this display, we identified introns that have high read density in the nuclear fraction of renal epithelial cells, but have very low to no reads in the cytoplasmic fraction of these cells (see Table 12 for percent intron retention (PIR) data for introns identified in genes described herein). This indicated that these introns were retained and that the intron-containing transcripts remain in the nucleus, and suggested that these retained RIC pre-mRNAs are non-productive, as they were not exported out to the cytoplasm.

Example 49: Identification of Intron Retention Events in Gene Transcripts by RNAseq Using Next Generation Sequencing for Retained Introns not Yet Identified Whole transcriptome shotgun sequencing was carried out using next generation sequencing to reveal a snapshot of transcripts produced by a gene described herein to identify unknown intron-retention events. For this purpose, polyA+ RNA from nuclear and cytoplasmic fractions of renal epithelial cells were isolated and cDNA libraries were constructed using Illumina's TruSeq Stranded mRNA library Prep Kit. The libraries were pair-end sequenced resulting in 100-nucleotide reads that were mapped to the human genome (February 2009, GRCh37/hg19 assembly) The mapped reads were visualized using the UCSC genome browser (operated by the UCSC Genome Informatics Group (Center for Biomolecular Science & Engineering, University of California, Santa Cruz, 1156 High Street, Santa Cruz, Calif. 95064) and described by, e.g., Rosenbloom, et al., 2015, "The UCSC Genome Browser database: 2015 update," Nucleic Acids Research 43, Database Issue, doi: 10.1093/nar/gku1177) and the coverage and number of reads can be inferred by the peak signals. The height of the peaks indicated the level of expression given by the density of the reads in a particular region. A schematic representation of the gene (drawn to scale) was provided by the UCSC genome browser (below the read signals) so that peaks could be matched to the gene exonic and intronic regions. Based on this display, retained introns were inferred as those that have high read density in the nuclear fraction of renal epithelial cells, but have very low to no reads in the cytoplasmic fraction of these cells. This indicated that the introns are retained and that the retained intron-containing transcripts remained in the nucleus, and suggests that these retained RIC pre-mRNAs are non-productive, as they are not exported out to the cytoplasm.

Example 50: Design of ASO-Walk Targeting a Retained Intron

An ASO walk was designed to target a retained intron using the method described herein. A region immediately downstream of the intron 5' splice site, e.g., spanning nucleotides +6 to +69 and a region immediately upstream of intron 3' splice site, e.g., spanning nucleotides −16 to −79 of the intron was targeted with 2'-O-Me RNA, PS backbone, 18-mer ASOs shifted by 5-nucleotide intervals. Table 12 lists exemplary ASOs that were designed and their target sequences.

ery reagents. Experiments were performed using 80 nM ASOs for 24 hrs (FIGS. 138B and C). Taqman qPCR results showed that several targeting ASOs increase CTNS gene transcript level compared to the mock-transfected. Ct values

TABLE 12

| Gene SEQ ID NO. | Gene Symbol | Pre-mRNA (RNA Accession Number) SEQ ID NO. | ASOs SEQ ID NOs. | Retained Intron (% Retention) | Target Sequence SEQ ID NO. |
|---|---|---|---|---|---|
| PPARD SEQ ID NO. 140005 | 5467 | PPARD: NM_006238 SEQ ID NO. 140009 | 140024-140280 | Intron 3 | 150740 |
| | | | 140281-140523 | Intron 4 | 150751 |
| | | | 140524-140776 | Intron 5 | 150743 |
| | | | 140777-140935 | Intron 6 | 150747 |
| | | | 140936-141626 | Intron 7 | 150746 |
| | | PPARD: NM_177435 SEQ ID NO. 1400010 | 141627-141883 | Intron 3 | 150740 |
| | | | 141884-142126 | Intron 4 | 150751 |
| | | | 142127-142378 | Intron 5 | 150743 |
| | | | 142379-142659 | Intron 6 | 150741 |
| | | PPARD: NM_001171818 SEQ ID NO. 1400011 | 142660-143350 | Intron 8 | 150746 |
| | | | 143351-143607 | Intron 4 | 150740 |
| | | | 143608-143850 | Intron 5 | 150751 |
| | | | 143851-144102 | Intron 6 | 150743 |
| | | | 144103-144262 | Intron 7 | 150747 |
| | | PPARD: NM_001171819 SEQ ID NO. 1400012 | 145263-144492 | Intron 2 | 150739 |
| | | | 144493-144735 | Intron 3 | 150751 |
| | | | 144736-144987 | Intron 4 | 150743 |
| | | | 144988-145147 | Intron 5 | 150747 |
| | | | 145148-145838 | Intron 6 | 150746 |
| | | PPARD: NM_001171820 SEQ ID NO. 1400013 | 145839-146105 | Intron 3 | 150748 |
| | | | 146106-146265 | Intron 4 | 150747 |
| | | | 146266-146956 | Intron 5 | 150746 |
| PAX2 SEQ ID NO. 140006 | 5076 | PAX2: NM_001304569 SEQ ID NO. 1400014 | 146957-147177 | Intron 2 | 150742 |
| | | PAX2: NM_000278 SEQ ID NO. 1400015 | 147178-147467 | Intron 1 | 150744 |
| | | PAX2: NM_003990 SEQ ID NO. 1400016 | 147468-147757 | Intron 1 (N/A) | 150744 |
| | | PAX2: NM_003988 SEQ ID NO. 1400017 | 147758-148047 | Intron 1 | 150744 |
| | | PAX2: NM_003987 SEQ ID NO. 1400018 | 148048-148337 | Intron 1 | 150744 |
| | | PAX2: NM_003989 SEQ ID NO. 1400019 | 148338-148627 | Intron 1 | 150744 |
| CTNS SEQ ID NO. 140007 | 1497 | CTNS: NM_004937 SEQ ID NO. 140020 | 148628-148850 | Intron 9 (10%) | 150752 |
| | | | 148851-149075 | Intron 10 | 150738 |
| | | CTNS: NM_001031681 SEQ ID NO. 140021 | 149076-149298 | Intron 9 (10%) | 150752 |
| | | | 149299-149523 | Intron 10 | 150738 |
| CYP24A1 SEQ ID NO. 140008 | 1591 | CYP24A1: NM_000782 SEQ ID NO. 140022 | 149524-149599 | Intron 10 (23%) | 150750 |
| | | | 149600-150072 | Intron 11 (50%) | 150749 |
| | | CYP24A1: NM_001128915 SEQ ID NO. 140023 | 150073-150264 | Intron 9 | 150745 |
| | | | 150265-150737 | Intron 10 | 150749 |

Example 51: Improved Splicing Efficiency Via ASO-Targeting of a Retained Intron Increases CTNS Transcript Levels To determine whether an increase in expression of CTNS could be achieved by improving splicing efficiency of a retained intron using ASOs, the methods described herein were used. ARPE-19 cells were mock-transfected, or transfected with CTNS targeting ASOs, or a non-targeting ASO control, independently, using RNAiMAX (Invitrogen) delivery reagents. Experiments were performed using 80 nM ASOs for 24 hrs (FIGS. 138B and C). Taqman qPCR results showed that several targeting ASOs increase CTNS gene transcript level compared to the mock-transfected. Ct values from CTNS targeting-ASO-transfected cells are normalized to RPL32 and plotted relative to the normalized qPCR product from mock-treated cells. Results of this analysis indicated that several CTNS targeting ASOs increase gene transcript levels. These results show that inducing splicing of a retained intron in the gene using ASOs leads to an increase in gene expression. Altogether, these results show that improving the splicing efficiency of a rate limiting intron in the CTNS gene using ASOs led to an increase in CTNS gene expression.

Example 52: Improved Splicing Efficiency Via ASO-Targeting of a Retained Intron Increases CYP24A1 Transcript Levels To determine whether an increase in expression of CYP24A1 could be achieved by improving splicing efficiency of a retained intron using ASOs, the methods described herein were used. ARPE-19 cells were mock-transfected, or transfected with CYP24A1 targeting ASOs, or a non-targeting ASO control, independently, using RNAiMAX (Invitrogen) delivery reagents. Experiments were performed using 80 nM ASOs for 24 hrs (FIGS. 139B and C). Taqman qPCR results showed that several targeting ASOs increase CYP24A1 gene transcript level compared to the mock-transfected. Ct values from CYP24A1 targeting-ASO-transfected cells are normalized to RPL32 and plotted relative to the normalized qPCR product from mock-treated cells. Results of this analysis indicated that several CYP24A1 targeting ASOs increase gene transcript levels. These results show that inducing splicing of a retained intron in the gene using ASOs leads to an increase in gene expression. Altogether, these results show that improving the splicing efficiency of a rate limiting intron in the CYP24A1 gene using ASOs led to an increase in CYP24A1 gene expression.

Example 53: Improved Splicing Efficiency Via ASO-Targeting of a Retained Intron Increases PPARD Transcript Levels To determine whether an increase in expression of PPARD could be achieved by improving splicing efficiency of a retained intron using ASOs, the methods described herein were used. ARPE-19 cells were mock-transfected, or transfected with PPARD targeting ASOs, or a non-targeting ASO control, independently, using RNAiMAX (Invitrogen) delivery reagents. Experiments were performed using 80 nM ASOs for 24 hrs (FIGS. 141A and B, FIGS. 141E and F). Taqman qPCR results showed that several targeting ASOs increase PPARD gene transcript level compared to the mock-transfected. Ct values from PPARD targeting-ASO-transfected cells are normalized to RPL32 and plotted relative to the normalized qPCR product from mock-treated cells. Results of this analysis indicated that several PPARD targeting ASOs increase gene transcript levels. These results show that inducing splicing of a retained intron in the gene using ASOs leads to an increase in gene expression. Altogether, these results show that improving the splicing efficiency of a rate limiting intron in the PPARD gene using ASOs led to an increase in PPARD gene expression.

Example 54: Improved Splicing Efficiency Via ASO-Targeting of a Retained Intron Increases Transcript Levels To determine whether an increase in expression of a target gene could be achieved by improving intron splicing efficiency with ASOs we used the method described herein. ARPE-19 cells, a human retinal epithelium cell line (American Type Culture Collection (ATCC), USA), or Huh-7, a human hepatoma cell line (NIBIOHN, Japan), or SK-N-AS, a human neuroblastoma cell line (ATCC) were mock-transfected, or transfected with the targeting ASOs described in FIGS. 138-141 and Table 12. Cells were transfected using Lipofectamine RNAiMax transfection reagent (Thermo Fisher) according to vendor's specifications. Briefly, ASOs were plated in 96-well tissue culture plates and combined with RNAiMax diluted in Opti-MEM. Cells were detached using trypsin and resuspended in full medium, and approximately 25,000 cells were added the ASO-transfection mixture. Transfection experiments were carried out in triplicate plate replicates. Final ASO concentration was 80 nM. Media was changed 6h post-transfection, and cells harvested at 24h, using the Cells-to-Ct lysis reagent, supplemented with DNAse (Thermo Fisher), according to vendor's specifications. cDNA was generated with Cells-to-Ct RT reagents (Thermo Fisher) according to vendor's specifications. To quantify the amount of splicing at the intron of interest, quantitative PCR was carried out using Taqman assays with probes spanning the corresponding exon-exon junction (Thermo Fisher) of the retained intron listed in Table 12. Taqman assays were carried out according to vendor's specifications, on a QuantStudio 7 Flex Real-Time PCR system (Thermo Fisher). Target gene assay values were normalized to RPL32 (deltaCt) and plate-matched mock transfected samples (delta-delta Ct), generating fold-change over mock quantitation ($2^{\wedge}$-(delta-deltaCt). Average fold-change over mock of the three plate replicates was plotted (FIG. 138C, FIG. 139C, FIG. 141B and FIG. 141F). Several ASOs were identified that increase the target gene expression, implying an increase in splicing at that target intron. Together with whole transcriptome data showing retention of the target intron (FIGS. 138-141), these results confirm that ASOs can improve the splicing efficiency of a rate limiting intron.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (150766 sequences)

SEQ ID NO: 1 - DNA, 36363 bp, Homo sapiens
ctgcccggcgtgctgggtagaggtggccagccccggccgctgctgccagacgggctctccgggtccttctccgagagccgggcgggcacgcgtcattgtgttacctgcggccggcccgcgagctaggctggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtaggagcccttctccgggcctccctcccagccgtcctctccctcccctcgcggcgccctgggcggttgagccccgcgagcaggctcggcagccctcgagcgcccgactcctcgcccctgcgcccgagcggctgcacctgggctgagcgcgccaactcccccacgggagcccctgcctcctgagggtgacccctccaggccggacaggggcgcgttcgctccgctgttgccccccgggaagtcgtcggatttcttccgcactcgtgcatttttttttttttttgccccggaatcatgttgagtccttgaacgtagtttcgcaaaattattttcactcggcgaggagggctcgtcggggcggggagtgggagggagtcgccacctctatactcgaagaaaacagctttctcccgcgctgacctacctccttccctcgccggcaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccggtgagtgactactcgggaaggaggccgggcggagcctcacacccgcgcctggccgagccctgttatcccttgcgagagggatttaaagggctttggcttgaaactaggcgctaactggggaaatctctaggggtggcgggtgagggagccgggacactatagttagatctcggctggggtagtcgaggtgggtcccattcctgctgctatttgcttagtgcacaaaagtggggatcccagagggtttatgggaccaggctcctaggaaggccggtgtaaacttgcaacttgaagttcccagagtaactctcccggccccaagccaagagatcgttgtagctgatctctttgcttaactaattaaacctggtgcgccgtggaaggcgactcggcgcagttctggcctgcgaacgccgtccaaattggcaacctcccctttcccgtgaacggccgggagggcgggtgtgtccttcctggagggtgtgggggagtccgtttcccgctgctccccgggagattttagtgtgtgcgggggcgctctccaggttcggcttaagggccgggggcggccgccgcaggaggaggttcttggggccctcacaggagctgtagacctgggaacccccgcccgctgctggccccttcctgcccccgcccccgagtggtgtagctcttgtggcctcacttccagcggttcccgggctctggaacagctgtgtttgcagacttccccgggaagggcgggtgcacggcccccgcaagccttcgggggccgtgccaaggcttggaaggggtggtcttctggaggtagtgcctgagggtgtaagtgataggccctcatccccccgccccattccgcccccaaaggagctcgaggcccgggcccagctggcagatcctgcagcgaggcccttgcaacatcccaaaatgggtggaaggaagatgggtgcgattgcagaaggggaggaaagggaaatgttgggggtgtgccctctgcctggctcctgctgtccaggaggcatgactcattgccaagactggggcttggcctagcctgtgctgggagggtgggtggtgagagggggagctcggtgccccagagcattgctttccaccacgtgctctaatggggtgcactctgctgcctcctgtccgccggcttaggttgtgattctgggaggagacagaggggagactatctggctgtgtctgtgtatgaagcttggggtggctcttaaaatccacgattacaggagctggcattataaagtgccctctgctgtgggtgagataagacagttatcaaaaactgccatgaaaaggggtttataaaaagaaaaattaaaaccaacgctgtctgtgaagctctcttgaggtccaagggctgtttctgttgtgggatttcatttttaccaagagtatttatcttgtttgttaatcccctattagggagaactttaagctaaagagtctggctgcgtttaaatctggctggcccaagctgactgtgaatactcaaactgcccttgaacgtgtgtttggagtttagggggaaggggcctgcaggtggttccaccctcctgccggaggatctgtctggagcccctcgcttttcacaagaccataaaaggaatcttattagtgatgtggaaaagcagcagcctggctgaggctcattttggagagtagggtcagagggatggctaacatgaaaacaaggaggcttgctccctcgctggccaaggaaaagtgacctagaaaagtgcgtctgtccgcttttgacacttggtcagagtcctcaatggaaaacgagcggaaatagtgtgggagggtaggagaggcgattgatttgcatttgctggtgctcttctgtggtttcaggccccacgggtcaccaaccatgaaatagactctcggcttttctcgaatgggggaagaccgatggggcaccactgaaaatgtggttcttttgaagttgggacaaacgcatgtatcactcataaacaagtctccaccctgatgccccagaaaggcctgctgtgaaacataagatttaattctcaagagaaattggagtttaggtgtatttgtttttctgtatgtggttggagaaacggcacagtccgtaactttcaagaatgattccaggctgagtagaaacgtaactgaaacacttaagtagctgagcgagtatttaactagagggcacagcttcatttagtttggcaattaactatgtcttttaaaactgatttccttgaatgggaaataaatgaacttagtacagaattcaagagatagcaagaaaaggatatatggttaaaaacaaaacaaaactccaaaccaccttgggctcccaacccctagcaggcacaattaccatttgcatgagtcctcccaaatttgctgacgctgggtatcagcaaagggtgcaggggtaggtcagtgtagaaggtcatgtagttcatgctttttgtttggaattatgacccctatccaagcaactgttcatgttctagagaggacgaggaggaaacgatttggtcagatatgaaatacagtccatgttctggtgtgcatgtgaaaggctttgtagaggtggcccttcctgtcatatatcatatctgagtatgtcccacgtggtgtcccctgccccggctctggtcttggggtagtttttcaccactggcttctaattctcatactgttgctgctctaaggggcttaacttgcagcaactatctggattaatgattctcaaattgggggaccaagtgataagaaccattattgtgggaagtaattgggcttaacaggaaataatttaggaattaccacttataaatcactgaaacggttaatctgtacctcccaaaattagtgctaaatcccagtagtgcctgcttattaaaaatacattagtgtaattaccactactcatctccaaaagctttttgggaacttcagaaccccagttagctgtattgctgcatcggtggccccagagtgaaatgaatctagagaaacgttaggggaagaaattggggtatctggcttattagcctcatatttaaattccattgatcctattaaaagacttgctgagatcaactttttttttttttttttttttttttttttttttttttttttggaaaatccaatgaaacgtgattcttctgtgtgagggatgccagctttggcccccttcatgcttcaggcctgaatgaccaattgccacgatgctaatcacagaatgtaattgacaggcccttacttttatgccttttgctgtcttttccagtccctgagcttctgtagatatggtgtgggcacatggagggcttaaggatggggttctgatttgacctgcctcctttctgcagccaggatttgcatcctgcccgtgtagtcagcatgtatacaaagaaagagcatgtgtgtacgtatgtgctcagagcaagggactttctgcatgtggagaaaacgccttttgccctaagaagtctacctcaaaccaaagggatgaagtgatgtatctgtgttgcaacactgggcttgggggaaagtgaagctgtgcttgctttgaaagagctgtgctaagtatctgcagaatagctgctccaaaaatggaatctttattccaggtacttggtttctaatttttttttctcttgcaggtgtaaccttctgtgttttctttctccttgttgtcttgtttcttagcaacttattcaaacctccagtacttataggaatttgcaacccaccagttccacacccgtaattctacagggacttaagatgtttttagaaaacggtgaaactttggcgtggaggctcttgggggagttcagtgggttaaaaggagagtcagcagcaacttacaggcatgcaacctcccagaaaatcagcaatctaagtgctgctcaaaatcttcacaccaaatagtggtgcctttggggaccttttagatagaagacgtggaaagtttagcatggagaaaaaagttacttaaaaaaaaaaaaacagtgtcaaggtaacaaggagccttcacagttcctgatctgaaaacaggaatgtgaaccagaggccttggctggattcatatcacccactggccccattgtagaagggccagaagttggtcccaatgtccggctttcaaggttagtgacaatgtaagaatgcatgatctctggatgtgcatacaattagcgttgtaatccataaatgcaaatactcctgcaaattcttccatggtaaacttctgtaaggcatgttgctcttccacctacccccatccttcaagcctaggatctaggctgctgagagaagtgactcttggcttcagcttttaaatatatatatatctctcaaaacttaatcttttcttccaactgttggaagatacattgggatgaatggaaagtggtgattctaaaatggtggtggaaatggaggagggtcctgggttcagaaaaatcccacctttactttggtgcatggcactgggtggctgtgttgtgacttctttgctgatttctgattaccgcatggaccacagcagccctgtgactgctgttttttttttttttttttttttttatggtgccagtgacatctaccattggtgcagtgcgtgtgctgggaagaaattccgcaaggtggctcccagtagttaaaggagtacataaatagtcaaacatgcagagtcctctaccagctcaacccagtttttatgcacttttggtaaataaacagaaaggcttcttgttcaggcttgctctgtgtgaaccagaccgttgtgcttggctggcttcttggtattctatctattaacctcgccacccttttgtaactggtgcatttaattatcagtgggatgcttttcaaacaggtaagggtaatgatgggaaagggggtggggatgtctcattgagagtcacaaatctggatatgagctttggggccccttggtgagcctttgagtgggctttgatgagaaaatcaccctttgtaaccagatcggactctattgacatgtcaagccctacagacttgattgctttctgtgcctgaagtcttagcctagatgctataggatagttgtcctttcttatctcactttcccaaaacccactcgcattgtgtgcatgagtacgtgtgcatgcgccacacatggactccctgcaaccttttctgcttaatatgttttgtgactggaatattttatactctggccacccagacacaggcaggacaatagagttggccgaattgactgaaatgaggattatggagaataatagggcctctccaaaaataatgctaacacaggacaagcgacaggaagcaacagttgagtcagcagagctcagggcccctgacgaaccctgggagccgactgactgtgcacaatggccgcgttggcacgtcgggcattcccaggatgtgcgtgccgccggcgggcctgcctgtcgcagcagcctggggttttggacgccgcacgcgtgccgtttggatggcggtttatttgtgtccgtcagcttggcaggaggggaggcagccgcttctcagggcttggtttggctgtcactgttgccaggaaaaggaagctcccggctgccaacacaattacctttgtttcttacatccccccttcttaatgtggcaattaagtgcttaccgctctgcccagtgccaaggtaaccgccatggagtgggacagggcagagaacacaaccttggcacagcagcctaagtgtggagggcgggaggaggtgcaggggccccagccttgctgggaacctggtggcccttggatgccttggggctttgatgccaggactctcctctaggtagaattccacagaaatcttccaaaaagcaattccgaaggctgaccattcctctttgatgccacaccagaatgggaaccagctgccaggtttccagatttccttgggcttggagctgggaaggggctgaagtgactcactttgcaaatccagactaaagatctgtttgctacccctccttcctgtgtggccttcacagtactgttctggaaaacataaggaaagatgaaagccaggtgactcttcggcagagtcttagttctgtagtctgaaatcaagaaaaacccaggtatttgcttttgttgttgttgttttgctgtataaacttaagtttgaacacttgcctttccaagccctcctgggatggaggactccgcctctactgggggtcagagttgcagtggctgcttgtatgtgacttcggcatagtggatttgctgctctgtggcctggtccctgctttgatgtggggtgcatgatctgggatctcagtgcctgggtgtatgttcagggatgtacagaggtcaagtgtgggcctgggaaaaattaaagttctctagcaactaataatcattgttaaattatcttgattgctgatctatagtgtggggatggagtgggaggttgagtgcctcctaataggaaccttggagggaatcctttttctctgtagggctgggcaggaggaatcctcctgccccaggagaccctaatcccctccctgaaacagacaggaaaaaaagtccaggctttgttgccgtcactgtagctccctgccctcaccctgtctctgcctctgagaaagaagggcagttcatggaaaatcacagagccaggcacgtagggctgtgtgcaattcttttctctccaggtggggtgatgtcggtcagcaacttctgaggttttcccagttctggcgaggatgagcctggtagactgcttggtcgtccaagttcttgtgcaagacctaaggatgctttcctctttgagtattaaactgagttagtactgccatgccagctcagtcccggcaccttcccttgcagtggggtttgtgggtattatgtgtttagcgcttgtgcaagtctgtcaaaactcctggtatcaatgcatttaatcagaggattaattacaacaatactgttgaagtggaggacgtgggcctcaacgtgaccagcaaatgaagggcttaattatacagaatcagccacacatctggcctcattttgactgtgctcttacctcaaatcagtagagaaatataatttcttgctgctcttagggaagagtcctgtaatttgcaggaagtcctaagaaacttaaagaggcagtaaataaggtataactttcgctaataaaatagtaacaacagcaatgaatttggacctgtggccactaacaggagagggctgggtatgtgccctggcttgcccggttttgcttgcttttctgagcattttcccacagttatcagtgaacgaaatggaatcctactctgctttgagtatgaaacatatttcggctgaattccaaggcagggtctatcacaagatatttttatattcagagatgacctgctgtgtcactctgagagcgctaagctggccttgagttatgaatgaaactcccttttaccctccctttttctctttttcctttatcttataggtgctttctcttctcttggcagcagtgtgcttctggtggcacagcacggtattatttaatctatacacgcttctatttcctatggcttggtttctgacacagcaaagcagggattcataacctagttcatgttccttgtctaccccacctgccttgagtacatttcttcagtgccaagatagcagaagcttcatttaaacgctggtgttttgtgagactgaccttactgtaaattacgaaggaaaattttagaaaaggagggaatttgctaatagcttaggtttggctgggggtggggaggtggaattctgagataagcttggaagataaaaggtgccttcagtttaacagctggcatcttgccagtatccagggaatttgtttagttagtagactctgattattcttggaatgttagatcttattaacagataagttcatcaataaatataacccatgggtgtgcggttgtttctccctttgtactttcttccctgggatctgcccccaactccaccgcccaagtgaggttgacttctttgtcttgcagagtcactttgcatctaccccctcctgtttcctagagttacccgatacttgtgggagccaggatggtctcacatagacagagttttcaaaggggttctaaaaaggaaaagggggcctccctagagactgcctcaccagggcccaaagtgtaaccttagcaataccccctcggtacaaatacctggttaggttagcttagaataaattctttgtgtgtgtgtgtgtgtgtgtgtgtgtgtgtgtgtgtgtttcctcatgcactagggtcagggtctggaaagttttgggaaactatatgctaaatactctcatatcatatagtgaggtggcatttcctgatctcaactttgagctgcctgcatgcatgttgactccagtgcgtccctgccaggtgaaaggagtcatttgtcaacctgggaagagtgctgacaaaggaaggggagttggtttggatttaaacatccaggaactcaatgcaacaaccaacagaatttttattttggcattatggttttgtttggtggggtattctgggaggccaagaatgtacgagattttggaaagtcgaccctgtttctgaattgctaaattgtttgtttgtcttgcagaggtcctatacgttgcttgtggaggcgtgggattccagtaatgacaccgttcgtaagtatcgcttctgtggacttttctctaaacacacgtggaagtgtggggcttggccaaccagttggagctggatctgtctccttagtacttagcatttctgccacctcttgccttctgttctcccctgtaccccagggtgaaccttcagtggaatgtattccttaacttttctaggatttttgcttggaatattaagtggccagaacagaatcccagttaactcattccctgattatgaaacctagattatcttcgggatagagatcttaatggttttacaactttaaaaccttgtagtctgctaaaggatcaaagtagtgactttttaaaagtccatttaaactttaagtgagtgtttaatctctcatcagaaagataaagccataaaggtggtgctgggctctagagaccgaccttgaatttcacttggtgggcaggtgagcttctagtctctccgggtttcccacactgctccacaaacctttcattgaagcgcaattccagagcttcacagccattacctgccttgtccctttctgaaagatggctctgttttcagtgcaggttgcctttcaggactgaggggttggttttggtggataagccatggaggatgtgattgaaatgacatagtctggcttacaaagtagtcttgctctttaattgtaactttacagtgttttcgctcacgagccgaaacttcaagttccctttttgccagcagagtttgggttgcggtcgctggaaaacttgatgctcactgaaatctcttggtctgtgcatgaggaagagtggatccagcttcttgtcttggctctctgttctctgaatgccttgtactttttgcttttctatcttaccatttttttttgtttgctttcactgtgaataatatattttcatctttccttgccttgcttttttttgctgacagaaaatggtgaatgcacaccgtgggtgcagtgagggcttggtgcctgctacgtgggcagcttccacctgtggctggcttattgggctacttggagccacagaatcattgctgagctccgatgtgccagagagtcccaggccatttgggtcactcttctagcttgggaatcttaagtccagctttttggatgtcatcctccctggagggggagctcatgaaagtccaaggttcgagtcttcctccccagagggctaccctgtaatgccgtgggggggtgtgtgtgggggtggcagggaagctctgtcagccttggctatggctgatgccagtcagggtcatagacacctgtttgttctcccctccctgccacaaacgttgaggactgtgaacattatgtcactgtgacctgcttacaatggtaactaagcgttaggcagaaggggttgaggaggggggagacataggctcttctgtaatagtatggtgtcgacatggtgttctttcccctcccttttagctattgaaacaatccacccggtagagtgaacagcttgaggttgatcctggcctgtgataagagccaggtcagtatacttgttagggacatgtgagagacctccccgccacactgcagcattcacagcacctttcctggacctcctgtcacctcgcaggtcagggagttatgtcccctgggaacccagggcttgtccagagctacccacagttgtctgcatttccaggtagcccgattttggggttctaggatgtttcatctcctgggggggtaatcaaatccctggaagaggacaagaaagactgaggtaggaataaagttcttttaaacctcaagggtgcccattgcaggttatcaaaactcacttggtgaaccctgaagagggagatgggtttggtggaaatggtttctccacttgcctatttggcctcttttatgatgcttccaaggaatcttgaattcagcacagtcaaaaccaaactcaggatcttctcttgccaaaagcagtcccttcccagggccccttctgggtgtctggcaccgatatttgaacactcattgccataagccagaaatatagaaggcgatctgtgtaccccctctctgttagcatccatacctagtccacctccaagttctgaaaaatctctccagctcttcacttgaatctgcctgccttctgccactgccctggtccaagtcaccatctgctcatgactgaacttagagtagccttcgtctggtccacctttatctgctctgactcacctctagtgctttctccattcttctgccatcctggtcttttcagagccataacatttgcttgtcacccttattatgaaaaaccaaccacttggtggccttctgttgctcttgggacagatcttcatgtggcccacaaggctctgtgcagcccagctttgtctccctgccagccttgtcttacacaccgtgttgtccatcgtatctgtagcctggccataccctagcagttgccttcctatcctcaactacatcacatgctttctggcctcaggacctttgcacatgctgtttatgctacttggagtgttttgttcctttcttcaccctcagccactccctctggactgcactccacagggcagaagctgaggatgttcagaagcccaaacggagttggctgccctgtgggacccaagcgagttgtaaacattctggcttcagatgtaaatcaaaggcagagccctgagttttagggcagagaattccttctatcagctctgcagtgagccctcacaggcagactcgggcccaaatatagcctaggtgctgtttatgtatttgaaagtatttaaggctggtccttctgtcatcggtcctccaaagtcttttattacattttgggactgtggtatatagagttccaaatttctttctcccctagagcaaatggtttcagtttactgtaatgcataataaacatgtaaacataaataggcacacttcagaccaggttttccctgtagcttagctttctcggctaaggcccccttccaggtttttgggtcggtgtggtcccaggttatgctcagactcgcccttcatcacctcctccttggcctgcgaggcggtcatggcttcttcgtgactcatcttcgtggcactggggattgcagggaggcatggtgatgtccttttccagtcacaaggctggactgccaaacgaactgccacagattcctttccagtgccccaagctgaaggaaagcgtgatcaggaagcaggcagcagacgtatttgaacccagacatgctcgaccccctccctgagcaggtgtgaaattatgtatgcagctccatagctccactgaggattctgaagtgatcctctgcacgacacttcccggaaataagtggaaagcttactgcatgactgaaaagtacatatcagtcctgcacccctaggattgccctggactcttgtctaaactgtttgttgttgataccagcctcagaagctggatgcctttaagccatggctagtgtgtttaaccgatcccttttatgaagatcttgtaagcgcgtggtaatagcccactatgctttttaactgaaccagcagagcaaacatagttaatggagagacatttttgtcattccttggcctctgtttatttgcaaaaacgagtaaagtgttacctgcctgcaagtggttcagtgcgtgccggggtgtcaggctgcaggtatgtgagcttgttcaaggcttgtcttgcccacgcagcagtttgagagccctagagggcgaacgctggggccctgttggaagcggtgtgtggatgaagccacccaggagtcccttctctcctggtcacttatagggcttgcatcactttttaaaggagcactggcccgaggcctagaaaaacagccatgtgggtgggtaagaatcacaaagacattgcaagtcagtcctaactgtctctccaagatggtcttgaatttgacaaggtgatgaagagttggtgctggcaggtttaagaaaacaaacacaaaaccaggttggggtgctgatttagtgccttgctgccttttcagatccctcccctgaactgctggcacctgatgtttgagctatttttgtacctgtctcttctcaaactagatgataagtggcctcagggcagggactacatactcctgagagctgcttgagctcgaggtgtttattatcctcagtaagcattttttttcaggagcatgacttggctcaaaaaaacaaaaagaaaaaagaaaccctcccctcaatttacctgtgtctaaactttggtgaattattctcccatctgccttctgggcagaggagaaaggtggaatgcatcaagttcaaggtcttggtatttaagagctggctttaaaggttgccatgttaacaattgtaaaaaaaaaaaaaaaaaaaaaaaaaaaagtaacttaatcgtctccttggcttccagttaagagttttgaaatggacaaaaagcttttctgagcaagacataaaaccctaaaaccagaaatgattgctgacctttatctggaataatgaaatttcttcaagagcaacattccatagggagctactgtctctcatatgtaaagagcacttgcaagtcagtatggcaatgtaatagaaaagttggcagagaagagaagctgttgctgttcacaggaacaaatataaatggttttgtaactaccagaaagggctcttgccatcacttagttaaatgctaattaaatgagatacctctttacctatcaggcatagattagaaggtttgataatgtacaacgttggcagtgttattgggaaacacagcttcctgggtggtgggaggacagactggtagtttgagactgtggacagaggttgatttgttgtgcacggactctgattcagcacttccatttctagagtatctcattgtgggaaccatacacaggcagatacgttcaaggaatgctcactgtggctttgtttaatagtaagaagcccaaacgactcacatgcacacatgtcagggactaggtaaattatttattggtgtttccagacaatgaaatactgtgtacccattaaagaaggtaaacaagtggtaacaggttgtctctgggtaggggcataaacttttcatttctttgccttttttacaacagatagaattttgtagcaggtgcatatgtttttattttaaaaagccaaaatggtcagggaagaaggctgcaatgtgaatattaacatgattcatcactttgtctctagaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagaggtatgtgtgtgtgtgtgcatgtgcacgtgtgcctgttgcttttagtgtccatttatcaccccaccagcaggcaggtggcatgcggctatctcaggtggggtgggattttggctgttattctgggcctgcagtatgaagatgcggagtgtagaagatgctgttggtgccccatccagatcccctttactggcatccccatcccccaggtgctgtgttggctgccaacagctcacagctgctccttctcaggagactcgtccttggccaaaccagtgcatgccccattcctccagctcacagtcagtgattgacagacatagggctacaaagcccagcttcctttgccttaaaacagtagtacaatttgcactctagagcttaccctgggattaggctgaaatcagactccagttgagaccatgttcttgctcagctctttcccctaccccatctgcttccctcaattccttctacctatgtccagatccccttctcagactctgcttctaaggaacttgacccaaaatagatccagacaggactaggtcagcccagttgttgtctgaacaggctatcctataggaaatgatagcccctgcattcagggtagccttgcagcaagttttcactaggtgtctttgggggcatggctttgatggggagaggtatgtggttagctcaagctttcctattggtgtaggagtgggcccacttttagtctctgtgctgtctactgtcccagtccctttatagaattcagtgattccaattcatagcaacttgatgggtaattctgttaactgtataatatcccctcatgagcaataatgtactctgcttattttacatgataattaggtaaattgttttgatagactcaatttcaaagtgagtttttcaaccatgagagaggggtgggtcatgggggaaggaatttacagctctcccgggtagtactactgctttcttaaataattggagagaagagtttaaaaaggatggcatttctggaattcaaatgaaaaggggaattcattaacatattttagtgtgttttaaaaattaaacgacctaacacttagtgtgggttttttgtttggtgtttttttttttttttaagataaggtgctcactttgtcacccatgatggcacaatcatggctcactggagccttgaactcctgggttcaagtgatcctcctgcctcagcctcccaagtagctgggactataggcacatgccaccacacccagcttttttattttgtgtagacatagtcttgctatgttgttgaggctggtctcgaactcctggcctcaagctatccttctgcctcaatctcccaaagtgttgggattataggcatgggccactgttgcctggtcttagaaactgacattttttagaagttacttttttcttttttttaaacgaagtagagaattgctctgcaaggatactttataaaagtctcaccagatctggccaccagattagcctgcccaatgagtccagcctggctggctctgttagtcccatggaattttcaaaccaggcatttggtatgggttgtttttttttttttttttttttttaaaggctgaggctcatctgaatgtgtcctggtgggatggggaaggattatctatacctttttttcttctaatgaaaagggtgtgggcagaatggaaactgaccaagctctgctcaaggagccagggtagctgtggtttagagaggctggacgaaggtcccccttccctcgtcaacttgtctgcattttgtccccaaacaatatcatgttttcagaatctgctaacaaggccttgaagtttaaagctggttttgttatttgggcccctcccatcttcctctccttacaagggacttgatatgagacctgttaaaatcgtggaatttgcagactttaatgcaatgggccattctcatgaccggggcgatgcaaggaacaggcagtgtgctgacacgcccttctctgttttttacagctatttgccgacaaggctgcagtcctaagcatgggtcttgcaaactcccaggtgactgcaggtaaatcaactggtcttttgtgagatttcttttaattttcctttatgtaagagaggaactgactttattgtgactatgcctcttttttccttggagaacaagaaagcttttttaaaaaaaaaattcagatagacacatccgaagcttattaaattataccagctgtctggtggaatgcacacaccacttctctcttggaataaaaagaaactctttgggcatagccagtgacttcatgtattaactgttctgtaaattgataacacatttttataatcttcccttatagtgctgatgggctagatggagggatgtgggcttgtttctttgcgtctctctcctcttccaccaaggctttcttctcccagccccctccccgacttttcccatcaataggcgaaagtccagcattctttagaatgggattagtccaatctcctggcccctttgcaggcgggagctgggttggtgctgagaggttaatggctgccctggaatcttgtcagttgagcctgatgaatgtagacttttgctgcagtcctttgaagtctgttcctttatggtccaggaacaatgcggaagccaaagggaggcctgccctgaccacttcacgatggcgggttttggaacttcttgaaatttatattacgcccgtttggaaaaggcttattttgggaaatattgttggtgtctgtggtgtttttggcagtcttaatgctttgctctccctcctcccaaattttaaggagtaacgctaaatggatcctttgagcctgtcacttttgcccccaaagctactctgacatgagtaaagggaatcttatgaaacatagtctaaaccagtatgtcccaaactaatgttatttggggctcttattaaaacgcaggtcctgattctataggtctgggctgagcccaggtttctgcatttctaacaagctcccaagcgatgctgctgatggaaccatcagcaatcactgcccccagacctcagtactcaaagtgtaacttccagaattaacaagggagctgttaaaatgcaggttcgtgggctccgtcccacatccatagaatcctagtccttggtttggcccaggagtctgcatttgacaagctggccacatgactttgctgcttagtaaattttgaggctactcctttaaagagaactatctgtggcctttacctttatgattccaccgctccgtctgttcccctcccatgcaagggggaacatggaactaaattaagaactggttgtcccgaattgtctcttcctacacttcagaaagatagtttatttcctggaaggctgaggggcttctcctgctgtctcccattggtggcgatggactgtagtatttaacagcattgctgtccaatgcggagcaggaatccacctaccttaactcttcctaattaagggtgttctggagaaagtcccaatggcagtgctattagtgattccaagcctgctgcctgctcagatggatatcagcggaggccgactgtgatttgtgctgctgtcatcagaacacacatacagctatacaggggagggccctcccagccagaacaacaggctttgtttccagaatttagccctttctctttcgaagtcccacctccctctccctgcccagacacgcactgatggccttatttacttaaggtgcgactttcccacacatcatttgcatagtctcccagcccagttttccctccctaccttgaaagaaagtcaaaacagaaccttcacgctgaggaagttcaggttgtgtcctgctgcagaaatagttgaatggcaagttacctgcaagttgtcttttggattatgtattacacaggttattttttttttcacccccacatgagaaaatttactggtttttgttgttcccaagtagactgagtccctttccctgggtatacatgcttgcttattgcaagcctgccaataatatcaaacttaattatgaatcatcatctgaggaaagtcacttcaatttctcatgagaatcttaatcatatattattaaactgggataacttggttggtgcctcttttagggtcagtatttttatttgttttcttttgaagtcatccatggcctcttgtggttgcttttttatgcttggggattgaggtctctttaattaggtgaggttgggtcctcagctgcctctccttgcctttatgaggcaacttgaagagggctagtgatcctgaatttggaagagaataagggaagacggtgagaatattgccatttcgtaatcagttccctcttactatctttcaggctaagaatatcagccttgacagaatggctacacccttacctcccactaacgtgggtgtccgcttttgagaaattatttagattgtaattttgttcttatcttactcctttagtcacttgtcacgttgacattccattttacataaaccagaatccagtgtctaactttaaaccacacattctagtgatttctttgcatgtgggtgtgcatagcttggtttcagaagttaggaagtggttagtcagtattctcaggggttaagttgactctcagccgtgggtgattagctattagctagatccctataattttcccatgacaaggatttgctagcctgcctcccgctcttgggaaaccgaaagcctttccttctggggagctagagggggcgggggttgttttccagagttacagctgagcagcttagggggttggcgctgatcgtggcttttcccaggtcccgttctggaaacatgttgcccatcccacccgcaccccaccctccaccctccaccctccacgctccaccgggaggctagttgatgtttctccctgccttcccccacccttgttaaagcttggctcttgagaaggcaattaaagtttcagagggcttgaaaattcaagggagagtggtttgagacgctgccccctctcccaccccagatgaaagttgttgtatttgtttttgtttttgcttggggatcagaggcactatttggccccaaaagagtatgattaatcaaggtgcttatataaaagaacctcaactccgccaatactagataaattaagcagactgctttcttttttttttcttttcttggcaaagcaagaaatcactataaattagcacacagtaatgggacacaaattatggagttggttccaagtgttgtcatttccttctccttccctatagaagtgggtttagagagcctactctggctttggccaagggagggtgcccctttctctccttgtttttttaaataaagcgtcatcgtgaggcagtttcctgctgcacttggtggcttgttgcatttctgtgcactggggtcatgactttctgtgcagacaaagagcagagtggcaagtgcagcgtctgcagagactttggcatagctctcttgtcaccgagagagtcctttcctctatagtctgtcgcaactaggtgcacgggttgatttattccatgccttcacctttggctcactcgtgtgagcctgagaagagagtggctttgtgaagggcatccccatgctggcctcttcccaaacagccctccttttgtcaggagtcggctgggaggggacctcagctcaactgtgaaaatgtttgtttatacggagcccctgatgagccttgggagtctaccttcctgtccccagaaacaaaacagaaaaagcctggactttgcagtcttccatttgaattgtacaggtgtctcttaacgttcaaaaggctaacctggaggtgtgctgtgtgtctccaggtgccagtacggctggcaaggcctgtactgtgataagtgcatcccacacccgggatgcgtccacggcatctgtaatgagccctggcagtgcctctgtgagaccaactggggcggccagctctgtgacaaaggtatggcccttagggatgagacccagggtgggatctgggggtgggatggcactaatttggtttctaattttattggcaggggcttttattctgaattctccttgaatgctgtgtgggttttctggtttttctttttaaaagacgactggggctagaaacatggtgggttcgccatcttcacaggcgtctcttagtgactccaggatctttttggcagatctcaattactgtgggactcatcagccgtgtctcaacgggggaacttgtagcaacacaggccctgacaaatatcagtgttcctgccctgaggggtattcaggacccaactgtgaaattggtaagtggtccaagatgaatgagagccctttgtctaatttttctgtactcagcttttaaaaaatatacttaaggacttgtttaaggaaaaaaaagtgaaaatagcttccaaagataggccttatcccaaccattctataagcctttgtaactttcaagtctctaaagttttttgggtgatgctgattcgtataggaggcagcgggagatgaaatgaccccagctctgagatgtcttggaatgtggttagagacagctcagcgagaaagatgacttcctttctttcctagacacagcagggttctatcacacgcttgcttttggtttttgaaatatgcttgcactagtggctgtggtgtgggattcggttggaggggggtgtggggaggtaacggtgtgcaggcatccctctctgactgccatcctggtttttgcagctgagcacgcctgcctctctgatccctgtcacaacagaggcagctgtaaggagacctccctgggctttgagtgtgagtgttccccaggctggaccggccccacatgctctacaagtaagtccaattttcagcctgtgtccattctaaggatccttgtgccaagataccacgctggggagaggtacctaggcttgtccagtgtgaatgtctcggtgagagaggggcgggtgcaggcctaagtctggtaagcagtctggtggcttgtgtgtttggaagtctcccagcacccccatcctgtcccactaaggtagcgcatgtatctgttcttggaaggaacgtcctcgtggaatcgcttgttcctttgcatctgcttcctggagctggccaccttccaattgtggttattcttcttgcagccatggagaggctgccttcaggggaggttgtcacttactactggattctgtcatagggccagggggccccagagaagaacctggcctgcagagttcctttggctgtgagacagggctgtatatcagaatcacctgggctgctttacagtgtaaatctctgggtcccccagattccctccagaatcggggagtccatggtctttgataaacttctggaattctgcagtgcagccaggtctgagaaccgctgtcatcagcaccccaggtgtggttatggatgtggatttctggggtcagattgcctgtgctggtcctaggcccccacctgtcacttgcggaactccagcaggccacagaagctccccgggccctctttaaatggcacagtagcaattcccatctccgaggttgtcataaagacacaaaagtgaatacttcataaattgttaggagttgtctctggtcagagcagaagtggagaatgcagcctctaggtgtgctattttgggcaaactctgtaagcaaatgagaggaataaggttttccacctgtaaagaactatttttcctgacttcttagctacttctgagccatgatgaaacttttctttaaaaataaagattaggcagatagagatgtcctgtgttcctcctgggcggatgctccgtcagtatccagctgtctttctcccccactgcttaggttggggattacatgaactggggcagtgggggatttaaagctaaaatcaaggcttcggccttatcgtcaccgtcccacttgtcctgctgtagctttccttgtagcaggtgtctggctcttcaatgacagcccctcatgtaagaggtgatgttaaaggatctaattgtcagatggattgaattaaattgtcaaccccctccttttcttgttgaccagacattgatgactgttctcctaataactgttcccacgggggcacctgccaggacctggttaacggatttaagtgtgtgtgccccccacagtggactgggaaaacgtgccagttaggtaagaacatccctgtgactgtaatttttataccaaggttggctttgattgtcaaagccattacagaagacgagcgtgtggccggcagtgtgagttcacactccatcatgctaagaagtaatttattatcaagagtctagcaggcctgggagaaataacttgaatgcaaatggactagctcttttaggccctgtgggaaagtcgtgggattccttgaaccatgtcaatcgtctgtccgaggagtgttcagctgggttccaaaaggggatgatctcatgaggaatgagctgtctgcattctttttgccacatttaaatcccagcaactaggctgcctgggttttgcacagaaatgcctggtggctttctgctgttttgttgggggctggttaactagcagctggaaagttatcaattagggttcttattggataatagctagggagagggatcagatgcttaaaatagagggaacctctagtatcttttatttagctagcttattaaaatgtctcatgtctcagacaaactctggcctgttctttttttttccaaggtgggggagatgggggttgaacttcatttctcatgctcatccccatctcctttcagatgcaaatgaatgtgaggccaaaccttgtgtaaacgccaaatcctgtaagaatctcattgccagctactactgcgactgtcttcccggctggatgggtcagaattgtgacataagtgagtgactttgtttccattttgattttcatgaaacttgggtagccgacttgctggtccgtactggggctccagtcctaggacttgagcagtagaaggaaaaccttagagtgggaatggttttttgagagggagtggtcagggcagcagtgaaaacatacactttatcaggctcattagctgcgaaaaccagccatattctgataatgtggctgaaacaatgatgtgaagtttcactccctcattctggaagaattagggagggtccccacccagcgtaataaccttatctcacggaaagcacacaggaaatctgatttgaaacttatctatcctgagctgagaaggcttttcaattaagcccaatttcactgtaaattacctctttaaaatgatgacttatttattttttagatattaatgactgccttggccagtgtcagaatgacgcctcctgtcgggtatgtaaatctttgcttaaatcaaaactttgacaattgacaacaaatctttagatttgtgcgacactaggagagctctgtccctgtgagatttaaaaatttgggtgaaaaaagagtctcttggaagtttcgctagggcttatgttaccccagcctcgtgggagtcattttgaaggcatgcacatagaaattcctctaaccactttcagaggtttagcatttggctatttcagtgaaccagctaaaccgcaacagtcatgctaaaccgctgaagccctgtgtttgtggaatacatagaaaaaaagcatgtgtctctctctccccttctcctcttctaggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcaggtgagtggtggcaaaacctcagatggccaagtttttagagcagagccgctgcctcctccgcttccctttacttttccctcagctcttgtgtctggaatttcctaacatctattaacatcctattgatgagagagtctctgctagacaaatgctggtggaaggagatactgacgaattattttcttcttagtgtcttcgtctttgtgttctttttggttccctccaccccctcttgtgctccctctcccactctgccccgttgtttcaaatactggacattggcagtccctacagcatagagatgtatcttacagggtgtctcctaatagaaaccgaaggaactgtcagattccagtgcctgctgccccagagaagttatcgtgacacctttgttttactctgatccctcccccttttcgctgttcctgatatttgcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaaggtacctcccttctcccgggacctggctgtctccagacttgctccttttgtccccacttactaccactgccccttgttacacttgagaagtaatgtattggtgaggaggacctctatagtgaaatgatcctgcctgtgtagcgggccgcaacacgtggaaacaatctattccggcctgccagtgggagagccgtgtctacaagtagcccaggggagagaatgtgaaatccatttagcattcctgttctggggtgggctgatgtgcaacgctgaggcaaatgcctgagaacaacactgtcaacagaacttcctgcaacggcagacagagggggatgttctgtatctgcacggtcaggtatgggagccccaggccatgtggactgtgactagtgtaactagaaactgattttatttcattttagttcatttaaatgtaaatagccacatgtggccggtggctgctgtattaggcagcacaacatttaaagcttctataagattgtccttgagccttgcttaagatcaaaaaggaagtaaataaagcaggtccttttgccttagcaagtgtttaccaaattgggtagatgtcaaaggtaggatgaaggggatccacaagcatgtgggttttcctggttgtgtggagggagaaaatgctttaaaactctttgcctggagtctcaactttgcctgtcataatgtgatgtggcacgttgccagtatcttggcttccctggggtgtgtctcattagccagagggtccctgtctccaggaaagtgggcttggcccaggcccttggcttaggaatgccgcatctgtgggtgcatggctgtgatctgatcccaagcctatcttctagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaagtaagactccctcatccgggaatggaccagtgctccccagcctgcccctgcccctgcctctgcccctggcccaccctgggatcattggtgttgaaagttttttttttttttttgagaccgaatttcgctgttgttgcccaggctagagtgcagtggcacgatctcggctcaccacaacctcggcctcccaggttcaagcgattctcctgcctgcctcagccttcctgagtagctgggattacaggcatgcgcaccacgcccaccacgcccagctaattttgtatttttagtagagatggggtttccccatgttggtcaggctggtctcgaactcccagcctcagatgatccaccccccgacccccaacttggcctcccaaagtgctgggattacaggtgtgagccaccatgcccagcagtgttgaaattgttttaatcagaaacagtaaggctggggagactggttgagacttatccttacatctgggatctaagactgaggtcgtgttcaatttaccagatcactctgcctcggagcctccatatctatgttggaacattctggaatgttgctaggttgggtgattcctcttttctgtaggagtttcttccccactttcacctagtaccggtgactaaatgcccatgtgagggcattaagtgggtaaggcactctctggaagcttctgcttgataagccgcctgtctaatttgagaaacagccctgatggagggtagcaggtggaggtgccaggtgcattgtgtcaggagggagccatgaaaactgctgaacagtgcttgtctatggcttcacaagtccttcagttctttttttgctttactttgtttcatagatattaatgactgtgagagcaacccttgtagaaacggtggcacttgcatcgatggtgtcaactcctacaagtgcatctgtagtgacggctgggagggggcctactgtgaaaccagtgagtctgccactctttggggagctctgggatgtatgggtcatgttggagggatcccacttcaacgtgggaaaactttctttgtactggaaatctctggaagcaagaccgcagtgatttctgcactgggacagtatcacttgtgtctcatttgcatttatgagtcctgatgatagcttatggggaggagcttctgctgaggacctatagaattagactgtgtaataaatattcctgcttgcaaggaaagtcatatttctactttcatttccatgggacttccagaggcccaccccacatcttgcctaacttgtggcattcaaagtaacccagttgggagctcctttattcctggaaaagcctgattgtgttaaagtactacgactgtggctgttctcagaataggatgttggatgtaagcagtaggaaaggcttggctctcgcctgtcgtgaatggtcctggatctcgtcttcagccgattgtctcccctttgattctagatattaatgactgcagccagaacccctgccacaatgggggcacgtgtcgcgacctggtcaatgacttctactgtgactgtaaaaatgggtggaaaggaaagacctgccactcacgtaagtggtagttggccttggatgctatctctgggacccttccctctgtcttctgtgggagggggccactgggactcacactgaaatattttcctccaggtgacagtcagtgtgatgaggccacgtgcaacaacggtggcacctgctatgatgagggggatgcttttaagtgcatgtgtcctggcggctgggaaggaacaacctgtaacataggtaactttatgccccacgtgggatctgcagtgggcatggccacctgggcgtgtctgctggttggcccctggagcttatgatatttctctgggcctggttcttgcccctccagactgtttctggatactcagggagggtggtcgtgtctgctcttcttttatagcccgaaacagtagctgcctgcccaacccctgccataatgggggcacatgtgtggtcaacggcgagtcctttacgtgcgtctgcaaggaaggctgggaggggcccatctgtgctcagagtgagtgtcctccccccttgaactctcccagggctgtcggagcagatcctgacacccttggggacttgcaatggaaaccagaagcagagctgtttgatgtctgcttttgtatcacctgggtctgcattaatgacttgatgggatacagccctgacctgggcatgagaaagtcgccaataagataagtggagacagatggcgtctcagttcccagctctgggtctgaccagcagcctgtctccttccattctcacccccacccctatcccctaccagggcctcttcctgtgtacatgtgtcccacagcaaatgaaactaagtgtggtgcgggcctggttccaatttagcaaaggtattttgctggtgttaactacgactttatcatttgggtattaggaaaataagtggtggttttacttagggctaagaccgctttccctgttgaagtcctcactattaagttgtcttttctttgcagataccaatgactgcagccctcatccctggtaagtgtgacatccttttaagccagcactcatccactatcgtgtgtgtgtgtgtgtgtgtgtgtgtgtgtgtgtgtgtgagaatcacccagggattgtgtttaaaatgcaagttctgagtcaggaggtctggggtggggcctcagactgcttttctaacaagctcccaggtgaagcgatcctgctgccccatggaccacactttaattagccaggttgtgtcctcatttagagcagtgatttttcaaccttggctgcacaccagaatcacctgggagcttttaaaaatcccgctgcctgggctgcaaccaagacctgtgaaattagactttctgggggtgggacccaggcatcagtattcttttaaaattccccaggcaacggccatggggtgagagccactgactgtaactggtgtggtgacatgtgagtgattggcagccagagtaatggactgggaggttggtaaccaaggtggtctttgctttcttagttacaacagcggcacctgtgtggatggagacaactggtaccggtgcgaatgtgccccgggttttgctgggcccgactgcagaataagtaaggactgtctccgtctggttttcccaatggctttaccgcttcattccatgcctcaccccaagactttcatctttaaaaacaaagccaccattccctttaagtagctctcatagagcaaaggatctctctcctccagctgggattaagatatgccaggctggatcctcccaggtacctgctggtagttccctgggtggtgtagccctccttgttcttggggagagagtgccagtcacagaatctgatgattaatctacagtggggtcctgaagaaagtatgtgcatttccccatgactaacatgaaattatgggcaagcagatgttaaccacagctacactggtataggataaagctaatacaaacggaagggaggacgactgtggcttccagaggcttgtctgtgctgggtctgatcaggccctggagaaatgactaaaacaggaaaataggggcaggcaacgcagtttttcaagaggcttaaagcatattattttgagccttttctctacttttttacaagccctttctcttacagaacaaaaaaggtgctagagtagttatggtttgattcttgtacccaaattgtctgaaattttactggtgcttgaaatccaagtctgggattaactagtcttcagcactagatgggggcaggttgtatctgtttcatgtttctaaataaacagttggcaaactgtggcccaggggccgtatccagcccactgtctgtttttataaatacagttttcttggcacacagccacacattcatttatgtattgtctatggctactttcatgataccacaagagttggatagttgtgacagagactatataccccacaaagcctaagatgtttactgtctgaccccttccaggaaactttgccaggcttgctgtaaattgcactgtcaaaggaatcaaattaaaaattgctgcctcccaaaatggttctccactgttagaactcaggatggtggtggtctttgggagccagtgattggaggtttttgcaatagatctgtttcttcttttggatgctgcttacctgagtgaaaattcatcaagcttatgatgatatgcttttcttgtatgttatgtcaataaaaacaatctcaaaacattgccacacaccatcagtccctaaacttgaactccatttctcctagacatcaatgaatgccagtcttcaccttgtgcctttggagcgacctgtgtggatgagatcaatggctaccggtgtgtctgccctccagggcacagtggtgccaagtgccaggaaggtatgtgtgccaggcttcagctgcccatgggtcttctggggtgagcgagctttgcagtcaccatttgacttttcacaaataagccactgtgctcagggaagggaacacacagtgggactacaagggaaagggaacgtgaagagtcttccccaaaacaggtagctgttgtttttggtcagctgttgccacaaaactgtgtaccaaaccatcccaaactgctgtggcttgcagcaagcattatttttattgctcatgatatgcagcatgggcagagagattgcgctgtgggttgggttcagttcgaccagtggctgtgtctggggcatattcctttcatcgccagtgggtaggtgtgcaagaggctagtcaaaggctctgctcacatcacatctgccaatgttacattggccagagcaagtcttgtggccaagcgcagagccagcaaaggcaggaagtacacatgctgttactgtgggaagaatgatcttaacatggcaaagggcacaggcataaccatttcataacagggaccaaagaattgaaccccgatccggttcacagaaaaataaactgctcacccgtctccacctgtcagtttcagggagaccttgcatcaccatggggagtgtgataccagatggggccaaatgggatgatgactgtaatacctgccagtgcctgaatggacggatcgcctgctcaaaggtaggacatgatggctgccgcagttcacctgtgttctggaatcagggatgagcatgcctgctaagctgccagcttctgtttttctccaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccagtatgtaacaacctttgttttttttttgaatggtggatgtctgcttgcttgctttaaaggaggaatgccatgagctaggatctacttctccctagcttacattcctgttttataataaagtaagcttgaacttagccagcctcaaagagaacatctcagccttttgttcttcctctcaatcttacacgtgtgtgggtttttaaaaatcgttttagggtcttactacggagcacatttgcagtgaattgaggaatttgaatattttgaagaatgtttccgctgaatattcaatctacatcgcttgcgagccttccccttcagcgaacaatgaaatacatgtggccattgtaagtataagacccattcacacctcattattcgatggcaaggcagttcggttaaccagtgtctgaatggagcaaattcactgacaaaaagctttgcagacacagattgtcgagtaattttgaagaaaggctgctttgagtattcctctgactctcaagtctgacaattgtttttccagtctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacaggtaggtgtcaagtgggactagtttgtgtgatgatagtagatgatctcattatactattcaataaagccatcaggtcgagggattatctggcagtgccctaccctcgcaggagctcccaatttaactgagaactgagggcagcctactttactaaggtcacatggcccatgggaacagaggtctgcctcatattttccttcccaacacactatgcaacgttccctgcagaacaggtattgtgctagatccgtgacaaagccctaggacactgcttgtcctttgtccttgagtttgaagctgtacaaagcctgacttggcattttggtgtcctgggacagcctagccactgctgagctctgtgaggctcgatggccccgcaggggtgtccaggcttccctcctgaggatctcgagcaccgtttcagccaagggagagattgggcatggagccatggcacgtttgagctgtctgtgctaatttgaatcggatttctagttctgaaaaccaactcctgtactgagctgcctcagtagccagacttaacaagacactgctctccccatgcgaagtcaaagagcctgtaggagctgccgctccacccagtctctccagggataagagtatcaaggtctacaggggcctgatcccagcatttgcttatcaagttgtgaagtgaccatatgcaatgatgaaaagggacttgtccctgtggcccccctcttagggataaagggcaggagaaccactgttggtattcttttgttcctgcgatgatgcttttttctttctttcttggagagttaattggttttgtgcctgccttacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattatgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccatgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggcc

SEQ ID NO: 2 - RNA, 36363 nt, Homo sapiens
cugcccggcgugcuggguagagguggccagccccggccgcugcugccagacgggcucuccggguccuucuccgagagccgggcgggcacgcgucauuguguuaccugcggccggcccgcgagcuaggcugguuuuuuuuuuucuccccucccuccccccuuuuuccaugcagcugaucuaaaagggaauaaaaggcugcgcauaaucauaauaauaaaagaaggggagcgcgagagaaggaaagaaagccgggagguggaagaggagggggagcgucucaaagaagcgaucagaauaauaaaaggaggccgggcucuuugccuucuggaacgggccgcucuugaaagggcuuuugaaaagugguguuguuuuccagucgugcaugcuccaaucggcggaguauauuagagccgggacgcggcggccgcaggggcagcggcgacggcagcaccggcggcagcaccagcgcgaacagcagcggcggcgucccgagugcccgcggcgcgcggcgcagcgaugcguuccccacggacgcgcggccgguccgggcgcccccuaagccuccugcucgcccugcucugugcccugcgagccaagguaggagcccuucuccgggccucccucccagccguccucucccuccccucgcggcgcccugggcgguugagccccgcgagcaggcucggcagcccucgagcgcccgacuccucgccccugcgcccgagcggcugcaccugggcugagcgcgccaacucccccacgggagccccugccuccugagggugaccccuccaggccggacaggggcgcguucgcuccgcuguugccccccgggaagucgucggauuucuuccgcacucgugcauuuuuuuuuuuuuuugccccggaaucauguugaguccuugaacguaguuucgcaaaauuauuuucacucggcgaggagggcucgucggggcggggagugggagggagucgccaccucuauacucgaagaaaacagcuuucucccgcgcugaccuaccuccuucccucgccggcagguguguggggccucgggucaguucgaguuggagauccuguccaugcagaacgugaacggggagcugcagaacgggaacugcugcggcggcgcccggaacccgggagaccgcaagugcacccgcgacgagugugacacauacuucaaagugugccucaaggaguaucagucccgcgucacggccggggggcccugcagcuucggcucaggguccacgccugucaucgggggcaacaccuucaaccucaaggccagccgcggcaacgaccgcaaccgcaucgugcugccuuucaguuucgccuggccggugagugacuacucgggaaggaggccgggcggagccucacacccgcgccuggccgagcccuguuaucccuugcgagagggauuuaaagggcuuuggcuugaaacuaggcgcuaacuggggaaaucucuagggguggcgggugagggagccgggacacuauaguuagaucucggcugggguagucgaggugggucccauuccugcugcuauuugcuuagugcacaaaaguggggaucccagaggguuuaugggaccaggcuccuaggaaggccgguguaaacuugcaacuugaaguucccagaguaacucucccggccccaagccaagagaucguuguagcugaucucuuugcuuaacuaauuaaaccuggugcgccguggaaggcgacucggcgcaguucuggccugcgaacgccguccaaauuggcaaccuccccuuucccgugaacggccgggagggcggguguguccuuccuggagggugugggggaguccguuucccgcugcuccccgggagauuuuagugugugcgggggcgcucuccagguucggcuuaagggccgggggcggccgccgcaggaggagguucuuggggcccucacaggagcuguagaccugggaacccccgcccgcugcuggccccuuccugcccccgcccccgagugguguagcucuuguggccucacuuccagcgguucccgggcucuggaacagcuguguuugcagacuuccccgggaagggcgggugcacggcccccgcaagccuucgggggccgugccaaggcuuggaagggguggucuucuggagguagugccugaggguguaagugauaggcccucauccccccgccccauuccgcccccaaaggagcucgaggcccgggcccagcuggcagauccugcagcgaggcccuugcaacaucccaaaauggguggaaggaagaugggugcgauugcagaaggggaggaaagggaaauguugggggugugcccucugccuggcuccugcuguccaggaggcaugacucauugccaagacuggggcuuggccuagccugugcugggaggguggguggugagagggggagcucggugccccagagcauugcuuuccaccacgugcucuaauggggugcacucugcugccuccuguccgccggcuuagguugugauucugggaggagacagaggggagacuaucuggcugugucuguguaugaagcuugggguggcucuuaaaauccacgauuacaggagcuggcauuauaaagugcccucugcugugggugagauaagacaguuaucaaaaacugccaugaaaagggguuuauaaaaagaaaaauuaaaaccaacgcugucugugaagcucucuugagguccaagggcuguuucuguugugggauuucauuuuuaccaagaguauuuaucuuguuuguuaauccccuauuagggagaacuuuaagcuaaagagucuggcugcguuuaaaucuggcuggcccaagcugacugugaauacucaaacugcccuugaacguguguuuggaguuuagggggaaggggccugcaggugguuccacccuccugccggaggaucugucuggagccccucgcuuuucacaagaccauaaaaggaaucuuauuagugauguggaaaagcagcagccuggcugaggcucauuuuggagaguagggucagagggauggcuaacaugaaaacaaggaggcuugcucccucgcuggccaaggaaaagugaccuagaaaagugcgucuguccgcuuuugacacuuggucagaguccucaauggaaaacgagcggaaauagugugggaggguaggagaggcgauugauuugcauuugcuggugcucuucugugguuucaggccccacgggucaccaaccaugaaauagacucucggcuuuucucgaaugggggaagaccgauggggcaccacugaaaaugugguucuuuugaaguugggacaaacgcauguaucacucauaaacaagucuccacccugaugccccagaaaggccugcugugaaacauaagauuuaauucucaagagaaauuggaguuuagguguauuuguuuuucuguaugugguuggagaaacggcacaguccguaacuuucaagaaugauuccaggcugaguagaaacguaacugaaacacuuaaguagcugagcgaguauuuaacuagagggcacagcuucauuuaguuuggcaauuaacuaugucuuuuaaaacugauuuccuugaaugggaaauaaaugaacuuaguacagaauucaagagauagcaagaaaaggauauaugguuaaaaacaaaacaaaacuccaaaccaccuugggcucccaaccccuagcaggcacaauuaccauuugcaugaguccucccaaauuugcugacgcuggguaucagcaaagggugcagggguaggucaguguagaaggucauguaguucaugcuuuuuguuuggaauuaugaccccuauccaagcaacuguucauguucuagagaggacgaggaggaaacgauuuggucagauaugaaauacaguccauguucuggugugcaugugaaaggcuuuguagagguggcccuuccugucauauaucauaucugaguaugucccacgugguguccccugccccggcucuggucuugggguaguuuuucaccacuggcuucuaauucucauacuguugcugcucuaaggggcuuaacuugcagcaacuaucuggauuaaugauucucaaauugggggaccaagugauaagaaccauuauugugggaaguaauugggcuuaacaggaaauaauuuaggaauuaccacuuauaaaucacugaaacgguuaaucuguaccucccaaaauuagugcuaaaucccaguagugccugcuuauuaaaaauacauuaguguaauuaccacuacucaucuccaaaagcuuuuugggaacuucagaaccccaguuagcuguauugcugcaucgguggccccagagugaaaugaaucuagagaaacguuaggggaagaaauugggguaucuggcuuauuagccucauauuuaaauuccauugauccuauuaaaagacuugcugagaucaacuuuuuuuuuuuuuuuuuuuuuuuuuuuuuuuuuuuuuuuuuggaaaauccaaugaaacgugauucuucugugugagggaugccagcuuuggcccccuucaugcuucaggccugaaugaccaauugccacgaugcuaaucacagaauguaauugacaggcccuuacuuuuaugccuuuugcugucuuuuccagucccugagcuucuguagauauggugugggcacauggagggcuuaaggaugggguucugauuugaccugccuccuuucugcagccaggauuugcauccugcccguguagucagcauguauacaaagaaagagcauguguguacguaugugcucagagcaagggacuuucugcauguggagaaaacgccuuuugcccuaagaagucuaccucaaaccaaagggaugaagugauguaucuguguugcaacacugggcuugggggaaagugaagcugugcuugcuuugaaagagcugugcuaaguaucugcagaauagcugcuccaaaaauggaaucuuuauuccagguacuugguuucuaauuuuuuuuucucuugcagguguaaccuucuguguuuucuuucuccuuguugucuuguuucuuagcaacuuauucaaaccuccaguacuuauaggaauuugcaacccaccaguuccacacccguaauucuacagggacuuaagauguuuuuagaaaacggugaaacuuuggcguggaggcucuugggggaguucaguggguuaaaaggagagucagcagcaacuuacaggcaugcaaccucccagaaaaucagcaaucuaagugcugcucaaaaucuucacaccaaauaguggugccuuuggggaccuuuuagauagaagacguggaaaguuuagcauggagaaaaaaguuacuuaaaaaaaaaaaaacagugucaagguaacaaggagccuucacaguuccugaucugaaaacaggaaugugaaccagaggccuuggcuggauucauaucacccacuggccccauuguagaagggccagaaguuggucccaauguccggcuuucaagguuagugacaauguaagaaugcaugaucucuggaugugcauacaauuagcguuguaauccauaaaugcaaauacuccugcaaauucuuccaugguaaacuucuguaaggcauguugcucuuccaccuacccccauccuucaagccuaggaucuaggcugcugagagaagugacucuuggcuucagcuuuuaaauauauauauaucucucaaaacuuaaucuuuucuuccaacuguuggaagauacauugggaugaauggaaaguggugauucuaaaauggugguggaaauggaggaggguccuggguucagaaaaaucccaccuuuacuuuggugcauggcacuggguggcuguguugugacuucuuugcugauuucugauuaccgcauggaccacagcagcccugugacugcuguuuuuuuuuuuuuuuuuuuuuuuuauggugccagugacaucuaccauuggugcagugcgugugcugggaagaaauuccgcaagguggcucccaguaguuaaaggaguacauaaauagucaaacaugcagaguccucuaccagcucaacccaguuuuuaugcacuuuugguaaauaaacagaaaggcuucuuguucaggcuugcucugugugaaccagaccguugugcuuggcuggcuucuugguauucuaucuauuaaccucgccacccuuuuguaacuggugcauuuaauuaucagugggaugcuuuucaaacagguaaggguaaugaugggaaaggggguggggaugucucauugagagucacaaaucuggauaugagcuuuggggccccuuggugagccuuugagugggcuuugaugagaaaaucacccuuuguaaccagaucggacucuauugacaugucaagcccuacagacuugauugcuuucugugccugaagucuuagccuagaugcuauaggauaguuguccuuucuuaucucacuuucccaaaacccacucgcauugugugcaugaguacgugugcaugcgccacacauggacucccugcaaccuuuucugcuuaauauguuuugugacuggaauauuuuauacucuggccacccagacacaggcaggacaauagaguuggccgaauugacugaaaugaggauuauggagaauaauagggccucuccaaaaauaaugcuaacacaggacaagcgacaggaagcaacaguugagucagcagagcucagggccccugacgaacccugggagccgacugacugugcacaauggccgcguuggcacgucgggcauucccaggaugugcgugccgccggcgggccugccugucgcagcagccugggguuuuggacgccgcacgcgugccguuuggauggcgguuuauuuguguccgucagcuuggcaggaggggaggcagccgcuucucagggcuugguuuggcugucacuguugccaggaaaaggaagcucccggcugccaacacaauuaccuuuguuucuuacauccccccuucuuaauguggcaauuaagugcuuaccgcucugcccagugccaagguaaccgccauggagugggacagggcagagaacacaaccuuggcacagcagccuaaguguggagggcgggaggaggugcaggggccccagccuugcugggaaccugguggcccuuggaugccuuggggcuuugaugccaggacucuccucuagguagaauuccacagaaaucuuccaaaaagcaauuccgaaggcugaccauuccucuuugaugccacaccagaaugggaaccagcugccagguuuccagauuuccuugggcuuggagcugggaaggggcugaagugacucacuuugcaaauccagacuaaagaucuguuugcuaccccuccuuccuguguggccuucacaguacuguucuggaaaacauaaggaaagaugaaagccaggugacucuucggcagagucuuaguucuguagucugaaaucaagaaaaacccagguauuugcuuuuguuguuguuguuuugcuguauaaacuuaaguuugaacacuugccuuuccaagcccuccugggauggaggacuccgccucuacugggggucagaguugcaguggcugcuuguaugugacuucggcauaguggauuugcugcucuguggccuggucccugcuuugauguggggugcaugaucugggaucucagugccuggguguauguucagggauguacagaggucaagugugggccugggaaaaauuaaaguucucuagcaacuaauaaucauuguuaaauuaucuugauugcugaucuauaguguggggauggagugggagguugagugccuccuaauaggaaccuuggagggaauccuuuuucucuguagggcugggcaggaggaauccuccugccccaggagacccuaauccccucccugaaacagacaggaaaaaaaguccaggcuuuguugccgucacuguagcucccugcccucacccugucucugccucugagaaagaagggcaguucauggaaaaucacagagccaggcacguagggcugugugcaauucuuuucucuccagguggggugaugucggucagcaacuucugagguuuucccaguucuggcgaggaugagccugguagacugcuuggucguccaaguucuugugcaagaccuaaggaugcuuuccucuuugaguauuaaacugaguuaguacugccaugccagcucagucccggcaccuucccuugcagugggguuuguggguauuauguguuuagcgcuugugcaagucugucaaaacuccugguaucaaugcauuuaaucagaggauuaauuacaacaauacuguugaaguggaggacgugggccucaacgugaccagcaaaugaagggcuuaauuauacagaaucagccacacaucuggccucauuuugacugugcucuuaccucaaaucaguagagaaauauaauuucuugcugcucuuagggaagaguccuguaauuugcaggaaguccuaagaaacuuaaagaggcaguaaauaagguauaacuuucgcuaauaaaauaguaacaacagcaaugaauuuggaccuguggccacuaacaggagagggcuggguaugugcccuggcuugcccgguuuugcuugcuuuucugagcauuuucccacaguuaucagugaacgaaauggaauccuacucugcuuugaguaugaaacauauuucggcugaauuccaaggcagggucuaucacaagauauuuuuauauucagagaugaccugcugugucacucugagagcgcuaagcuggccuugaguuaugaaugaaacucccuuuuacccucccuuuuucucuuuuuccuuuaucuuauaggugcuuucucuucucuuggcagcagugugcuucugguggcacagcacgguauuauuuaaucuauacacgcuucuauuuccuauggcuugguuucugacacagcaaagcagggauucauaaccuaguucauguuccuugucuaccccaccugccuugaguacauuucuucagugccaagauagcagaagcuucauuuaaacgcugguguuuugugagacugaccuuacuguaaauuacgaaggaaaauuuuagaaaaggagggaauuugcuaauagcuuagguuuggcuggggguggggagguggaauucugagauaagcuuggaagauaaaaggugccuucaguuuaacagcuggcaucuugccaguauccagggaauuuguuuaguuaguagacucugauuauucuuggaauguuagaucuuauuaacagauaaguucaucaauaaauauaacccaugggugugcgguuguuucucccuuuguacuuucuucccugggaucugcccccaacuccaccgcccaagugagguugacuucuuugucuugcagagucacuuugcaucuacccccuccuguuuccuagaguuacccgauacuugugggagccaggauggucucacauagacagaguuuucaaagggguucuaaaaaggaaaagggggccucccuagagacugccucaccagggcccaaaguguaaccuuagcaauacccccucgguacaaauaccugguuagguuagcuuagaauaaauucuuuguguguguguguguguguguguguguguguguguguguuuccucaugcacuagggucagggucuggaaaguuuugggaaacuauaugcuaaauacucucauaucauauagugagguggcauuuccugaucucaacuuugagcugccugcaugcauguugacuccagugcgucccugccaggugaaaggagucauuugucaaccugggaagagugcugacaaaggaaggggaguugguuuggauuuaaacauccaggaacucaaugcaacaaccaacagaauuuuuauuuuggcauuaugguuuuguuuggugggguauucugggaggccaagaauguacgagauuuuggaaagucgacccuguuucugaauugcuaaauuguuuguuugucuugcagagguccuauacguugcuuguggaggcgugggauuccaguaaugacaccguucguaaguaucgcuucuguggacuuuucucuaaacacacguggaaguguggggcuuggccaaccaguuggagcuggaucugucuccuuaguacuuagcauuucugccaccucuugccuucuguucuccccuguaccccagggugaaccuucaguggaauguauuccuuaacuuuucuaggauuuuugcuuggaauauuaaguggccagaacagaaucccaguuaacucauucccugauuaugaaaccuagauuaucuucgggauagagaucuuaaugguuuuacaacuuuaaaaccuuguagucugcuaaaggaucaaaguagugacuuuuuaaaaguccauuuaaacuuuaagugaguguuuaaucucucaucagaaagauaaagccauaaagguggugcugggcucuagagaccgaccuugaauuucacuuggugggcaggugagcuucuagucucuccggguuucccacacugcuccacaaaccuuucauugaagcgcaauuccagagcuucacagccauuaccugccuugucccuuucugaaagauggcucuguuuucagugcagguugccuuucaggacugagggguugguuuugguggauaagccauggaggaugugauugaaaugacauagucuggcuuacaaaguagucuugcucuuuaauuguaacuuuacaguguuuucgcucacgagccgaaacuucaaguucccuuuuugccagcagaguuuggguugcggucgcuggaaaacuugaugcucacugaaaucucuuggucugugcaugaggaagaguggauccagcuucuugucuuggcucucuguucucugaaugccuuguacuuuuugcuuuucuaucuuaccauuuuuuuuuguuugcuuucacugugaauaauauauuuucaucuuuccuugccuugcuuuuuuuugcugacagaaaauggugaaugcacaccgugggugcagugagggcuuggugccugcuacgugggcagcuuccaccuguggcuggcuuauugggcuacuuggagccacagaaucauugcugagcuccgaugugccagagagucccaggccauuugggucacucuucuagcuugggaaucuuaaguccagcuuuuuggaugucauccucccuggagggggagcucaugaaaguccaagguucgagucuuccuccccagagggcuacccuguaaugccguggggggguguguguggggguggcagggaagcucugucagccuuggcuauggcugaugccagucagggucauagacaccuguuuguucuccccucccugccacaaacguugaggacugugaacauuaugucacugugaccugcuuacaaugguaacuaagcguuaggcagaagggguugaggaggggggagacauaggcucuucuguaauaguauggugucgacaugguguucuuuccccucccuuuuagcuauugaaacaauccacccgguagagugaacagcuugagguugauccuggccugugauaagagccaggucaguauacuuguuagggacaugugagagaccuccccgccacacugcagcauucacagcaccuuuccuggaccuccugucaccucgcaggucagggaguuauguccccugggaacccagggcuuguccagagcuacccacaguugucugcauuuccagguagcccgauuuugggguucuaggauguuucaucuccuggggggguaaucaaaucccuggaagaggacaagaaagacugagguaggaauaaaguucuuuuaaaccucaagggugcccauugcagguuaucaaaacucacuuggugaacccugaagagggagauggguuugguggaaaugguuucuccacuugccuauuuggccucuuuuaugaugcuuccaaggaaucuugaauucagcacagucaaaaccaaacucaggaucuucucuugccaaaagcagucccuucccagggccccuucugggugucuggcaccgauauuugaacacucauugccauaagccagaaauauagaaggcgaucuguguacccccucucuguuagcauccauaccuaguccaccuccaaguucugaaaaaucucuccagcucuucacuugaaucugccugccuucugccacugcccugguccaagucaccaucugcucaugacugaacuuagaguagccuucgucugguccaccuuuaucugcucugacucaccucuagugcuuucuccauucuucugccauccuggucuuuucagagccauaacauuugcuugucacccuuauuaugaaaaaccaaccacuugguggccuucuguugcucuugggacagaucuucauguggcccacaaggcucugugcagcccagcuuugucucccugccagccuugucuuacacaccguguuguccaucguaucuguagccuggccauacccuagcaguugccuuccuauccucaacuacaucacaugcuuucuggccucaggaccuuugcacaugcuguuuaugcuacuuggaguguuuuguuccuuucuucacccucagccacucccucuggacugcacuccacagggcagaagcugaggauguucagaagcccaaacggaguuggcugcccugugggacccaagcgaguuguaaacauucuggcuucagauguaaaucaaaggcagagcccugaguuuuagggcagagaauuccuucuaucagcucugcagugagcccucacaggcagacucgggcccaaauauagccuaggugcuguuuauguauuugaaaguauuuaaggcugguccuucugucaucgguccuccaaagucuuuuauuacauuuugggacugugguauauagaguuccaaauuucuuucuccccuagagcaaaugguuucaguuuacuguaaugcauaauaaacauguaaacauaaauaggcacacuucagaccagguuuucccuguagcuuagcuuucucggcuaaggcccccuuccagguuuuugggucgguguggucccagguuaugcucagacucgcccuucaucaccuccuccuuggccugcgaggcggucauggcuucuucgugacucaucuucguggcacuggggauugcagggaggcauggugauguccuuuuccagucacaaggcuggacugccaaacgaacugccacagauuccuuuccagugccccaagcugaaggaaagcgugaucaggaagcaggcagcagacguauuugaacccagacaugcucgacccccucccugagcaggugugaaauuauguaugcagcuccauagcuccacugaggauucugaagugauccucugcacgacacuucccggaaauaaguggaaagcuuacugcaugacugaaaaguacauaucaguccugcaccccuaggauugcccuggacucuugucuaaacuguuuguuguugauaccagccucagaagcuggaugccuuuaagccauggcuaguguguuuaaccgaucccuuuuaugaagaucuuguaagcgcgugguaauagcccacuaugcuuuuuaacugaaccagcagagcaaacauaguuaauggagagacauuuuugucauuccuuggccucuguuuauuugcaaaaacgaguaaaguguuaccugccugcaagugguucagugcgugccggggugucaggcugcagguaugugagcuuguucaaggcuugucuugcccacgcagcaguuugagagcccuagagggcgaacgcuggggcccuguuggaagcgguguguggaugaagccacccaggagucccuucucuccuggucacuuauagggcuugcaucacuuuuuaaaggagcacuggcccgaggccuagaaaaacagccauguggguggguaagaaucacaaagacauugcaagucaguccuaacugucucuccaagauggucuugaauuugacaaggugaugaagaguuggugcuggcagguuuaagaaaacaaacacaaaaccagguuggggugcugauuuagugccuugcugccuuuucagaucccuccccugaacugcuggcaccugauguuugagcuauuuuuguaccugucucuucucaaacuagaugauaaguggccucagggcagggacuacauacuccugagagcugcuugagcucgagguguuuauuauccucaguaagcauuuuuuuucaggagcaugacuuggcucaaaaaaacaaaaagaaaaaagaaacccuccccucaauuuaccugugucuaaacuuuggugaauuauucucccaucugccuucugggcagaggagaaagguggaaugcaucaaguucaaggucuugguauuuaagagcuggcuuuaaagguugccauguuaacaauuguaaaaaaaaaaaaaaaaaaaaaaaaaaaaguaacuuaaucgucuccuuggcuuccaguuaagaguuuugaaauggacaaaaagcuuuucugagcaagacauaaaacccuaaaaccagaaaugauugcugaccuuuaucuggaauaaugaaauuucuucaagagcaacauuccauagggagcuacugucucucauauguaaagagcacuugcaagucaguauggcaauguaauagaaaaguuggcagagaagagaagcuguugcuguucacaggaacaaauauaaaugguuuuguaacuaccagaaagggcucuugccaucacuuaguuaaaugcuaauuaaaugagauaccucuuuaccuaucaggcauagauuagaagguuugauaauguacaacguuggcaguguuauugggaaacacagcuuccuggguggugggaggacagacugguaguuugagacuguggacagagguugauuuguugugcacggacucugauucagcacuuccauuucuagaguaucucauugugggaaccauacacaggcagauacguucaaggaaugcucacuguggcuuuguuuaauaguaagaagcccaaacgacucacaugcacacaugucagggacuagguaaauuauuuauugguguuuccagacaaugaaauacuguguacccauuaaagaagguaaacaagugguaacagguugucucuggguaggggcauaaacuuuucauuucuuugccuuuuuuacaacagauagaauuuuguagcaggugcauauguuuuuauuuuaaaaagccaaaauggucagggaagaaggcugcaaugugaauauuaacaugauucaucacuuugucucuagaaccugacaguauuauugaaaaggcuucucacucgggcaugaucaaccccagccggcaguggcagacgcugaagcagaacacgggcguugcccacuuugaguaucagauccgcgugaccugugaugacuacuacuauggcuuuggcugcaauaaguucugccgccccagagaugacuucuuuggacacuaugccugugaccagaauggcaacaaaacuugcauggaaggcuggaugggccccgaauguaacagagguaugugugugugugugcaugugcacgugugccuguugcuuuuaguguccauuuaucaccccaccagcaggcagguggcaugcggcuaucucagguggggugggauuuuggcuguuauucugggccugcaguaugaagaugcggaguguagaagaugcuguuggugccccauccagauccccuuuacuggcauccccaucccccaggugcuguguuggcugccaacagcucacagcugcuccuucucaggagacucguccuuggccaaaccagugcaugccccauuccuccagcucacagucagugauugacagacauagggcuacaaagcccagcuuccuuugccuuaaaacaguaguacaauuugcacucuagagcuuacccugggauuaggcugaaaucagacuccaguugagaccauguucuugcucagcucuuuccccuaccccaucugcuucccucaauuccuucuaccuauguccagauccccuucucagacucugcuucuaaggaacuugacccaaaauagauccagacaggacuaggucagcccaguuguugucugaacaggcuauccuauaggaaaugauagccccugcauucaggguagccuugcagcaaguuuucacuaggugucuuugggggcauggcuuugauggggagagguaugugguuagcucaagcuuuccuauugguguaggagugggcccacuuuuagucucugugcugucuacugucccagucccuuuauagaauucagugauuccaauucauagcaacuugauggguaauucuguuaacuguauaauauccccucaugagcaauaauguacucugcuuauuuuacaugauaauuagguaaauuguuuugauagacucaauuucaaagugaguuuuucaaccaugagagaggggugggucaugggggaaggaauuuacagcucucccggguaguacuacugcuuucuuaaauaauuggagagaagaguuuaaaaaggauggcauuucuggaauucaaaugaaaaggggaauucauuaacauauuuuaguguguuuuaaaaauuaaacgaccuaacacuuaguguggguuuuuuguuugguguuuuuuuuuuuuuuuaagauaaggugcucacuuugucacccaugauggcacaaucauggcucacuggagccuugaacuccuggguucaagugauccuccugccucagccucccaaguagcugggacuauaggcacaugccaccacacccagcuuuuuuauuuuguguagacauagucuugcuauguuguugaggcuggucucgaacuccuggccucaagcuauccuucugccucaaucucccaaaguguugggauuauaggcaugggccacuguugccuggucuuagaaacugacauuuuuuagaaguuacuuuuuucuuuuuuuuaaacgaaguagagaauugcucugcaaggauacuuuauaaaagucucaccagaucuggccaccagauuagccugcccaaugaguccagccuggcuggcucuguuagucccauggaauuuucaaaccaggcauuugguauggguuguuuuuuuuuuuuuuuuuuuuuuuaaaggcugaggcucaucugaauguguccuggugggauggggaaggauuaucuauaccuuuuuuucuucuaaugaaaagggugugggcagaauggaaacugaccaagcucugcucaaggagccaggguagcugugguuuagagaggcuggacgaaggucccccuucccucgucaacuugucugcauuuuguccccaaacaauaucauguuuucagaaucugcuaacaaggccuugaaguuuaaagcugguuuuguuauuugggccccucccaucuuccucuccuuacaagggacuugauaugagaccuguuaaaaucguggaauuugcagacuuuaaugcaaugggccauucucaugaccggggcgaugcaaggaacaggcagugugcugacacgcccuucucuguuuuuuacagcuauuugccgacaaggcugcaguccuaagcaugggucuugcaaacucccaggugacugcagguaaaucaacuggucuuuugugagauuucuuuuaauuuuccuuuauguaagagaggaacugacuuuauugugacuaugccucuuuuuuccuuggagaacaagaaagcuuuuuuaaaaaaaaaauucagauagacacauccgaagcuuauuaaauuauaccagcugucugguggaaugcacacaccacuucucucuuggaauaaaaagaaacucuuugggcauagccagugacuucauguauuaacuguucuguaaauugauaacacauuuuuauaaucuucccuuauagugcugaugggcuagauggagggaugugggcuuguuucuuugcgucucucuccucuuccaccaaggcuuucuucucccagcccccuccccgacuuuucccaucaauaggcgaaaguccagcauucuuuagaaugggauuaguccaaucuccuggccccuuugcaggcgggagcuggguuggugcugagagguuaauggcugcccuggaaucuugucaguugagccugaugaauguagacuuuugcugcaguccuuugaagucuguuccuuuaugguccaggaacaaugcggaagccaaagggaggccugcccugaccacuucacgauggcggguuuuggaacuucuugaaauuuauauuacgcccguuuggaaaaggcuuauuuugggaaauauuguuggugucugugguguuuuuggcagucuuaaugcuuugcucucccuccucccaaauuuuaaggaguaacgcuaaauggauccuuugagccugucacuuuugcccccaaagcuacucugacaugaguaaagggaaucuuaugaaacauagucuaaaccaguaugucccaaacuaauguuauuuggggcucuuauuaaaacgcagguccugauucuauaggucugggcugagcccagguuucugcauuucuaacaagcucccaagcgaugcugcugauggaaccaucagcaaucacugcccccagaccucaguacucaaaguguaacuuccagaauuaacaagggagcuguuaaaaugcagguucgugggcuccgucccacauccauagaauccuaguccuugguuuggcccaggagucugcauuugacaagcuggccacaugacuuugcugcuuaguaaauuuugaggcuacuccuuuaaagagaacuaucuguggccuuuaccuuuaugauuccaccgcuccgucuguuccccucccaugcaagggggaacauggaacuaaauuaagaacugguugucccgaauugucucuuccuacacuucagaaagauaguuuauuuccuggaaggcugaggggcuucuccugcugucucccauugguggcgauggacuguaguauuuaacagcauugcuguccaaugcggagcaggaauccaccuaccuuaacucuuccuaauuaaggguguucuggagaaagucccaauggcagugcuauuagugauuccaagccugcugccugcucagauggauaucagcggaggccgacugugauuugugcugcugucaucagaacacacauacagcuauacaggggagggcccucccagccagaacaacaggcuuuguuuccagaauuuagcccuuucucuuucgaagucccaccucccucucccugcccagacacgcacugauggccuuauuuacuuaaggugcgacuuucccacacaucauuugcauagucucccagcccaguuuucccucccuaccuugaaagaaagucaaaacagaaccuucacgcugaggaaguucagguuguguccugcugcagaaauaguugaauggcaaguuaccugcaaguugucuuuuggauuauguauuacacagguuauuuuuuuuuucacccccacaugagaaaauuuacugguuuuuguuguucccaaguagacugagucccuuucccuggguauacaugcuugcuuauugcaagccugccaauaauaucaaacuuaauuaugaaucaucaucugaggaaagucacuucaauuucucaugagaaucuuaaucauauauuauuaaacugggauaacuugguuggugccucuuuuagggucaguauuuuuauuuguuuucuuuugaagucauccauggccucuugugguugcuuuuuuaugcuuggggauugaggucucuuuaauuaggugagguuggguccucagcugccucuccuugccuuuaugaggcaacuugaagagggcuagugauccugaauuuggaagagaauaagggaagacggugagaauauugccauuucguaaucaguucccucuuacuaucuuucaggcuaagaauaucagccuugacagaauggcuacacccuuaccucccacuaacguggguguccgcuuuugagaaauuauuuagauuguaauuuuguucuuaucuuacuccuuuagucacuugucacguugacauuccauuuuacauaaaccagaauccagugucuaacuuuaaaccacacauucuagugauuucuuugcaugugggugugcauagcuugguuucagaaguuaggaagugguuagucaguauucucagggguuaaguugacucucagccgugggugauuagcuauuagcuagaucccuauaauuuucccaugacaaggauuugcuagccugccucccgcucuugggaaaccgaaagccuuuccuucuggggagcuagagggggcggggguuguuuuccagaguuacagcugagcagcuuaggggguuggcgcugaucguggcuuuucccaggucccguucuggaaacauguugcccaucccacccgcaccccacccuccacccuccacccuccacgcuccaccgggaggcuaguugauguuucucccugccuucccccacccuuguuaaagcuuggcucuugagaaggcaauuaaaguuucagagggcuugaaaauucaagggagagugguuugagacgcugcccccucucccaccccagaugaaaguuguuguauuuguuuuuguuuuugcuuggggaucagaggcacuauuuggccccaaaagaguaugauuaaucaaggugcuuauauaaaagaaccucaacuccgccaauacuagauaaauuaagcagacugcuuucuuuuuuuuuucuuuucuuggcaaagcaagaaaucacuauaaauuagcacacaguaaugggacacaaauuauggaguugguuccaaguguugucauuuccuucuccuucccuauagaaguggguuuagagagccuacucuggcuuuggccaagggagggugccccuuucucuccuuguuuuuuuaaauaaagcgucaucgugaggcaguuuccugcugcacuugguggcuuguugcauuucugugcacuggggucaugacuuucugugcagacaaagagcagaguggcaagugcagcgucugcagagacuuuggcauagcucucuugucaccgagagaguccuuuccucuauagucugucgcaacuaggugcacggguugauuuauuccaugccuucaccuuuggcucacucgugugagccugagaagagaguggcuuugugaagggcauccccaugcuggccucuucccaaacagcccuccuuuugucaggagucggcugggaggggaccucagcucaacugugaaaauguuuguuuauacggagccccugaugagccuugggagucuaccuuccuguccccagaaacaaaacagaaaaagccuggacuuugcagucuuccauuugaauuguacaggugucucuuaacguucaaaaggcuaaccuggaggugugcugugugucuccaggugccaguacggcuggcaaggccuguacugugauaagugcaucccacacccgggaugcguccacggcaucuguaaugagcccuggcagugccucugugagaccaacuggggcggccagcucugugacaaagguauggcccuuagggaugagacccagggugggaucugggggugggauggcacuaauuugguuucuaauuuuauuggcaggggcuuuuauucugaauucuccuugaaugcuguguggguuuucugguuuuucuuuuuaaaagacgacuggggcuagaaacaugguggguucgccaucuucacaggcgucucuuagugacuccaggaucuuuuuggcagaucucaauuacugugggacucaucagccgugucucaacgggggaacuuguagcaacacaggcccugacaaauaucaguguuccugcccugagggguauucaggacccaacugugaaauugguaagugguccaagaugaaugagagcccuuugucuaauuuuucuguacucagcuuuuaaaaaauauacuuaaggacuuguuuaaggaaaaaaaagugaaaauagcuuccaaagauaggccuuaucccaaccauucuauaagccuuuguaacuuucaagucucuaaaguuuuuugggugaugcugauucguauaggaggcagcgggagaugaaaugaccccagcucugagaugucuuggaaugugguuagagacagcucagcgagaaagaugacuuccuuucuuuccuagacacagcaggguucuaucacacgcuugcuuuugguuuuugaaauaugcuugcacuaguggcuguggugugggauucgguuggagggggguguggggagguaacggugugcaggcaucccucucugacugccauccugguuuuugcagcugagcacgccugccucucugaucccugucacaacagaggcagcuguaaggagaccucccugggcuuugagugugaguguuccccaggcuggaccggccccacaugcucuacaaguaaguccaauuuucagccuguguccauucuaaggauccuugugccaagauaccacgcuggggagagguaccuaggcuuguccagugugaaugucucggugagagaggggcgggugcaggccuaagucugguaagcagucugguggcuuguguguuuggaagucucccagcacccccauccugucccacuaagguagcgcauguaucuguucuuggaaggaacguccucguggaaucgcuuguuccuuugcaucugcuuccuggagcuggccaccuuccaauugugguuauucuucuugcagccauggagaggcugccuucaggggagguugucacuuacuacuggauucugucauagggccagggggccccagagaagaaccuggccugcagaguuccuuuggcugugagacagggcuguauaucagaaucaccugggcugcuuuacaguguaaaucucugggucccccagauucccuccagaaucggggaguccauggucuuugauaaacuucuggaauucugcagugcagccaggucugagaaccgcugucaucagcaccccaggugugguuauggauguggauuucuggggucagauugccugugcugguccuaggcccccaccugucacuugcggaacuccagcaggccacagaagcuccccgggcccucuuuaaauggcacaguagcaauucccaucuccgagguugucauaaagacacaaaagugaauacuucauaaauuguuaggaguugucucuggucagagcagaaguggagaaugcagccucuaggugugcuauuuugggcaaacucuguaagcaaaugagaggaauaagguuuuccaccuguaaagaacuauuuuuccugacuucuuagcuacuucugagccaugaugaaacuuuucuuuaaaaauaaagauuaggcagauagagauguccuguguuccuccugggcggaugcuccgucaguauccagcugucuuucucccccacugcuuagguuggggauuacaugaacuggggcagugggggauuuaaagcuaaaaucaaggcuucggccuuaucgucaccgucccacuuguccugcuguagcuuuccuuguagcaggugucuggcucuucaaugacagccccucauguaagaggugauguuaaaggaucuaauugucagauggauugaauuaaauugucaacccccuccuuuucuuguugaccagacauugaugacuguucuccuaauaacuguucccacgggggcaccugccaggaccugguuaacggauuuaagugugugugccccccacaguggacugggaaaacgugccaguuagguaagaacaucccugugacuguaauuuuuauaccaagguuggcuuugauugucaaagccauuacagaagacgagcguguggccggcagugugaguucacacuccaucaugcuaagaaguaauuuauuaucaagagucuagcaggccugggagaaauaacuugaaugcaaauggacuagcucuuuuaggcccugugggaaagucgugggauuccuugaaccaugucaaucgucuguccgaggaguguucagcuggguuccaaaaggggaugaucucaugaggaaugagcugucugcauucuuuuugccacauuuaaaucccagcaacuaggcugccuggguuuugcacagaaaugccugguggcuuucugcuguuuuguugggggcugguuaacuagcagcuggaaaguuaucaauuaggguucuuauuggauaauagcuagggagagggaucagaugcuuaaaauagagggaaccucuaguaucuuuuauuuagcuagcuuauuaaaaugucucaugucucagacaaacucuggccuguucuuuuuuuuuccaaggugggggagauggggguugaacuucauuucucaugcucauccccaucuccuuucagaugcaaaugaaugugaggccaaaccuuguguaaacgccaaauccuguaagaaucucauugccagcuacuacugcgacugucuucccggcuggaugggucagaauugugacauaagugagugacuuuguuuccauuuugauuuucaugaaacuuggguagccgacuugcugguccguacuggggcuccaguccuaggacuugagcaguagaaggaaaaccuuagagugggaaugguuuuuugagagggaguggucagggcagcagugaaaacauacacuuuaucaggcucauuagcugcgaaaaccagccauauucugauaauguggcugaaacaaugaugugaaguuucacucccucauucuggaagaauuagggaggguccccacccagcguaauaaccuuaucucacggaaagcacacaggaaaucugauuugaaacuuaucuauccugagcugagaaggcuuuucaauuaagcccaauuucacuguaaauuaccucuuuaaaaugaugacuuauuuauuuuuuagauauuaaugacugccuuggccagugucagaaugacgccuccugucggguauguaaaucuuugcuuaaaucaaaacuuugacaauugacaacaaaucuuuagauuugugcgacacuaggagagcucugucccugugagauuuaaaaauuugggugaaaaaagagucucuuggaaguuucgcuagggcuuauguuaccccagccucgugggagucauuuugaaggcaugcacauagaaauuccucuaaccacuuucagagguuuagcauuuggcuauuucagugaaccagcuaaaccgcaacagucaugcuaaaccgcugaagcccuguguuuguggaauacauagaaaaaaagcaugugucucucucuccccuucuccucuucuaggauuugguuaaugguuaucgcuguaucuguccaccuggcuaugcaggcgaucacugugagagagacaucgaugaaugugccagcaaccccuguuugaaugggggucacugucagaaugaaaucaacagauuccagugucugugucccacugguuucucuggaaaccucugucaggugagugguggcaaaaccucagauggccaaguuuuuagagcagagccgcugccuccuccgcuucccuuuacuuuucccucagcucuugugucuggaauuuccuaacaucuauuaacauccuauugaugagagagucucugcuagacaaaugcugguggaaggagauacugacgaauuauuuucuucuuagugucuucgucuuuguguucuuuuugguucccuccacccccucuugugcucccucucccacucugccccguuguuucaaauacuggacauuggcagucccuacagcauagagauguaucuuacagggugucuccuaauagaaaccgaaggaacugucagauuccagugccugcugccccagagaaguuaucgugacaccuuuguuuuacucugaucccucccccuuuucgcuguuccugauauuugcagcuggacaucgauuauugugagccuaaucccugccagaacggugcccagugcuacaaccgugccagugacuauuucugcaagugccccgaggacuaugagggcaagaacugcucacaccugaaagaccacugccgcacgacccccugugaagguaccucccuucucccgggaccuggcugucuccagacuugcuccuuuuguccccacuuacuaccacugccccuuguuacacuugagaaguaauguauuggugaggaggaccucuauagugaaaugauccugccuguguagcgggccgcaacacguggaaacaaucuauuccggccugccagugggagagccgugucuacaaguagcccaggggagagaaugugaaauccauuuagcauuccuguucuggggugggcugaugugcaacgcugaggcaaaugccugagaacaacacugucaacagaacuuccugcaacggcagacagagggggauguucuguaucugcacggucagguaugggagccccaggccauguggacugugacuaguguaacuagaaacugauuuuauuucauuuuaguucauuuaaauguaaauagccacauguggccgguggcugcuguauuaggcagcacaacauuuaaagcuucuauaagauuguccuugagccuugcuuaagaucaaaaaggaaguaaauaaagcagguccuuuugccuuagcaaguguuuaccaaauuggguagaugucaaagguaggaugaaggggauccacaagcauguggguuuuccugguuguguggagggagaaaaugcuuuaaaacucuuugccuggagucucaacuuugccugucauaaugugauguggcacguugccaguaucuuggcuucccuggggugugucucauuagccagagggucccugucuccaggaaagugggcuuggcccaggcccuuggcuuaggaaugccgcaucugugggugcauggcugugaucugaucccaagccuaucuucuagugauugacagcugcacaguggccauggcuuccaacgacacaccugaaggggugcgguauauuuccuccaacgucugugguccucacgggaagugcaagagucagucgggaggcaaauucaccugugacuguaacaaaggcuucacgggaacauacugccaugaaaguaagacucccucauccgggaauggaccagugcuccccagccugccccugccccugccucugccccuggcccacccugggaucauugguguugaaaguuuuuuuuuuuuuuuugagaccgaauuucgcuguuguugcccaggcuagagugcaguggcacgaucucggcucaccacaaccucggccucccagguucaagcgauucuccugccugccucagccuuccugaguagcugggauuacaggcaugcgcaccacgcccaccacgcccagcuaauuuuguauuuuuaguagagaugggguuuccccauguuggucaggcuggucucgaacucccagccucagaugauccaccccccgacccccaacuuggccucccaaagugcugggauuacaggugugagccaccaugcccagcaguguugaaauuguuuuaaucagaaacaguaaggcuggggagacugguugagacuuauccuuacaucugggaucuaagacugaggucguguucaauuuaccagaucacucugccucggagccuccauaucuauguuggaacauucuggaauguugcuagguugggugauuccucuuuucuguaggaguuucuuccccacuuucaccuaguaccggugacuaaaugcccaugugagggcauuaaguggguaaggcacucucuggaagcuucugcuugauaagccgccugucuaauuugagaaacagcccugauggaggguagcagguggaggugccaggugcauugugucaggagggagccaugaaaacugcugaacagugcuugucuauggcuucacaaguccuucaguucuuuuuuugcuuuacuuuguuucauagauauuaaugacugugagagcaacccuuguagaaacgguggcacuugcaucgauggugucaacuccuacaagugcaucuguagugacggcugggagggggccuacugugaaaccagugagucugccacucuuuggggagcucugggauguaugggucauguuggagggaucccacuucaacgugggaaaacuuucuuuguacuggaaaucucuggaagcaagaccgcagugauuucugcacugggacaguaucacuugugucucauuugcauuuaugaguccugaugauagcuuauggggaggagcuucugcugaggaccuauagaauuagacuguguaauaaauauuccugcuugcaaggaaagucauauuucuacuuucauuuccaugggacuuccagaggcccaccccacaucuugccuaacuuguggcauucaaaguaacccaguugggagcuccuuuauuccuggaaaagccugauuguguuaaaguacuacgacuguggcuguucucagaauaggauguuggauguaagcaguaggaaaggcuuggcucucgccugucgugaaugguccuggaucucgucuucagccgauugucuccccuuugauucuagauauuaaugacugcagccagaaccccugccacaaugggggcacgugucgcgaccuggucaaugacuucuacugugacuguaaaaauggguggaaaggaaagaccugccacucacguaagugguaguuggccuuggaugcuaucucugggacccuucccucugucuucugugggagggggccacugggacucacacugaaauauuuuccuccaggugacagucagugugaugaggccacgugcaacaacgguggcaccugcuaugaugagggggaugcuuuuaagugcauguguccuggcggcugggaaggaacaaccuguaacauagguaacuuuaugccccacgugggaucugcagugggcauggccaccugggcgugucugcugguuggccccuggagcuuaugauauuucucugggccugguucuugccccuccagacuguuucuggauacucagggaggguggucgugucugcucuucuuuuauagcccgaaacaguagcugccugcccaaccccugccauaaugggggcacauguguggucaacggcgaguccuuuacgugcgucugcaaggaaggcugggaggggcccaucugugcucagagugaguguccuccccccuugaacucucccagggcugucggagcagauccugacacccuuggggacuugcaauggaaaccagaagcagagcuguuugaugucugcuuuuguaucaccugggucugcauuaaugacuugaugggauacagcccugaccugggcaugagaaagucgccaauaagauaaguggagacagauggcgucucaguucccagcucugggucugaccagcagccugucuccuuccauucucacccccaccccuauccccuaccagggccucuuccuguguacaugugucccacagcaaaugaaacuaaguguggugcgggccugguuccaauuuagcaaagguauuuugcugguguuaacuacgacuuuaucauuuggguauuaggaaaauaaguggugguuuuacuuagggcuaagaccgcuuucccuguugaaguccucacuauuaaguugucuuuucuuugcagauaccaaugacugcagcccucaucccugguaagugugacauccuuuuaagccagcacucauccacuaucgugugugugugugugugugugugugugugugugugugugagaaucacccagggauuguguuuaaaaugcaaguucugagucaggaggucugggguggggccucagacugcuuuucuaacaagcucccaggugaagcgauccugcugccccauggaccacacuuuaauuagccagguuguguccucauuuagagcagugauuuuucaaccuuggcugcacaccagaaucaccugggagcuuuuaaaaaucccgcugccugggcugcaaccaagaccugugaaauuagacuuucugggggugggacccaggcaucaguauucuuuuaaaauuccccaggcaacggccauggggugagagccacugacuguaacugguguggugacaugugagugauuggcagccagaguaauggacugggagguugguaaccaagguggucuuugcuuucuuaguuacaacagcggcaccuguguggauggagacaacugguaccggugcgaaugugccccggguuuugcugggcccgacugcagaauaaguaaggacugucuccgucugguuuucccaauggcuuuaccgcuucauuccaugccucaccccaagacuuucaucuuuaaaaacaaagccaccauucccuuuaaguagcucucauagagcaaaggaucucucuccuccagcugggauuaagauaugccaggcuggauccucccagguaccugcugguaguucccugggugguguagcccuccuuguucuuggggagagagugccagucacagaaucugaugauuaaucuacagugggguccugaagaaaguaugugcauuuccccaugacuaacaugaaauuaugggcaagcagauguuaaccacagcuacacugguauaggauaaagcuaauacaaacggaagggaggacgacuguggcuuccagaggcuugucugugcugggucugaucaggcccuggagaaaugacuaaaacaggaaaauaggggcaggcaacgcaguuuuucaagaggcuuaaagcauauuauuuugagccuuuucucuacuuuuuuacaagcccuuucucuuacagaacaaaaaaggugcuagaguaguuaugguuugauucuuguacccaaauugucugaaauuuuacuggugcuugaaauccaagucugggauuaacuagucuucagcacuagaugggggcagguuguaucuguuucauguuucuaaauaaacaguuggcaaacuguggcccaggggccguauccagcccacugucuguuuuuauaaauacaguuuucuuggcacacagccacacauucauuuauguauugucuauggcuacuuucaugauaccacaagaguuggauaguugugacagagacuauauaccccacaaagccuaagauguuuacugucugaccccuuccaggaaacuuugccaggcuugcuguaaauugcacugucaaaggaaucaaauuaaaaauugcugccucccaaaaugguucuccacuguuagaacucaggauggugguggucuuugggagccagugauuggagguuuuugcaauagaucuguuucuucuuuuggaugcugcuuaccugagugaaaauucaucaagcuuaugaugauaugcuuuucuuguauguuaugucaauaaaaacaaucucaaaacauugccacacaccaucagucccuaaacuugaacuccauuucuccuagacaucaaugaaugccagucuucaccuugugccuuuggagcgaccuguguggaugagaucaauggcuaccggugugucugcccuccagggcacaguggugccaagugccaggaagguaugugugccaggcuucagcugcccaugggucuucuggggugagcgagcuuugcagucaccauuugacuuuucacaaauaagccacugugcucagggaagggaacacacagugggacuacaagggaaagggaacgugaagagucuuccccaaaacagguagcuguuguuuuuggucagcuguugccacaaaacuguguaccaaaccaucccaaacugcuguggcuugcagcaagcauuauuuuuauugcucaugauaugcagcaugggcagagagauugcgcuguggguuggguucaguucgaccaguggcugugucuggggcauauuccuuucaucgccaguggguaggugugcaagaggcuagucaaaggcucugcucacaucacaucugccaauguuacauuggccagagcaagucuuguggccaagcgcagagccagcaaaggcaggaaguacacaugcuguuacugugggaagaaugaucuuaacauggcaaagggcacaggcauaaccauuucauaacagggaccaaagaauugaaccccgauccgguucacagaaaaauaaacugcucacccgucuccaccugucaguuucagggagaccuugcaucaccauggggagugugauaccagauggggccaaaugggaugaugacuguaauaccugccagugccugaauggacggaucgccugcucaaagguaggacaugauggcugccgcaguucaccuguguucuggaaucagggaugagcaugccugcuaagcugccagcuucuguuuuucuccaggucugguguggcccucgaccuugccugcuccacaaagggcacagcgagugccccagcgggcagagcugcauccccauccuggacgaccagugcuucguccaccccugcacuggugugggcgagugucggucuuccagucuccagccggugaagacaaagugcaccucugacuccuauuaccaggauaacugugcgaacaucacauuuaccuuuaacaaggagaugaugucaccaguauguaacaaccuuuguuuuuuuuuugaaugguggaugucugcuugcuugcuuuaaaggaggaaugccaugagcuaggaucuacuucucccuagcuuacauuccuguuuuauaauaaaguaagcuugaacuuagccagccucaaagagaacaucucagccuuuuguucuuccucucaaucuuacacguguguggguuuuuaaaaaucguuuuagggucuuacuacggagcacauuugcagugaauugaggaauuugaauauuuugaagaauguuuccgcugaauauucaaucuacaucgcuugcgagccuuccccuucagcgaacaaugaaauacauguggccauuguaaguauaagacccauucacaccucauuauucgauggcaaggcaguucgguuaaccagugucugaauggagcaaauucacugacaaaaagcuuugcagacacagauugucgaguaauuuugaagaaaggcugcuuugaguauuccucugacucucaagucugacaauuguuuuuccagucugcugaagauauacgggaugaugggaacccgaucaaggaaaucacugacaaaauaaucgaucuuguuaguaaacgugauggaaacagcucgcugauugcugccguugcagaaguaagaguucagaggcggccucugaagaacagaacagguaggugucaagugggacuaguuugugugaugauaguagaugaucucauuauacuauucaauaaagccaucaggucgagggauuaucuggcagugcccuacccucgcaggagcucccaauuuaacugagaacugagggcagccuacuuuacuaaggucacauggcccaugggaacagaggucugccucauauuuuccuucccaacacacuaugcaacguucccugcagaacagguauugugcuagauccgugacaaagcccuaggacacugcuuguccuuuguccuugaguuugaagcuguacaaagccugacuuggcauuuugguguccugggacagccuagccacugcugagcucugugaggcucgauggccccgcagggguguccaggcuucccuccugaggaucucgagcaccguuucagccaagggagagauugggcauggagccauggcacguuugagcugucugugcuaauuugaaucggauuucuaguucugaaaaccaacuccuguacugagcugccucaguagccagacuuaacaagacacugcucuccccaugcgaagucaaagagccuguaggagcugccgcuccacccagucucuccagggauaagaguaucaaggucuacaggggccugaucccagcauuugcuuaucaaguugugaagugaccauaugcaaugaugaaaagggacuugucccuguggccccccucuuagggauaaagggcaggagaaccacuguugguauucuuuuguuccugcgaugaugcuuuuuucuuucuuucuuggagaguuaauugguuuugugccugccuuacagauuuccuuguucccuugcugagcucugucuuaacuguggcuuggaucuguugcuuggugacggccuucuacuggugccugcggaagcggcggaagccgggcagccacacacacucagccucugaggacaacaccaccaacaacgugcgggagcagcugaaccagaucaaaaaccccauugagaaacauggggccaacacgguccccaucaaggauuaugagaacaagaacuccaaaaugucuaaaauaaggacacacaauucugaaguagaagaggacgacauggacaaacaccagcagaaagcccgguuugccaagcagccggcguacacgcugguagacagagaagagaagccccccaacggcacgccgacaaaacacccaaacuggacaaacaaacaggacaacagagacuuggaaagugcccagagcuuaaaccgaauggaguacaucguauagcagaccgcgggcacugccgccgcuagguagagucugagggcuuguaguucuuuaaacugucgugucauacucgagucugaggccguugcugacuuagaaucccuguguuaauuuaaguuuugacaagcuggcuuacacuggcaaugguaguuucugugguuggcugggaaaucgagugccgcaucucacagcuaugcaaaaagcuagucaacaguacccugguuguguguccccuugcagccgacacggucucggaucaggcucccaggagccugcccagcccccuggucuuugagcucccacuucugccagauguccuaauggugaugcagucuuagaucauaguuuuauuuauauuuauugacucuugaguuguuuuuguauauugguuuuaugaugacguacaaguaguucuguauuugaaagugccuuugcagcucagaaccacagcaacgaucacaaaugacuuuauuauuuauuuuuuuuaauuguauuuuuguuguugggggaggggagacuuugaugucagcaguugcugguaaaaugaagaauuuaaagaaaaaaaugucaaaaguagaacuuuguauaguuauguaaauaauucuuuuuuauuaaucacuguguauauuugauuuauuaacuuaauaaucaagagccuuaaaacaucauuccuuuuuauuuauauguauguguuuagaauugaagguuuuugauagcauuguaagcguauggcuuuauuuuuuugaacucuucucauuacuuguugccuauaagccaaaauuaagguguuugaaaauaguuuauuuuaaaacaauaggaugggcuucugugcccagaauacugauggaauuuuuuuguacgacgucagauguuuaaaacaccuucuauagcaucacuuaaaacacguuuuaaggacugacugaggcaguuugaggauuaguuuagaacagguuuuuuuguuuguuuguuuuuuguuuuucugcuuuagacuugaaaagagacaggcaggugaucugcugcagagcaguaagggaacaaguugagcuaugacuuaacauagccaaaaugugagugguugaauaugauuaaaaauaucaaauuaauugugugaacuuggaagcacaccaaucuuacuuuguaaauucugauuucuuuucaccauucguacauaauacugaaccacuuguagauuugauuuuuuuuuuuaaucuacugcauuuagggaguauucuaauaagcuaguugaauacuugaaccauaaaauguccaguaagaucacuguuuagauuugccauagaguacacugccugccuuaagugaggaaaucaaagugcuauuacgaaguucaagaucaaaaaggcuuauaaaacagaguaaucuuguugguucaccauugagaccgugaagauacuuuguauuguccuauuaguguuauaugaacauacaaaugcaucuuugauguguuguucuuggcaauaaauuuugaaaaguaauauuuauuaaauuuuuuuguaugaaaacauggaacaguguggccucuucugagcuuacguaguucuaccggcuuugccaugugcuucugccacccugcugagucuguucugguaaucgggguauaauaggcucugccugacagagggauggaggaagaacugaaaggcuuuucaaccacaaaacucaucuggaguucucaaagaccuggggcugcugugaagcuggaacugcgggagccccaucuaggggagccuugauucccuuguuauucaacagcaagugugaauacugcuugaauaaacaccacuggauuaauggcc

SEQ ID NO: 3 - RNA, 18 nt, Artificial Sequence
  Description of Artificial Sequence: Synthetic oligonucleotide
aggcagcuacuguuucgg

SEQ ID NO: 4 - RNA, 18 nt, Artificial Sequence
  Description of Artificial Sequence: Synthetic oligonucleotide
ugggcaggcagcuacugu

SEQ ID NO: 5 - RNA, 18 nt, Artificial Sequence
  Description of Artificial Sequence: Synthetic oligonucleotide
gcccccauuauggcaggg

SEQ ID NO: 6 - RNA, 18 nt, Artificial Sequence
  Description of Artificial Sequence: Synthetic oligonucleotide
caugugcccccauuaugg

SEQ ID NO: 7 - RNA, 18 nt, Artificial Sequence
  Description of Artificial Sequence: Synthetic oligonucleotide
ccacacaugugcccccau

SEQ ID NO: 8 - RNA, 18 nt, Artificial Sequence
  Description of Artificial Sequence: Synthetic oligonucleotide
guugaccacacaugugcc

SEQ ID NO: 9 - RNA, 18 nt, Artificial Sequence
  Description of Artificial Sequence: Synthetic oligonucleotide
ucgccguugaccacacau

SEQ ID NO: 10 - RNA, 18 nt, Artificial Sequence
  Description of Artificial Sequence: Synthetic oligonucleotide
aggacucgccguugacca

SEQ ID NO: 11 - RNA, 18 nt, Artificial Sequence
  Description of Artificial Sequence: Synthetic oligonucleotide
cguaaaggacucgccguu

SEQ ID NO: 12 - RNA, 18 nt, Artificial Sequence
  Description of Artificial Sequence: Synthetic oligonucleotide
acgcacguaaaggacucg

SEQ ID NO: 13 - RNA, 18 nt, Artificial Sequence
  Description of Artificial Sequence: Synthetic oligonucleotide
ugcagacgcacguaaagg

SEQ ID NO: 14 - RNA, 18 nt, Artificial Sequence
  Description of Artificial Sequence: Synthetic oligonucleotide
uuccuugcagacgcacgu

SEQ ID NO: 15 - RNA, 18 nt, Artificial Sequence
  Description of Artificial Sequence: Synthetic oligonucleotide
cagccuuccuugcagacg

SEQ ID NO: 16 - RNA, 18 nt, Artificial Sequence
  Description of Artificial Sequence: Synthetic oligonucleotide
ccucccagccuuccuugc

SEQ ID NO: 17 - RNA, 18 nt, Artificial Sequence
  Description of Artificial Sequence: Synthetic oligonucleotide
gggccccucccagccuuc

SEQ ID NO: 18 - RNA, 18 nt, Artificial Sequence
  Description of Artificial Sequence: Synthetic oligonucleotide
cagaugggccccucccag

SEQ ID NO: 19 - RNA, 18 nt, Artificial Sequence
  Description of Artificial Sequence: Synthetic oligonucleotide
gagcacagaugggccccu

SEQ ID NO: 20 - RNA, 18 nt, Artificial Sequence
  Description of Artificial Sequence: Synthetic oligonucleotide
cccugggagaguucaagg

SEQ ID NO: 21 - RNA, 18 nt, Artificial Sequence
  Description of Artificial Sequence: Synthetic oligonucleotide
gacagcccugggagaguu

SEQ ID NO: 22 - RNA, 18 nt, Artificial Sequence
  Description of Artificial Sequence: Synthetic oligonucleotide
gcuccgacagcccuggga

SEQ ID NO: 23 - RNA, 18 nt, Artificial Sequence
  Description of Artificial Sequence: Synthetic oligonucleotide
gaucugcuccgacagccc

SEQ ID NO: 24 - RNA, 18 nt, Artificial Sequence
  Description of Artificial Sequence: Synthetic oligonucleotide
gucaggaucugcuccgac

SEQ ID NO: 25 - RNA, 18 nt, Artificial Sequence
  Description of Artificial Sequence: Synthetic oligonucleotide
agggugucaggaucugcu

SEQ ID NO: 26 - RNA, 18 nt, Artificial Sequence
  Description of Artificial Sequence: Synthetic oligonucleotide
ccccaagggugucaggau

SEQ ID NO: 27 - RNA, 18 nt, Artificial Sequence
  Description of Artificial Sequence: Synthetic oligonucleotide
caaguccccaaggguguc

SEQ ID NO: 28 - RNA, 18 nt, Artificial Sequence
  Description of Artificial Sequence: Synthetic oligonucleotide
cauugcaaguccccaagg

SEQ ID NO: 29 - RNA, 18 nt, Artificial Sequence
  Description of Artificial Sequence: Synthetic oligonucleotide
guuuccauugcaaguccc

SEQ ID NO: 30 - RNA, 18 nt, Artificial Sequence
  Description of Artificial Sequence: Synthetic oligonucleotide
uucugguuuccauugcaa

SEQ ID NO: 31 - RNA, 18 nt, Artificial Sequence
  Description of Artificial Sequence: Synthetic oligonucleotide
ucugcuucugguuuccau

SEQ ID NO: 32 - RNA, 18 nt, Artificial Sequence
  Description of Artificial Sequence: Synthetic oligonucleotide
acagcucugcuucugguu

SEQ ID NO: 33 - RNA, 18 nt, Artificial Sequence
  Description of Artificial Sequence: Synthetic oligonucleotide
aucaaacagcucugcuuc

SEQ ID NO: 34 - RNA, 18 nt, Artificial Sequence
  Description of Artificial Sequence: Synthetic oligonucleotide
cagacaucaaacagcucu

SEQ ID NO: 35 - RNA, 18 nt, Artificial Sequence
  Description of Artificial Sequence: Synthetic oligonucleotide
aaaagcagacaucaaaca

SEQ ID NO: 36 - RNA, 18 nt, Artificial Sequence
  Description of Artificial Sequence: Synthetic oligonucleotide
gauacaaaagcagacauc

SEQ ID NO: 37 - RNA, 18 nt, Artificial Sequence
  Description of Artificial Sequence: Synthetic oligonucleotide
caggugauacaaaagcag

SEQ ID NO: 38 - RNA, 18 nt, Artificial Sequence
  Description of Artificial Sequence: Synthetic oligonucleotide
agacccaggugauacaaa

SEQ ID NO: 39 - RNA, 18 nt, Artificial Sequence
  Description of Artificial Sequence: Synthetic oligonucleotide
aaugcagacccaggugau

SEQ ID NO: 40 - RNA, 18 nt, Artificial Sequence
  Description of Artificial Sequence: Synthetic oligonucleotide
ucauuaaugcagacccag

SEQ ID NO: 41 - RNA, 18 nt, Artificial Sequence
  Description of Artificial Sequence: Synthetic oligonucleotide
ucaagucauuaaugcaga

SEQ ID NO: 42 - RNA, 18 nt, Artificial Sequence
  Description of Artificial Sequence: Synthetic oligonucleotide
ucccaucaagucauuaau

SEQ ID NO: 43 - RNA, 18 nt, Artificial Sequence
  Description of Artificial Sequence: Synthetic oligonucleotide
cuguaucccaucaaguca

SEQ ID NO: 44 - RNA, 18 nt, Artificial Sequence
  Description of Artificial Sequence: Synthetic oligonucleotide
cagggcuguaucccauca

SEQ ID NO: 45 - RNA, 18 nt, Artificial Sequence
  Description of Artificial Sequence: Synthetic oligonucleotide
caggucagggcuguaucc

SEQ ID NO: 46 - RNA, 18 nt, Artificial Sequence
  Description of Artificial Sequence: Synthetic oligonucleotide
augcccaggucagggcug

SEQ ID NO: 47 - RNA, 18 nt, Artificial Sequence
  Description of Artificial Sequence: Synthetic oligonucleotide
uucucaugcccaggucag

SEQ ID NO: 48 - RNA, 18 nt, Artificial Sequence
  Description of Artificial Sequence: Synthetic oligonucleotide
cgacuuucucaugcccag

SEQ ID NO: 49 - RNA, 18 nt, Artificial Sequence
  Description of Artificial Sequence: Synthetic oligonucleotide
auuggcgacuuucucaug

SEQ ID NO: 50 - RNA, 18 nt, Artificial Sequence
  Description of Artificial Sequence: Synthetic oligonucleotide
aucuuauuggcgacuuuc

SEQ ID NO: 51 - RNA, 18 nt, Artificial Sequence
  Description of Artificial Sequence: Synthetic oligonucleotide
cacuuaucuuauuggcga

SEQ ID NO: 52 - RNA, 18 nt, Artificial Sequence
  Description of Artificial Sequence: Synthetic oligonucleotide
gucuccacuuaucuuauu

SEQ ID NO: 53 - RNA, 18 nt, Artificial Sequence
  Description of Artificial Sequence: Synthetic oligonucleotide
caucugucuccacuuauc

SEQ ID NO: 54 - RNA, 18 nt, Artificial Sequence
  Description of Artificial Sequence: Synthetic oligonucleotide
gacgccaucugucuccac

SEQ ID NO: 55 - RNA, 18 nt, Artificial Sequence
  Description of Artificial Sequence: Synthetic oligonucleotide
acugagacgccaucuguc

SEQ ID NO: 56 - RNA, 18 nt, Artificial Sequence
  Description of Artificial Sequence: Synthetic oligonucleotide
ugggaacugagacgccau

SEQ ID NO: 57 - RNA, 18 nt, Artificial Sequence
  Description of Artificial Sequence: Synthetic oligonucleotide
agagcugggaacugagac

SEQ ID NO: 58 - RNA, 18 nt, Artificial Sequence
  Description of Artificial Sequence: Synthetic oligonucleotide
gacccagagcugggaacu

SEQ ID NO: 59 - RNA, 18 nt, Artificial Sequence
  Description of Artificial Sequence: Synthetic oligonucleotide
ggucagacccagagcugg

SEQ ID NO: 60 - RNA, 18 nt, Artificial Sequence
  Description of Artificial Sequence: Synthetic oligonucleotide
cugcuggucagacccaga

SEQ ID NO: 61 - RNA, 18 nt, Artificial Sequence
  Description of Artificial Sequence: Synthetic oligonucleotide
acaggcugcuggucagac

SEQ ID NO: 62 - RNA, 18 nt, Artificial Sequence
  Description of Artificial Sequence: Synthetic oligonucleotide
aggagacaggcugcuggu

SEQ ID NO: 63 - RNA, 18 nt, Artificial Sequence
  Description of Artificial Sequence: Synthetic oligonucleotide
auggaaggagacaggcug

SEQ ID NO: 64 - RNA, 18 nt, Artificial Sequence
  Description of Artificial Sequence: Synthetic oligonucleotide
ugagaauggaaggagaca

SEQ ID NO: 65 - RNA, 18 nt, Artificial Sequence
  Description of Artificial Sequence: Synthetic oligonucleotide
gggugagaauggaaggag

SEQ ID NO: 66 - RNA, 18 nt, Artificial Sequence
  Description of Artificial Sequence: Synthetic oligonucleotide
ucagacccagagcuggga

SEQ ID NO: 67 - RNA, 18 nt, Artificial Sequence
  Description of Artificial Sequence: Synthetic oligonucleotide
gcuggucagacccagagc

SEQ ID NO: 68 - RNA, 18 nt, Artificial Sequence
  Description of Artificial Sequence: Synthetic oligonucleotide
aggcugcuggucagaccc

SEQ ID NO: 69 - RNA, 18 nt, Artificial Sequence
  Description of Artificial Sequence: Synthetic oligonucleotide
gagacaggcugcugguca

SEQ ID NO: 70 - RNA, 18 nt, Artificial Sequence
  Description of Artificial Sequence: Synthetic oligonucleotide
ggaaggagacaggcugcu

SEQ ID NO: 71 - RNA, 18 nt, Artificial Sequence
  Description of Artificial Sequence: Synthetic oligonucleotide
agaauggaaggagacagg

SEQ ID NO: 72 - RNA, 18 nt, Artificial Sequence
  Description of Artificial Sequence: Synthetic oligonucleotide
gggugagaauggaaggag

SEQ ID NO: 73 - RNA, 18 nt, Artificial Sequence
  Description of Artificial Sequence: Synthetic oligonucleotide
gaagaggcccugguaggg

SEQ ID NO: 74 - RNA, 18 nt, Artificial Sequence
  Description of Artificial Sequence: Synthetic oligonucleotide
caggaagaggcccuggua

SEQ ID NO: 75 - RNA, 18 nt, Artificial Sequence
  Description of Artificial Sequence: Synthetic oligonucleotide
guacacaggaagaggccc

SEQ ID NO: 76 - RNA, 18 nt, Artificial Sequence
  Description of Artificial Sequence: Synthetic oligonucleotide
cacauguacacaggaaga

SEQ ID NO: 77 - RNA, 18 nt, Artificial Sequence
  Description of Artificial Sequence: Synthetic oligonucleotide
ugggacacauguacacag

SEQ ID NO: 78 - RNA, 18 nt, Artificial Sequence
  Description of Artificial Sequence: Synthetic oligonucleotide
ugcugugggacacaugua

SEQ ID NO: 79 - RNA, 18 nt, Artificial Sequence
  Description of Artificial Sequence: Synthetic oligonucleotide
ucauuugcugugggacac

SEQ ID NO: 80 - RNA, 18 nt, Artificial Sequence
  Description of Artificial Sequence: Synthetic oligonucleotide
uaguuucauuugcugugg

SEQ ID NO: 81 - RNA, 18 nt, Artificial Sequence
  Description of Artificial Sequence: Synthetic oligonucleotide
acacuuaguuucauuugc

SEQ ID NO: 82 - RNA, 18 nt, Artificial Sequence
  Description of Artificial Sequence: Synthetic oligonucleotide
gcaccacacuuaguuuca

SEQ ID NO: 83 - RNA, 18 nt, Artificial Sequence
  Description of Artificial Sequence: Synthetic oligonucleotide
ggcccgcaccacacuuag

SEQ ID NO: 84 - RNA, 18 nt, Artificial Sequence
  Description of Artificial Sequence: Synthetic oligonucleotide
aaccaggcccgcaccaca

SEQ ID NO: 85 - RNA, 18 nt, Artificial Sequence
  Description of Artificial Sequence: Synthetic oligonucleotide
auuggaaccaggcccgca

SEQ ID NO: 86 - RNA, 18 nt, Artificial Sequence
  Description of Artificial Sequence: Synthetic oligonucleotide
gcuaaauuggaaccaggc

SEQ ID NO: 87 - RNA, 18 nt, Artificial Sequence
  Description of Artificial Sequence: Synthetic oligonucleotide
ccuuugcuaaauuggaac

SEQ ID NO: 88 - RNA, 18 nt, Artificial Sequence
  Description of Artificial Sequence: Synthetic oligonucleotide
aaauaccuuugcuaaauu

SEQ ID NO: 89 - RNA, 18 nt, Artificial Sequence
  Description of Artificial Sequence: Synthetic oligonucleotide
cagcaaaauaccuuugcu

SEQ ID NO: 90 - RNA, 18 nt, Artificial Sequence
  Description of Artificial Sequence: Synthetic oligonucleotide
aacaccagcaaaauaccu

SEQ ID NO: 91 - RNA, 18 nt, Artificial Sequence
  Description of Artificial Sequence: Synthetic oligonucleotide
uaguuaacaccagcaaaa

SEQ ID NO: 92 - RNA, 18 nt, Artificial Sequence
  Description of Artificial Sequence: Synthetic oligonucleotide
agucguaguuaacaccag

SEQ ID NO: 93 - RNA, 18 nt, Artificial Sequence
  Description of Artificial Sequence: Synthetic oligonucleotide
gauaaagucguaguuaac

SEQ ID NO: 94 - RNA, 18 nt, Artificial Sequence
  Description of Artificial Sequence: Synthetic oligonucleotide
caaaugauaaagucguag

SEQ ID NO: 95 - RNA, 18 nt, Artificial Sequence
  Description of Artificial Sequence: Synthetic oligonucleotide
auacccaaaugauaaagu

SEQ ID NO: 96 - RNA, 18 nt, Artificial Sequence
  Description of Artificial Sequence: Synthetic oligonucleotide
uccuaauacccaaaugau

SEQ ID NO: 97 - RNA, 18 nt, Artificial Sequence
  Description of Artificial Sequence: Synthetic oligonucleotide
uauuuuccuaauacccaa

SEQ ID NO: 98 - RNA, 18 nt, Artificial Sequence
  Description of Artificial Sequence: Synthetic oligonucleotide
ccacuuauuuuccuaaua

SEQ ID NO: 99 - RNA, 18 nt, Artificial Sequence
  Description of Artificial Sequence: Synthetic oligonucleotide
aaccaccacuuauuuucc

SEQ ID NO: 100 - RNA, 18 nt, Artificial Sequence
  Description of Artificial Sequence: Synthetic oligonucleotide
aguaaaaccaccacuuau

SEQ ID NO: 101 - RNA, 18 nt, Artificial Sequence
  Description of Artificial Sequence: Synthetic oligonucleotide
cccuaaguaaaaccacca

SEQ ID NO: 102 - RNA, 18 nt, Artificial Sequence
  Description of Artificial Sequence: Synthetic oligonucleotide
cuuagcccuaaguaaaac

SEQ ID NO: 103 - RNA, 18 nt, Artificial Sequence
  Description of Artificial Sequence: Synthetic oligonucleotide
gcggucuuagcccuaagu

SEQ ID NO: 104 - RNA, 18 nt, Artificial Sequence
  Description of Artificial Sequence: Synthetic oligonucleotide
ggaaagcggucuuagccc

SEQ ID NO: 105 - RNA, 18 nt, Artificial Sequence
  Description of Artificial Sequence: Synthetic oligonucleotide
aacagggaaagcggucuu

SEQ ID NO: 106 - RNA, 18 nt, Artificial Sequence
  Description of Artificial Sequence: Synthetic oligonucleotide
acuucaacagggaaagcg

SEQ ID NO: 107 - RNA, 18 nt, Artificial Sequence
  Description of Artificial Sequence: Synthetic oligonucleotide
ugaggacuucaacaggga

SEQ ID NO: 108 - RNA, 18 nt, Artificial Sequence
  Description of Artificial Sequence: Synthetic oligonucleotide
aauagugaggacuucaac

SEQ ID NO: 109 - RNA, 18 nt, Artificial Sequence
  Description of Artificial Sequence: Synthetic oligonucleotide
aacuuaauagugaggacu

SEQ ID NO: 110 - RNA, 18 nt, Artificial Sequence
  Description of Artificial Sequence: Synthetic oligonucleotide
gggcugcagucauuggua

SEQ ID NO: 111 - RNA, 18 nt, Artificial Sequence
  Description of Artificial Sequence: Synthetic oligonucleotide
gaugagggcugcagucau

SEQ ID NO: 112 - RNA, 18 nt, Artificial Sequence
  Description of Artificial Sequence: Synthetic oligonucleotide
cucacaauaaucgauguc

SEQ ID NO: 113 - RNA, 18 nt, Artificial Sequence
  Description of Artificial Sequence: Synthetic oligonucleotide
uuaggcucacaauaaucg

SEQ ID NO: 114 - RNA, 18 nt, Artificial Sequence
  Description of Artificial Sequence: Synthetic oligonucleotide
agggauuaggcucacaau

SEQ ID NO: 115 - RNA, 18 nt, Artificial Sequence
  Description of Artificial Sequence: Synthetic oligonucleotide
cuggcagggauuaggcuc

SEQ ID NO: 116 - RNA, 18 nt, Artificial Sequence
  Description of Artificial Sequence: Synthetic oligonucleotide
ccguucuggcagggauua

SEQ ID NO: 117 - RNA, 18 nt, Artificial Sequence
  Description of Artificial Sequence: Synthetic oligonucleotide
gggcaccguucuggcagg

SEQ ID NO: 118 - RNA, 18 nt, Artificial Sequence
  Description of Artificial Sequence: Synthetic oligonucleotide
gcacugggcaccguucug

SEQ ID NO: 119 - RNA, 18 nt, Artificial Sequence
  Description of Artificial Sequence: Synthetic oligonucleotide
uuguagcacugggcaccg

SEQ ID NO: 120 - RNA, 18 nt, Artificial Sequence
  Description of Artificial Sequence: Synthetic oligonucleotide
cacgguuguagcacuggg

SEQ ID NO: 121 - RNA, 18 nt, Artificial Sequence
  Description of Artificial Sequence: Synthetic oligonucleotide
acuggcacgguuguagca

SEQ ID NO: 122 - RNA, 18 nt, Artificial Sequence
  Description of Artificial Sequence: Synthetic oligonucleotide
uagucacuggcacgguug

SEQ ID NO: 123 - RNA, 18 nt, Artificial Sequence
  Description of Artificial Sequence: Synthetic oligonucleotide
agaaauagucacuggcac

SEQ ID NO: 124 - RNA, 18 nt, Artificial Sequence
  Description of Artificial Sequence: Synthetic oligonucleotide
cuugcagaaauagucacu

SEQ ID NO: 125 - RNA, 18 nt, Artificial Sequence
  Description of Artificial Sequence: Synthetic oligonucleotide
gggcacuugcagaaauag

SEQ ID NO: 126 - RNA, 18 nt, Artificial Sequence
  Description of Artificial Sequence: Synthetic oligonucleotide
gcccucauaguccucggg

SEQ ID NO: 127 - RNA, 18 nt, Artificial Sequence
  Description of Artificial Sequence: Synthetic oligonucleotide
ugcccucauaguccucgg

SEQ ID NO: 128 - RNA, 18 nt, Artificial Sequence
  Description of Artificial Sequence: Synthetic oligonucleotide
guucuugcccucauaguc

SEQ ID NO: 129 - RNA, 18 nt, Artificial Sequence
  Description of Artificial Sequence: Synthetic oligonucleotide
gagcaguucuugcccuca

SEQ ID NO: 130 - RNA, 18 nt, Artificial Sequence
  Description of Artificial Sequence: Synthetic oligonucleotide
ggugugagcaguucuugc

SEQ ID NO: 131 - RNA, 18 nt, Artificial Sequence
  Description of Artificial Sequence: Synthetic oligonucleotide
uuucaggugugagcaguu

SEQ ID NO: 132 - RNA, 18 nt, Artificial Sequence
  Description of Artificial Sequence: Synthetic oligonucleotide
uggucuuucaggugugag

SEQ ID NO: 133 - RNA, 18 nt, Artificial Sequence
  Description of Artificial Sequence: Synthetic oligonucleotide
ggcaguggucuuucaggu

SEQ ID NO: 134 - RNA, 18 nt, Artificial Sequence
  Description of Artificial Sequence: Synthetic oligonucleotide
cgugcggcaguggucuuu

SEQ ID NO: 135 - RNA, 18 nt, Artificial Sequence
  Description of Artificial Sequence: Synthetic oligonucleotide
aggucccgggagaaggga

SEQ ID NO: 136 - RNA, 18 nt, Artificial Sequence
  Description of Artificial Sequence: Synthetic oligonucleotide
cagccaggucccgggaga

SEQ ID NO: 137 - RNA, 18 nt, Artificial Sequence
  Description of Artificial Sequence: Synthetic oligonucleotide
ggagacagccaggucccg

SEQ ID NO: 138 - RNA, 18 nt, Artificial Sequence
  Description of Artificial Sequence: Synthetic oligonucleotide
agucuggagacagccagg

SEQ ID NO: 139 - RNA, 18 nt, Artificial Sequence
  Description of Artificial Sequence: Synthetic oligonucleotide
gagcaagucuggagacag

SEQ ID NO: 140 - RNA, 18 nt, Artificial Sequence
  Description of Artificial Sequence: Synthetic oligonucleotide
aaaaggagcaagucugga

SEQ ID NO: 141 - RNA, 18 nt, Artificial Sequence
  Description of Artificial Sequence: Synthetic oligonucleotide
gggacaaaaggagcaagu

SEQ ID NO: 142 - RNA, 18 nt, Artificial Sequence
  Description of Artificial Sequence: Synthetic oligonucleotide
gggcagugguaguaagug

SEQ ID NO: 143 - RNA, 18 nt, Artificial Sequence
  Description of Artificial Sequence: Synthetic oligonucleotide
ucucaaguguaacaaggg

SEQ ID NO: 144 - RNA, 18 nt, Artificial Sequence
  Description of Artificial Sequence: Synthetic oligonucleotide
uuacuucucaaguguaac

SEQ ID NO: 145 - RNA, 18 nt, Artificial Sequence
  Description of Artificial Sequence: Synthetic oligonucleotide
auacauuacuucucaagu

SEQ ID NO: 146 - RNA, 18 nt, Artificial Sequence
  Description of Artificial Sequence: Synthetic oligonucleotide
caccaauacauuacuucu

SEQ ID NO: 147 - RNA, 18 nt, Artificial Sequence
  Description of Artificial Sequence: Synthetic oligonucleotide
cuccucaccaauacauua

SEQ ID NO: 148 - RNA, 18 nt, Artificial Sequence
  Description of Artificial Sequence: Synthetic oligonucleotide
agguccuccucaccaaua

SEQ ID NO: 149 - RNA, 18 nt, Artificial Sequence
  Description of Artificial Sequence: Synthetic oligonucleotide
uauagagguccuccucac

SEQ ID NO: 150 - RNA, 18 nt, Artificial Sequence
  Description of Artificial Sequence: Synthetic oligonucleotide
uucacuauagagguccuc

SEQ ID NO: 151 - RNA, 18 nt, Artificial Sequence
  Description of Artificial Sequence: Synthetic oligonucleotide
aucauuucacuauagagg

SEQ ID NO: 152 - RNA, 18 nt, Artificial Sequence
  Description of Artificial Sequence: Synthetic oligonucleotide
gcaggaucauuucacuau

SEQ ID NO: 153 - RNA, 18 nt, Artificial Sequence
  Description of Artificial Sequence: Synthetic oligonucleotide
cacaggcaggaucauuuc

SEQ ID NO: 154 - RNA, 18 nt, Artificial Sequence
  Description of Artificial Sequence: Synthetic oligonucleotide
cgcuacacaggcaggauc

SEQ ID NO: 155 - RNA, 18 nt, Artificial Sequence
  Description of Artificial Sequence: Synthetic oligonucleotide
cggcccgcuacacaggca

SEQ ID NO: 156 - RNA, 18 nt, Artificial Sequence
  Description of Artificial Sequence: Synthetic oligonucleotide
uguugcggcccgcuacac

SEQ ID NO: 157 - RNA, 18 nt, Artificial Sequence
  Description of Artificial Sequence: Synthetic oligonucleotide
ccacguguugcggcccgc

SEQ ID NO: 158 - RNA, 18 nt, Artificial Sequence
  Description of Artificial Sequence: Synthetic oligonucleotide
uguuuccacguguugcgg

SEQ ID NO: 159 - RNA, 18 nt, Artificial Sequence
  Description of Artificial Sequence: Synthetic oligonucleotide
uagauuguuuccacgugu

SEQ ID NO: 160 - RNA, 18 nt, Artificial Sequence
  Description of Artificial Sequence: Synthetic oligonucleotide
cggaauagauuguuucca

SEQ ID NO: 161 - RNA, 18 nt, Artificial Sequence
  Description of Artificial Sequence: Synthetic oligonucleotide
caggccggaauagauugu

SEQ ID NO: 162 - RNA, 18 nt, Artificial Sequence
  Description of Artificial Sequence: Synthetic oligonucleotide
acuggcaggccggaauag

SEQ ID NO: 163 - RNA, 18 nt, Artificial Sequence
  Description of Artificial Sequence: Synthetic oligonucleotide
cucccacuggcaggccgg

SEQ ID NO: 164 - RNA, 18 nt, Artificial Sequence
  Description of Artificial Sequence: Synthetic oligonucleotide
cggcucucccacuggcag

SEQ ID NO: 165 - RNA, 18 nt, Artificial Sequence
  Description of Artificial Sequence: Synthetic oligonucleotide
agacacggcucucccacu

SEQ ID NO: 166 - RNA, 18 nt, Artificial Sequence
  Description of Artificial Sequence: Synthetic oligonucleotide
cuuguagacacggcucuc

SEQ ID NO: 167 - RNA, 18 nt, Artificial Sequence
  Description of Artificial Sequence: Synthetic oligonucleotide
ggcuacuuguagacacgg

SEQ ID NO: 168 - RNA, 18 nt, Artificial Sequence
  Description of Artificial Sequence: Synthetic oligonucleotide
cccugggcuacuuguaga

SEQ ID NO: 169 - RNA, 18 nt, Artificial Sequence
  Description of Artificial Sequence: Synthetic oligonucleotide
cucuccccugggcuacuu

SEQ ID NO: 170 - RNA, 18 nt, Artificial Sequence
  Description of Artificial Sequence: Synthetic oligonucleotide
acauucucuccccugggc

SEQ ID NO: 171 - RNA, 18 nt, Artificial Sequence
  Description of Artificial Sequence: Synthetic oligonucleotide
auuucacauucucucccc

SEQ ID NO: 172 - RNA, 18 nt, Artificial Sequence
  Description of Artificial Sequence: Synthetic oligonucleotide
aauggauuucacauucuc

SEQ ID NO: 173 - RNA, 18 nt, Artificial Sequence
  Description of Artificial Sequence: Synthetic oligonucleotide
ugcuaaauggauuucaca

SEQ ID NO: 174 - RNA, 18 nt, Artificial Sequence
  Description of Artificial Sequence: Synthetic oligonucleotide
aggaaugcuaaauggauu

SEQ ID NO: 175 - RNA, 18 nt, Artificial Sequence
  Description of Artificial Sequence: Synthetic oligonucleotide
agaacaggaaugcuaaau

SEQ ID NO: 176 - RNA, 18 nt, Artificial Sequence
  Description of Artificial Sequence: Synthetic oligonucleotide
accccagaacaggaaugc

SEQ ID NO: 177 - RNA, 18 nt, Artificial Sequence
  Description of Artificial Sequence: Synthetic oligonucleotide
agcccaccccagaacagg

SEQ ID NO: 178 - RNA, 18 nt, Artificial Sequence
  Description of Artificial Sequence: Synthetic oligonucleotide
acaucagcccaccccaga

SEQ ID NO: 179 - RNA, 18 nt, Artificial Sequence
  Description of Artificial Sequence: Synthetic oligonucleotide
guugcacaucagcccacc

SEQ ID NO: 180 - RNA, 18 nt, Artificial Sequence
  Description of Artificial Sequence: Synthetic oligonucleotide
ucagcguugcacaucagc

SEQ ID NO: 181 - RNA, 18 nt, Artificial Sequence
  Description of Artificial Sequence: Synthetic oligonucleotide
uugccucagcguugcaca

SEQ ID NO: 182 - RNA, 18 nt, Artificial Sequence
  Description of Artificial Sequence: Synthetic oligonucleotide
ggcauuugccucagcguu

SEQ ID NO: 183 - RNA, 18 nt, Artificial Sequence
  Description of Artificial Sequence: Synthetic oligonucleotide
ucucaggcauuugccuca

SEQ ID NO: 184 - RNA, 18 nt, Artificial Sequence
  Description of Artificial Sequence: Synthetic oligonucleotide
guuguucucaggcauuug

SEQ ID NO: 185 - RNA, 18 nt, Artificial Sequence
  Description of Artificial Sequence: Synthetic oligonucleotide
acaguguuguucucaggc

SEQ ID NO: 186 - RNA, 18 nt, Artificial Sequence
  Description of Artificial Sequence: Synthetic oligonucleotide
uguugacaguguuguucu

SEQ ID NO: 187 - RNA, 18 nt, Artificial Sequence
  Description of Artificial Sequence: Synthetic oligonucleotide
aguucuguugacaguguu

SEQ ID NO: 188 - RNA, 18 nt, Artificial Sequence
  Description of Artificial Sequence: Synthetic oligonucleotide
caggaaguucuguugaca

SEQ ID NO: 189 - RNA, 18 nt, Artificial Sequence
  Description of Artificial Sequence: Synthetic oligonucleotide
cguugcaggaaguucugu

SEQ ID NO: 190 - RNA, 18 nt, Artificial Sequence
  Description of Artificial Sequence: Synthetic oligonucleotide
ucugccguugcaggaagu

SEQ ID NO: 191 - RNA, 18 nt, Artificial Sequence
  Description of Artificial Sequence: Synthetic oligonucleotide
cucugucugccguugcag

SEQ ID NO: 192 - RNA, 18 nt, Artificial Sequence
  Description of Artificial Sequence: Synthetic oligonucleotide
ucccccucugucugccgu

SEQ ID NO: 193 - RNA, 18 nt, Artificial Sequence
  Description of Artificial Sequence: Synthetic oligonucleotide
gaacaucccccucugucu

SEQ ID NO: 194 - RNA, 18 nt, Artificial Sequence
  Description of Artificial Sequence: Synthetic oligonucleotide
auacagaacaucccccuc

SEQ ID NO: 195 - RNA, 18 nt, Artificial Sequence
  Description of Artificial Sequence: Synthetic oligonucleotide
ugcagauacagaacaucc

SEQ ID NO: 196 - RNA, 18 nt, Artificial Sequence
  Description of Artificial Sequence: Synthetic oligonucleotide
gaccgugcagauacagaa

SEQ ID NO: 197 - RNA, 18 nt, Artificial Sequence
  Description of Artificial Sequence: Synthetic oligonucleotide
uaccugaccgugcagaua

SEQ ID NO: 198 - RNA, 18 nt, Artificial Sequence
  Description of Artificial Sequence: Synthetic oligonucleotide
ucccauaccugaccgugc

SEQ ID NO: 199 - RNA, 18 nt, Artificial Sequence
  Description of Artificial Sequence: Synthetic oligonucleotide
gggcucccauaccugacc

SEQ ID NO: 200 - RNA, 18 nt, Artificial Sequence
  Description of Artificial Sequence: Synthetic oligonucleotide
caguccacauggccuggg

SEQ ID NO: 201 - RNA, 18 nt, Artificial Sequence
  Description of Artificial Sequence: Synthetic oligonucleotide
agucacaguccacauggc

SEQ ID NO: 202 - RNA, 18 nt, Artificial Sequence
  Description of Artificial Sequence: Synthetic oligonucleotide
acacuagucacaguccac

SEQ ID NO: 203 - RNA, 18 nt, Artificial Sequence
  Description of Artificial Sequence: Synthetic oligonucleotide
uaguuacacuagucacag

SEQ ID NO: 204 - RNA, 18 nt, Artificial Sequence
  Description of Artificial Sequence: Synthetic oligonucleotide
guuucuaguuacacuagu

SEQ ID NO: 205 - RNA, 18 nt, Artificial Sequence
  Description of Artificial Sequence: Synthetic oligonucleotide
aaucaguuucuaguuaca

SEQ ID NO: 206 - RNA, 18 nt, Artificial Sequence
  Description of Artificial Sequence: Synthetic oligonucleotide
aauaaaaucaguuucuag

SEQ ID NO: 207 - RNA, 18 nt, Artificial Sequence
  Description of Artificial Sequence: Synthetic oligonucleotide
aaugaaauaaaaucaguu

SEQ ID NO: 208 - RNA, 18 nt, Artificial Sequence
  Description of Artificial Sequence: Synthetic oligonucleotide
acuaaaaugaaauaaaau

SEQ ID NO: 209 - RNA, 18 nt, Artificial Sequence
  Description of Artificial Sequence: Synthetic oligonucleotide
aaugaacuaaaaugaaau

SEQ ID NO: 210 - RNA, 18 nt, Artificial Sequence
  Description of Artificial Sequence: Synthetic oligonucleotide
auuuaaaugaacuaaaau

SEQ ID NO: 211 - RNA, 18 nt, Artificial Sequence
  Description of Artificial Sequence: Synthetic oligonucleotide
uuuacauuuaaaugaacu

SEQ ID NO: 212 - RNA, 18 nt, Artificial Sequence
  Description of Artificial Sequence: Synthetic oligonucleotide
ggcuauuuacauuuaaau

SEQ ID NO: 213 - RNA, 18 nt, Artificial Sequence
  Description of Artificial Sequence: Synthetic oligonucleotide
cauguggcuauuuacauu

SEQ ID NO: 214 - RNA, 18 nt, Artificial Sequence
  Description of Artificial Sequence: Synthetic oligonucleotide
ggccacauguggcuauuu

SEQ ID NO: 215 - RNA, 18 nt, Artificial Sequence
  Description of Artificial Sequence: Synthetic oligonucleotide
ccaccggccacauguggc

SEQ ID NO: 216 - RNA, 18 nt, Artificial Sequence
  Description of Artificial Sequence: Synthetic oligonucleotide
augaaauaaaaucaguuu

SEQ ID NO: 217 - RNA, 18 nt, Artificial Sequence
  Description of Artificial Sequence: Synthetic oligonucleotide
cuaaaaugaaauaaaauc

SEQ ID NO: 218 - RNA, 18 nt, Artificial Sequence
  Description of Artificial Sequence: Synthetic oligonucleotide
augaacuaaaaugaaaua

SEQ ID NO: 219 - RNA, 18 nt, Artificial Sequence
  Description of Artificial Sequence: Synthetic oligonucleotide
uuuaaaugaacuaaaaug

SEQ ID NO: 220 - RNA, 18 nt, Artificial Sequence
  Description of Artificial Sequence: Synthetic oligonucleotide
uuacauuuaaaugaacua

SEQ ID NO: 221 - RNA, 18 nt, Artificial Sequence
  Description of Artificial Sequence: Synthetic oligonucleotide
gcuauuuacauuuaaaug

SEQ ID NO: 222 - RNA, 18 nt, Artificial Sequence
  Description of Artificial Sequence: Synthetic oligonucleotide
auguggcuauuuacauuu

SEQ ID NO: 223 - RNA, 18 nt, Artificial Sequence
  Description of Artificial Sequence: Synthetic oligonucleotide
gccacauguggcuauuua

SEQ ID NO: 224 - RNA, 18 nt, Artificial Sequence
  Description of Artificial Sequence: Synthetic oligonucleotide
caccggccacauguggcu

SEQ ID NO: 225 - RNA, 18 nt, Artificial Sequence
  Description of Artificial Sequence: Synthetic oligonucleotide
gcagccaccggccacaug

SEQ ID NO: 226 - RNA, 18 nt, Artificial Sequence
  Description of Artificial Sequence: Synthetic oligonucleotide
auacagcagccaccggcc

SEQ ID NO: 227 - RNA, 18 nt, Artificial Sequence
  Description of Artificial Sequence: Synthetic oligonucleotide
gccuaauacagcagccac

SEQ ID NO: 228 - RNA, 18 nt, Artificial Sequence
  Description of Artificial Sequence: Synthetic oligonucleotide
gugcugccuaauacagca

SEQ ID NO: 229 - RNA, 18 nt, Artificial Sequence
  Description of Artificial Sequence: Synthetic oligonucleotide
auguugugcugccuaaua

SEQ ID NO: 230 - RNA, 18 nt, Artificial Sequence
  Description of Artificial Sequence: Synthetic oligonucleotide
uuuaaauguugugcugcc

SEQ ID NO: 231 - RNA, 18 nt, Artificial Sequence
  Description of Artificial Sequence: Synthetic oligonucleotide
gaagcuuuaaauguugug

SEQ ID NO: 232 - RNA, 18 nt, Artificial Sequence
  Description of Artificial Sequence: Synthetic oligonucleotide
uuauagaagcuuuaaaug

SEQ ID NO: 233 - RNA, 18 nt, Artificial Sequence
  Description of Artificial Sequence: Synthetic oligonucleotide
caaucuuauagaagcuuu

SEQ ID NO: 234 - RNA, 18 nt, Artificial Sequence
  Description of Artificial Sequence: Synthetic oligonucleotide
aaggacaaucuuauagaa

SEQ ID NO: 235 - RNA, 18 nt, Artificial Sequence
  Description of Artificial Sequence: Synthetic oligonucleotide
ggcucaaggacaaucuua

SEQ ID NO: 236 - RNA, 18 nt, Artificial Sequence
  Description of Artificial Sequence: Synthetic oligonucleotide
agcaaggcucaaggacaa

SEQ ID NO: 237 - RNA, 18 nt, Artificial Sequence
  Description of Artificial Sequence: Synthetic oligonucleotide
ucuuaagcaaggcucaag

SEQ ID NO: 238 - RNA, 18 nt, Artificial Sequence
  Description of Artificial Sequence: Synthetic oligonucleotide
uuugaucuuaagcaaggc

SEQ ID NO: 239 - RNA, 18 nt, Artificial Sequence
  Description of Artificial Sequence: Synthetic oligonucleotide
uccuuuuugaucuuaagc

SEQ ID NO: 240 - RNA, 18 nt, Artificial Sequence
  Description of Artificial Sequence: Synthetic oligonucleotide
uuacuuccuuuuugaucu

SEQ ID NO: 241 - RNA, 18 nt, Artificial Sequence
  Description of Artificial Sequence: Synthetic oligonucleotide
uuuauuuacuuccuuuuu

SEQ ID NO: 242 - RNA, 18 nt, Artificial Sequence
  Description of Artificial Sequence: Synthetic oligonucleotide
ccugcuuuauuuacuucc

SEQ ID NO: 243 - RNA, 18 nt, Artificial Sequence
  Description of Artificial Sequence: Synthetic oligonucleotide
aaggaccugcuuuauuua

SEQ ID NO: 244 - RNA, 18 nt, Artificial Sequence
  Description of Artificial Sequence: Synthetic oligonucleotide
ggcaaaaggaccugcuuu

SEQ ID NO: 245 - RNA, 18 nt, Artificial Sequence
  Description of Artificial Sequence: Synthetic oligonucleotide
gcuaaggcaaaaggaccu

SEQ ID NO: 246 - RNA, 18 nt, Artificial Sequence
  Description of Artificial Sequence: Synthetic oligonucleotide
cacuugcuaaggcaaaag

SEQ ID NO: 247 - RNA, 18 nt, Artificial Sequence
  Description of Artificial Sequence: Synthetic oligonucleotide
guaaacacuugcuaaggc

SEQ ID NO: 248 - RNA, 18 nt, Artificial Sequence
  Description of Artificial Sequence: Synthetic oligonucleotide
auuugguaaacacuugcu

SEQ ID NO: 249 - RNA, 18 nt, Artificial Sequence
  Description of Artificial Sequence: Synthetic oligonucleotide
acccaauuugguaaacac

SEQ ID NO: 250 - RNA, 18 nt, Artificial Sequence
  Description of Artificial Sequence: Synthetic oligonucleotide
caucuacccaauuuggua

SEQ ID NO: 251 - RNA, 18 nt, Artificial Sequence
  Description of Artificial Sequence: Synthetic oligonucleotide
uuugacaucuacccaauu

SEQ ID NO: 252 - RNA, 18 nt, Artificial Sequence
  Description of Artificial Sequence: Synthetic oligonucleotide
cuaccuuugacaucuacc

SEQ ID NO: 253 - RNA, 18 nt, Artificial Sequence
  Description of Artificial Sequence: Synthetic oligonucleotide
ucauccuaccuuugacau

SEQ ID NO: 254 - RNA, 18 nt, Artificial Sequence
  Description of Artificial Sequence: Synthetic oligonucleotide
ccccuucauccuaccuuu

SEQ ID NO: 255 - RNA, 18 nt, Artificial Sequence
  Description of Artificial Sequence: Synthetic oligonucleotide
uggauccccuucauccua

SEQ ID NO: 256 - RNA, 18 nt, Artificial Sequence
  Description of Artificial Sequence: Synthetic oligonucleotide
gcuuguggauccccuuca

SEQ ID NO: 257 - RNA, 18 nt, Artificial Sequence
  Description of Artificial Sequence: Synthetic oligonucleotide
cacaugcuuguggauccc

SEQ ID NO: 258 - RNA, 18 nt, Artificial Sequence
  Description of Artificial Sequence: Synthetic oligonucleotide
aaacccacaugcuugugg

SEQ ID NO: 259 - RNA, 18 nt, Artificial Sequence
  Description of Artificial Sequence: Synthetic oligonucleotide
caggaaaacccacaugcu

SEQ ID NO: 260 - RNA, 18 nt, Artificial Sequence
  Description of Artificial Sequence: Synthetic oligonucleotide
acaaccaggaaaacccac

SEQ ID NO: 261 - RNA, 18 nt, Artificial Sequence
  Description of Artificial Sequence: Synthetic oligonucleotide
uccacacaaccaggaaaa

SEQ ID NO: 262 - RNA, 18 nt, Artificial Sequence
  Description of Artificial Sequence: Synthetic oligonucleotide
cucccuccacacaaccag

SEQ ID NO: 263 - RNA, 18 nt, Artificial Sequence
  Description of Artificial Sequence: Synthetic oligonucleotide
auuuucucccuccacaca

SEQ ID NO: 264 - RNA, 18 nt, Artificial Sequence
  Description of Artificial Sequence: Synthetic oligonucleotide
aaagcauuuucucccucc

SEQ ID NO: 265 - RNA, 18 nt, Artificial Sequence
  Description of Artificial Sequence: Synthetic oligonucleotide
guuuuaaagcauuuucuc

SEQ ID NO: 266 - RNA, 18 nt, Artificial Sequence
  Description of Artificial Sequence: Synthetic oligonucleotide
aaagaguuuuaaagcauu

SEQ ID NO: 267 - RNA, 18 nt, Artificial Sequence
  Description of Artificial Sequence: Synthetic oligonucleotide
caggcaaagaguuuuaaa

SEQ ID NO: 268 - RNA, 18 nt, Artificial Sequence
  Description of Artificial Sequence: Synthetic oligonucleotide
gacuccaggcaaagaguu

SEQ ID NO: 269 - RNA, 18 nt, Artificial Sequence
  Description of Artificial Sequence: Synthetic oligonucleotide
guugagacuccaggcaaa

SEQ ID NO: 270 - RNA, 18 nt, Artificial Sequence
  Description of Artificial Sequence: Synthetic oligonucleotide
gcaaaguugagacuccag

SEQ ID NO: 271 - RNA, 18 nt, Artificial Sequence
  Description of Artificial Sequence: Synthetic oligonucleotide
gacaggcaaaguugagac

SEQ ID NO: 272 - RNA, 18 nt, Artificial Sequence
  Description of Artificial Sequence: Synthetic oligonucleotide
auuaugacaggcaaaguu

SEQ ID NO: 273 - RNA, 18 nt, Artificial Sequence
  Description of Artificial Sequence: Synthetic oligonucleotide
aucacauuaugacaggca

SEQ ID NO: 274 - RNA, 18 nt, Artificial Sequence
  Description of Artificial Sequence: Synthetic oligonucleotide
gccacaucacauuaugac

SEQ ID NO: 275 - RNA, 18 nt, Artificial Sequence
  Description of Artificial Sequence: Synthetic oligonucleotide
aacgugccacaucacauu

SEQ ID NO: 276 - RNA, 18 nt, Artificial Sequence
  Description of Artificial Sequence: Synthetic oligonucleotide
cuggcaacgugccacauc

SEQ ID NO: 277 - RNA, 18 nt, Artificial Sequence
  Description of Artificial Sequence: Synthetic oligonucleotide
agauacuggcaacgugcc

SEQ ID NO: 278 - RNA, 18 nt, Artificial Sequence
  Description of Artificial Sequence: Synthetic oligonucleotide
agccaagauacuggcaac

SEQ ID NO: 279 - RNA, 18 nt, Artificial Sequence
  Description of Artificial Sequence: Synthetic oligonucleotide
agggaagccaagauacug

SEQ ID NO: 280 - RNA, 18 nt, Artificial Sequence
  Description of Artificial Sequence: Synthetic oligonucleotide
accccagggaagccaaga

SEQ ID NO: 281 - RNA, 18 nt, Artificial Sequence
  Description of Artificial Sequence: Synthetic oligonucleotide
gacacaccccagggaagc

SEQ ID NO: 282 - RNA, 18 nt, Artificial Sequence
  Description of Artificial Sequence: Synthetic oligonucleotide
aaugagacacaccccagg

SEQ ID NO: 283 - RNA, 18 nt, Artificial Sequence
  Description of Artificial Sequence: Synthetic oligonucleotide
uggcuaaugagacacacc

SEQ ID NO: 284 - RNA, 18 nt, Artificial Sequence
  Description of Artificial Sequence: Synthetic oligonucleotide
cccucuggcuaaugagac

SEQ ID NO: 285 - RNA, 18 nt, Artificial Sequence
  Description of Artificial Sequence: Synthetic oligonucleotide
agggacccucuggcuaau

SEQ ID NO: 286 - RNA, 18 nt, Artificial Sequence
  Description of Artificial Sequence: Synthetic oligonucleotide
gagacagggacccucugg

SEQ ID NO: 287 - RNA, 18 nt, Artificial Sequence
  Description of Artificial Sequence: Synthetic oligonucleotide
uccuggagacagggaccc

SEQ ID NO: 288 - RNA, 18 nt, Artificial Sequence
  Description of Artificial Sequence: Synthetic oligonucleotide
cacuuuccuggagacagg

SEQ ID NO: 289 - RNA, 18 nt, Artificial Sequence
  Description of Artificial Sequence: Synthetic oligonucleotide
aagcccacuuuccuggag

SEQ ID NO: 290 - RNA, 18 nt, Artificial Sequence
  Description of Artificial Sequence: Synthetic oligonucleotide
gggccaagcccacuuucc

SEQ ID NO: 291 - RNA, 18 nt, Artificial Sequence
  Description of Artificial Sequence: Synthetic oligonucleotide
ggccugggccaagcccac

SEQ ID NO: 292 - RNA, 18 nt, Artificial Sequence
  Description of Artificial Sequence: Synthetic oligonucleotide
ccaagggccugggccaag

SEQ ID NO: 293 - RNA, 18 nt, Artificial Sequence
  Description of Artificial Sequence: Synthetic oligonucleotide
cuaagccaagggccuggg

SEQ ID NO: 294 - RNA, 18 nt, Artificial Sequence
  Description of Artificial Sequence: Synthetic oligonucleotide
cauuccuaagccaagggc

SEQ ID NO: 295 - RNA, 18 nt, Artificial Sequence
  Description of Artificial Sequence: Synthetic oligonucleotide
ugcggcauuccuaagcca

SEQ ID NO: 296 - RNA, 18 nt, Artificial Sequence
  Description of Artificial Sequence: Synthetic oligonucleotide
acagaugcggcauuccua

SEQ ID NO: 297 - RNA, 18 nt, Artificial Sequence
  Description of Artificial Sequence: Synthetic oligonucleotide
cacccacagaugcggcau

SEQ ID NO: 298 - RNA, 18 nt, Artificial Sequence
  Description of Artificial Sequence: Synthetic oligonucleotide
ccaugcacccacagaugc

SEQ ID NO: 299 - RNA, 18 nt, Artificial Sequence
  Description of Artificial Sequence: Synthetic oligonucleotide
cacagccaugcacccaca

SEQ ID NO: 300 - RNA, 18 nt, Artificial Sequence
  Description of Artificial Sequence: Synthetic oligonucleotide
cagaucacagccaugcac

SEQ ID NO: 301 - RNA, 18 nt, Artificial Sequence
  Description of Artificial Sequence: Synthetic oligonucleotide
gggaucagaucacagcca

SEQ ID NO: 302 - RNA, 18 nt, Artificial Sequence
  Description of Artificial Sequence: Synthetic oligonucleotide
acugugcagcugucaauc

SEQ ID NO: 303 - RNA, 18 nt, Artificial Sequence
  Description of Artificial Sequence: Synthetic oligonucleotide
uggccacugugcagcugu

SEQ ID NO: 304 - RNA, 18 nt, Artificial Sequence
  Description of Artificial Sequence: Synthetic oligonucleotide
agccauggccacugugca

SEQ ID NO: 305 - RNA, 18 nt, Artificial Sequence
  Description of Artificial Sequence: Synthetic oligonucleotide
uuggaagccauggccacu

SEQ ID NO: 306 - RNA, 18 nt, Artificial Sequence
  Description of Artificial Sequence: Synthetic oligonucleotide
ugucguuggaagccaugg

SEQ ID NO: 307 - RNA, 18 nt, Artificial Sequence
  Description of Artificial Sequence: Synthetic oligonucleotide
aggugugucguuggaagc

SEQ ID NO: 308 - RNA, 18 nt, Artificial Sequence
  Description of Artificial Sequence: Synthetic oligonucleotide
ccuucaggugugucguug

SEQ ID NO: 309 - RNA, 18 nt, Artificial Sequence
  Description of Artificial Sequence: Synthetic oligonucleotide
gcaccccuucaggugugu

SEQ ID NO: 310 - RNA, 18 nt, Artificial Sequence
  Description of Artificial Sequence: Synthetic oligonucleotide
auaccgcaccccuucagg

SEQ ID NO: 311 - RNA, 18 nt, Artificial Sequence
  Description of Artificial Sequence: Synthetic oligonucleotide
gaaauauaccgcaccccu

SEQ ID NO: 312 - RNA, 18 nt, Artificial Sequence
  Description of Artificial Sequence: Synthetic oligonucleotide
uggaggaaauauaccgca

SEQ ID NO: 313 - RNA, 18 nt, Artificial Sequence
  Description of Artificial Sequence: Synthetic oligonucleotide
gacguuggaggaaauaua

SEQ ID NO: 314 - RNA, 18 nt, Artificial Sequence
  Description of Artificial Sequence: Synthetic oligonucleotide
ccacagacguuggaggaa

SEQ ID NO: 315 - RNA, 18 nt, Artificial Sequence
  Description of Artificial Sequence: Synthetic oligonucleotide
gaggaccacagacguugg

SEQ ID NO: 316 - RNA, 18 nt, Artificial Sequence
  Description of Artificial Sequence: Synthetic oligonucleotide
cccgugaggaccacagac

SEQ ID NO: 317 - RNA, 18 nt, Artificial Sequence
  Description of Artificial Sequence: Synthetic oligonucleotide
cacuucccgugaggacca

SEQ ID NO: 318 - RNA, 18 nt, Artificial Sequence
  Description of Artificial Sequence: Synthetic oligonucleotide
ucuugcacuucccgugag

SEQ ID NO: 319 - RNA, 18 nt, Artificial Sequence
  Description of Artificial Sequence: Synthetic oligonucleotide
cugacucuugcacuuccc

SEQ ID NO: 320 - RNA, 18 nt, Artificial Sequence
  Description of Artificial Sequence: Synthetic oligonucleotide
cccgacugacucuugcac

SEQ ID NO: 321 - RNA, 18 nt, Artificial Sequence
  Description of Artificial Sequence: Synthetic oligonucleotide
ugccucccgacugacucu

SEQ ID NO: 322 - RNA, 18 nt, Artificial Sequence
  Description of Artificial Sequence: Synthetic oligonucleotide
gaauuugccucccgacug

SEQ ID NO: 323 - RNA, 18 nt, Artificial Sequence
  Description of Artificial Sequence: Synthetic oligonucleotide
caggugaauuugccuccc

SEQ ID NO: 324 - RNA, 18 nt, Artificial Sequence
  Description of Artificial Sequence: Synthetic oligonucleotide
agucacaggugaauuugc

SEQ ID NO: 325 - RNA, 18 nt, Artificial Sequence
  Description of Artificial Sequence: Synthetic oligonucleotide
guuacagucacaggugaa

SEQ ID NO: 326 - RNA, 18 nt, Artificial Sequence
  Description of Artificial Sequence: Synthetic oligonucleotide
ccuuuguuacagucacag

SEQ ID NO: 327 - RNA, 18 nt, Artificial Sequence
  Description of Artificial Sequence: Synthetic oligonucleotide
ugaagccuuuguuacagu

SEQ ID NO: 328 - RNA, 18 nt, Artificial Sequence
  Description of Artificial Sequence: Synthetic oligonucleotide
ucccgugaagccuuuguu

SEQ ID NO: 329 - RNA, 18 nt, Artificial Sequence
  Description of Artificial Sequence: Synthetic oligonucleotide
uauguucccgugaagccu

SEQ ID NO: 330 - RNA, 18 nt, Artificial Sequence
  Description of Artificial Sequence: Synthetic oligonucleotide
ggcaguauguucccguga

SEQ ID NO: 331 - RNA, 18 nt, Artificial Sequence
  Description of Artificial Sequence: Synthetic oligonucleotide
uucauggcaguauguucc

SEQ ID NO: 332 - RNA, 18 nt, Artificial Sequence
  Description of Artificial Sequence: Synthetic oligonucleotide
gucgagggccacaccaga

SEQ ID NO: 333 - RNA, 18 nt, Artificial Sequence
  Description of Artificial Sequence: Synthetic oligonucleotide
gcaaggucgagggccaca

SEQ ID NO: 334 - RNA, 18 nt, Artificial Sequence
  Description of Artificial Sequence: Synthetic oligonucleotide
agcaggcaaggucgaggg

SEQ ID NO: 335 - RNA, 18 nt, Artificial Sequence
  Description of Artificial Sequence: Synthetic oligonucleotide
uguggagcaggcaagguc

SEQ ID NO: 336 - RNA, 18 nt, Artificial Sequence
  Description of Artificial Sequence: Synthetic oligonucleotide
cccuuuguggagcaggca

SEQ ID NO: 337 - RNA, 18 nt, Artificial Sequence
  Description of Artificial Sequence: Synthetic oligonucleotide
cugugcccuuuguggagc

SEQ ID NO: 338 - RNA, 18 nt, Artificial Sequence
  Description of Artificial Sequence: Synthetic oligonucleotide
acucgcugugcccuuugu

SEQ ID NO: 339 - RNA, 18 nt, Artificial Sequence
  Description of Artificial Sequence: Synthetic oligonucleotide
gcagcucugcccgcuggg

SEQ ID NO: 340 - RNA, 18 nt, Artificial Sequence
  Description of Artificial Sequence: Synthetic oligonucleotide
gggaugcagcucugcccg

SEQ ID NO: 341 - RNA, 18 nt, Artificial Sequence
  Description of Artificial Sequence: Synthetic oligonucleotide
cuggucguccaggauggg

SEQ ID NO: 342 - RNA, 18 nt, Artificial Sequence
  Description of Artificial Sequence: Synthetic oligonucleotide
agcacuggucguccagga

SEQ ID NO: 343 - RNA, 18 nt, Artificial Sequence
  Description of Artificial Sequence: Synthetic oligonucleotide
gacgaagcacuggucguc

SEQ ID NO: 344 - RNA, 18 nt, Artificial Sequence
  Description of Artificial Sequence: Synthetic oligonucleotide
ggguggacgaagcacugg

SEQ ID NO: 345 - RNA, 18 nt, Artificial Sequence
  Description of Artificial Sequence: Synthetic oligonucleotide
gcccacaccagugcaggg

SEQ ID NO: 346 - RNA, 18 nt, Artificial Sequence
  Description of Artificial Sequence: Synthetic oligonucleotide
cgcccacaccagugcagg

SEQ ID NO: 347 - RNA, 18 nt, Artificial Sequence
  Description of Artificial Sequence: Synthetic oligonucleotide
acacucgcccacaccagu

SEQ ID NO: 348 - RNA, 18 nt, Artificial Sequence
  Description of Artificial Sequence: Synthetic oligonucleotide
gaccgacacucgcccaca

SEQ ID NO: 349 - RNA, 18 nt, Artificial Sequence
  Description of Artificial Sequence: Synthetic oligonucleotide
uggaagaccgacacucgc

SEQ ID NO: 350 - RNA, 18 nt, Artificial Sequence
  Description of Artificial Sequence: Synthetic oligonucleotide
gagacuggaagaccgaca

SEQ ID NO: 351 - RNA, 18 nt, Artificial Sequence
  Description of Artificial Sequence: Synthetic oligonucleotide
ggcuggagacuggaagac

SEQ ID NO: 352 - RNA, 18 nt, Artificial Sequence
  Description of Artificial Sequence: Synthetic oligonucleotide
ucaccggcuggagacugg

SEQ ID NO: 353 - RNA, 18 nt, Artificial Sequence
  Description of Artificial Sequence: Synthetic oligonucleotide
ugucuucaccggcuggag

SEQ ID NO: 354 - RNA, 18 nt, Artificial Sequence
  Description of Artificial Sequence: Synthetic oligonucleotide
cacuuugucuucaccggc

SEQ ID NO: 355 - RNA, 18 nt, Artificial Sequence
  Description of Artificial Sequence: Synthetic oligonucleotide
aggugcacuuugucuuca

SEQ ID NO: 356 - RNA, 18 nt, Artificial Sequence
  Description of Artificial Sequence: Synthetic oligonucleotide
gucagaggugcacuuugu

SEQ ID NO: 357 - RNA, 18 nt, Artificial Sequence
  Description of Artificial Sequence: Synthetic oligonucleotide
uaggagucagaggugcac

SEQ ID NO: 358 - RNA, 18 nt, Artificial Sequence
  Description of Artificial Sequence: Synthetic oligonucleotide
gguaauaggagucagagg

SEQ ID NO: 359 - RNA, 18 nt, Artificial Sequence
  Description of Artificial Sequence: Synthetic oligonucleotide
auccugguaauaggaguc

SEQ ID NO: 360 - RNA, 18 nt, Artificial Sequence
  Description of Artificial Sequence: Synthetic oligonucleotide
caguuauccugguaauag

SEQ ID NO: 361 - RNA, 18 nt, Artificial Sequence
  Description of Artificial Sequence: Synthetic oligonucleotide
ucgcacaguuauccuggu

SEQ ID NO: 362 - RNA, 18 nt, Artificial Sequence
  Description of Artificial Sequence: Synthetic oligonucleotide
gauguucgcacaguuauc

SEQ ID NO: 363 - RNA, 18 nt, Artificial Sequence
  Description of Artificial Sequence: Synthetic oligonucleotide
aaugugauguucgcacag

SEQ ID NO: 364 - RNA, 18 nt, Artificial Sequence
  Description of Artificial Sequence: Synthetic oligonucleotide
agguaaaugugauguucg

SEQ ID NO: 365 - RNA, 18 nt, Artificial Sequence
  Description of Artificial Sequence: Synthetic oligonucleotide
guuaaagguaaaugugau

SEQ ID NO: 366 - RNA, 18 nt, Artificial Sequence
  Description of Artificial Sequence: Synthetic oligonucleotide
uccuuguuaaagguaaau

SEQ ID NO: 367 - RNA, 18 nt, Artificial Sequence
  Description of Artificial Sequence: Synthetic oligonucleotide
ucaucuccuuguuaaagg

SEQ ID NO: 368 - RNA, 18 nt, Artificial Sequence
  Description of Artificial Sequence: Synthetic oligonucleotide
ugacaucaucuccuuguu

SEQ ID NO: 369 - RNA, 18 nt, Artificial Sequence
  Description of Artificial Sequence: Synthetic oligonucleotide
aaaaaacaaagguuguua

SEQ ID NO: 370 - RNA, 18 nt, Artificial Sequence
  Description of Artificial Sequence: Synthetic oligonucleotide
caaaaaaaaaacaaaggu

SEQ ID NO: 371 - RNA, 18 nt, Artificial Sequence
  Description of Artificial Sequence: Synthetic oligonucleotide
ccauucaaaaaaaaaaca

SEQ ID NO: 372 - RNA, 18 nt, Artificial Sequence
  Description of Artificial Sequence: Synthetic oligonucleotide
auccaccauucaaaaaaa

SEQ ID NO: 373 - RNA, 18 nt, Artificial Sequence
  Description of Artificial Sequence: Synthetic oligonucleotide
cagacauccaccauucaa

SEQ ID NO: 374 - RNA, 18 nt, Artificial Sequence
  Description of Artificial Sequence: Synthetic oligonucleotide
gcaagcagacauccacca

SEQ ID NO: 375 - RNA, 18 nt, Artificial Sequence
  Description of Artificial Sequence: Synthetic oligonucleotide
agcaagcaagcagacauc

SEQ ID NO: 376 - RNA, 18 nt, Artificial Sequence
  Description of Artificial Sequence: Synthetic oligonucleotide
uuuaaagcaagcaagcag

SEQ ID NO: 377 - RNA, 18 nt, Artificial Sequence
  Description of Artificial Sequence: Synthetic oligonucleotide
ccuccuuuaaagcaagca

SEQ ID NO: 378 - RNA, 18 nt, Artificial Sequence
  Description of Artificial Sequence: Synthetic oligonucleotide
gcauuccuccuuuaaagc

SEQ ID NO: 379 - RNA, 18 nt, Artificial Sequence
  Description of Artificial Sequence: Synthetic oligonucleotide
ucauggcauuccuccuuu

SEQ ID NO: 380 - RNA, 18 nt, Artificial Sequence
  Description of Artificial Sequence: Synthetic oligonucleotide
cuagcucauggcauuccu

SEQ ID NO: 381 - RNA, 18 nt, Artificial Sequence
  Description of Artificial Sequence: Synthetic oligonucleotide
agauccuagcucauggca

SEQ ID NO: 382 - RNA, 18 nt, Artificial Sequence
  Description of Artificial Sequence: Synthetic oligonucleotide
gaaguagauccuagcuca

SEQ ID NO: 383 - RNA, 18 nt, Artificial Sequence
  Description of Artificial Sequence: Synthetic oligonucleotide
agggagaaguagauccua

SEQ ID NO: 384 - RNA, 18 nt, Artificial Sequence
  Description of Artificial Sequence: Synthetic oligonucleotide
aagcuagggagaaguaga

SEQ ID NO: 385 - RNA, 18 nt, Artificial Sequence
  Description of Artificial Sequence: Synthetic oligonucleotide
aauguaagcuagggagaa

SEQ ID NO: 386 - RNA, 18 nt, Artificial Sequence
  Description of Artificial Sequence: Synthetic oligonucleotide
acaggaauguaagcuagg

SEQ ID NO: 387 - RNA, 18 nt, Artificial Sequence
  Description of Artificial Sequence: Synthetic oligonucleotide
auaaaacaggaauguaag

SEQ ID NO: 388 - RNA, 18 nt, Artificial Sequence
  Description of Artificial Sequence: Synthetic oligonucleotide
uuauuauaaaacaggaau

SEQ ID NO: 389 - RNA, 18 nt, Artificial Sequence
  Description of Artificial Sequence: Synthetic oligonucleotide
uuacuuuauuauaaaaca

SEQ ID NO: 390 - RNA, 18 nt, Artificial Sequence
  Description of Artificial Sequence: Synthetic oligonucleotide
caagcuuacuuuauuaua

SEQ ID NO: 391 - RNA, 18 nt, Artificial Sequence
  Description of Artificial Sequence: Synthetic oligonucleotide
aaguucaagcuuacuuua

SEQ ID NO: 392 - RNA, 18 nt, Artificial Sequence
  Description of Artificial Sequence: Synthetic oligonucleotide
uggcuaaguucaagcuua

SEQ ID NO: 393 - RNA, 18 nt, Artificial Sequence
  Description of Artificial Sequence: Synthetic oligonucleotide
cuagggagaaguagaucc

SEQ ID NO: 394 - RNA, 18 nt, Artificial Sequence
  Description of Artificial Sequence: Synthetic oligonucleotide
guaagcuagggagaagua

SEQ ID NO: 395 - RNA, 18 nt, Artificial Sequence
  Description of Artificial Sequence: Synthetic oligonucleotide
ggaauguaagcuagggag

SEQ ID NO: 396 - RNA, 18 nt, Artificial Sequence
  Description of Artificial Sequence: Synthetic oligonucleotide
aaacaggaauguaagcua

SEQ ID NO: 397 - RNA, 18 nt, Artificial Sequence
  Description of Artificial Sequence: Synthetic oligonucleotide
uuauaaaacaggaaugua

SEQ ID NO: 398 - RNA, 18 nt, Artificial Sequence
  Description of Artificial Sequence: Synthetic oligonucleotide
cuuuauuauaaaacagga

SEQ ID NO: 399 - RNA, 18 nt, Artificial Sequence
  Description of Artificial Sequence: Synthetic oligonucleotide
gcuuacuuuauuauaaaa

SEQ ID NO: 400 - RNA, 18 nt, Artificial Sequence
  Description of Artificial Sequence: Synthetic oligonucleotide
uucaagcuuacuuuauua

SEQ ID NO: 401 - RNA, 18 nt, Artificial Sequence
  Description of Artificial Sequence: Synthetic oligonucleotide
cuaaguucaagcuuacuu

SEQ ID NO: 402 - RNA, 18 nt, Artificial Sequence
  Description of Artificial Sequence: Synthetic oligonucleotide
gcuggcuaaguucaagcu

SEQ ID NO: 403 - RNA, 18 nt, Artificial Sequence
  Description of Artificial Sequence: Synthetic oligonucleotide
uugaggcuggcuaaguuc

SEQ ID NO: 404 - RNA, 18 nt, Artificial Sequence
  Description of Artificial Sequence: Synthetic oligonucleotide
ucucuuugaggcuggcua

SEQ ID NO: 405 - RNA, 18 nt, Artificial Sequence
  Description of Artificial Sequence: Synthetic oligonucleotide
gauguucucuuugaggcu

SEQ ID NO: 406 - RNA, 18 nt, Artificial Sequence
  Description of Artificial Sequence: Synthetic oligonucleotide
gcugagauguucucuuug

SEQ ID NO: 407 - RNA, 18 nt, Artificial Sequence
  Description of Artificial Sequence: Synthetic oligonucleotide
aaaaggcugagauguucu

SEQ ID NO: 408 - RNA, 18 nt, Artificial Sequence
  Description of Artificial Sequence: Synthetic oligonucleotide
agaacaaaaggcugagau

SEQ ID NO: 409 - RNA, 18 nt, Artificial Sequence
  Description of Artificial Sequence: Synthetic oligonucleotide
gaggaagaacaaaaggcu

SEQ ID NO: 410 - RNA, 18 nt, Artificial Sequence
  Description of Artificial Sequence: Synthetic oligonucleotide
auugagaggaagaacaaa

SEQ ID NO: 411 - RNA, 18 nt, Artificial Sequence
  Description of Artificial Sequence: Synthetic oligonucleotide
guaagauugagaggaaga

SEQ ID NO: 412 - RNA, 18 nt, Artificial Sequence
  Description of Artificial Sequence: Synthetic oligonucleotide
cacguguaagauugagag

SEQ ID NO: 413 - RNA, 18 nt, Artificial Sequence
  Description of Artificial Sequence: Synthetic oligonucleotide
ccacacacguguaagauu

SEQ ID NO: 414 - RNA, 18 nt, Artificial Sequence
  Description of Artificial Sequence: Synthetic oligonucleotide
aaaacccacacacgugua

SEQ ID NO: 415 - RNA, 18 nt, Artificial Sequence
  Description of Artificial Sequence: Synthetic oligonucleotide
ugugcuccguaguaagac

SEQ ID NO: 416 - RNA, 18 nt, Artificial Sequence
  Description of Artificial Sequence: Synthetic oligonucleotide
gcaaaugugcuccguagu

SEQ ID NO: 417 - RNA, 18 nt, Artificial Sequence
  Description of Artificial Sequence: Synthetic oligonucleotide
ucacugcaaaugugcucc

SEQ ID NO: 418 - RNA, 18 nt, Artificial Sequence
  Description of Artificial Sequence: Synthetic oligonucleotide
ucaauucacugcaaaugu

SEQ ID NO: 419 - RNA, 18 nt, Artificial Sequence
  Description of Artificial Sequence: Synthetic oligonucleotide
auuccucaauucacugca

SEQ ID NO: 420 - RNA, 18 nt, Artificial Sequence
  Description of Artificial Sequence: Synthetic oligonucleotide
uucaaauuccucaauuca

SEQ ID NO: 421 - RNA, 18 nt, Artificial Sequence
  Description of Artificial Sequence: Synthetic oligonucleotide
aaauauucaaauuccuca

SEQ ID NO: 422 - RNA, 18 nt, Artificial Sequence
  Description of Artificial Sequence: Synthetic oligonucleotide
cuucaaaauauucaaauu

SEQ ID NO: 423 - RNA, 18 nt, Artificial Sequence
  Description of Artificial Sequence: Synthetic oligonucleotide
acauucuucaaaauauuc

SEQ ID NO: 424 - RNA, 18 nt, Artificial Sequence
  Description of Artificial Sequence: Synthetic oligonucleotide
cggaaacauucuucaaaa

SEQ ID NO: 425 - RNA, 18 nt, Artificial Sequence
  Description of Artificial Sequence: Synthetic oligonucleotide
uucagcggaaacauucuu

SEQ ID NO: 426 - RNA, 18 nt, Artificial Sequence
  Description of Artificial Sequence: Synthetic oligonucleotide
gaauauucagcggaaaca

SEQ ID NO: 427 - RNA, 18 nt, Artificial Sequence
  Description of Artificial Sequence: Synthetic oligonucleotide
agauugaauauucagcgg

SEQ ID NO: 428 - RNA, 18 nt, Artificial Sequence
  Description of Artificial Sequence: Synthetic oligonucleotide
gauguagauugaauauuc

SEQ ID NO: 429 - RNA, 18 nt, Artificial Sequence
  Description of Artificial Sequence: Synthetic oligonucleotide
caagcgauguagauugaa

SEQ ID NO: 430 - RNA, 18 nt, Artificial Sequence
  Description of Artificial Sequence: Synthetic oligonucleotide
gcucgcaagcgauguaga

SEQ ID NO: 431 - RNA, 18 nt, Artificial Sequence
  Description of Artificial Sequence: Synthetic oligonucleotide
ggaaggcucgcaagcgau

SEQ ID NO: 432 - RNA, 18 nt, Artificial Sequence
  Description of Artificial Sequence: Synthetic oligonucleotide
gggaaggcucgcaagcga

SEQ ID NO: 433 - RNA, 18 nt, Artificial Sequence
  Description of Artificial Sequence: Synthetic oligonucleotide
ucauuguucgcugaaggg

SEQ ID NO: 434 - RNA, 18 nt, Artificial Sequence
  Description of Artificial Sequence: Synthetic oligonucleotide
guauuucauuguucgcug

SEQ ID NO: 435 - RNA, 18 nt, Artificial Sequence
  Description of Artificial Sequence: Synthetic oligonucleotide
cacauguauuucauuguu

SEQ ID NO: 436 - RNA, 18 nt, Artificial Sequence
  Description of Artificial Sequence: Synthetic oligonucleotide
auggccacauguauuuca

SEQ ID NO: 437 - DNA, 581 bp, Homo sapiens
gtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccagtatgtaacaacctttgttttttttttgaatggtggatgtctgcttgcttgctttaaaggaggaatgccatgagctaggatctacttctccctagcttacattcctgttttataataaagtaagcttgaacttagccagcctcaaagagaacatctcagccttttgttcttcctctcaatcttacacgtgtgtgggtttttaaaaatcgttttagggtcttactacggagcacatttgcagtgaattgaggaatttgaatattttgaagaatgtttccgctgaatattcaatctacatcgcttgcgagccttccccttcagcgaacaatgaaatacatgtggccatt

SEQ ID NO: 438 - DNA, 1172 bp, Homo sapiens
ctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaaggtacctcccttctcccgggacctggctgtctccagacttgctccttttgtccccacttactaccactgccccttgttacacttgagaagtaatgtattggtgaggaggacctctatagtgaaatgatcctgcctgtgtagcgggccgcaacacgtggaaacaatctattccggcctgccagtgggagagccgtgtctacaagtagcccaggggagagaatgtgaaatccatttagcattcctgttctggggtgggctgatgtgcaacgctgaggcaaatgcctgagaacaacactgtcaacagaacttcctgcaacggcagacagagggggatgttctgtatctgcacggtcaggtatgggagccccaggccatgtggactgtgactagtgtaactagaaactgattttatttcattttagttcatttaaatgtaaatagccacatgtggccggtggctgctgtattaggcagcacaacatttaaagcttctataagattgtccttgagccttgcttaagatcaaaaaggaagtaaataaagcaggtccttttgccttagcaagtgtttaccaaattgggtagatgtcaaaggtaggatgaaggggatccacaagcatgtgggttttcctggttgtgtggagggagaaaatgctttaaaactctttgcctggagtctcaactttgcctgtcataatgtgatgtggcacgttgccagtatcttggcttccctggggtgtgtctcattagccagagggtccctgtctccaggaaagtgggcttggcccaggcccttggcttaggaatgccgcatctgtgggtgcatggctgtgatctgatcccaagcctatcttctagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaa

SEQ ID NO: 439 - DNA, 623 bp, Homo sapiens
cccgaaacagtagctgcctgcccaacccctgccataatgggggcacatgtgtggtcaacggcgagtcctttacgtgcgtctgcaaggaaggctgggaggggcccatctgtgctcagagtgagtgtcctccccccttgaactctcccagggctgtcggagcagatcctgacacccttggggacttgcaatggaaaccagaagcagagctgtttgatgtctgcttttgtatcacctgggtctgcattaatgacttgatgggatacagccctgacctgggcatgagaaagtcgccaataagataagtggagacagatggcgtctcagttcccagctctgggtctgaccagcagcctgtctccttccattctcacccccacccctatcccctaccagggcctcttcctgtgtacatgtgtcccacagcaaatgaaactaagtgtggtgcgggcctggttccaatttagcaaaggtattttgctggtgttaactacgactttatcatttgggtattaggaaaataagtggtggttttacttagggctaagaccgctttccctgttgaagtcctcactattaagttgtcttttctttgcagataccaatgactgcagccctcatccctg

SEQ ID NO: 440 - DNA, 40826 bp, Homo sapiens
tttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcggggtaagtggcggtccccacggggcaagtggcggtccccacggggcagcggcctagagaggcggaccccgcagtgtccgggtcccgggccctcacccgcgcccactgcaacccgactccggagctccgagcatcccttagttttaagtcatggcgggtgcgaacgggtctctgctgcaggcggctccgtgacagctcctgcttcacatgggtagaggagagacggcaaacgtcggggctcccaggacttcgcggcggcagtcctaacccgtgcactgagtcgggcggggcgggcggcagcgtctgagtagagagctctctagaccaggcctggtgtctcccgggctttcctaggtgcctgtttgcgagctggtcagctgggctgtagttgagttctcccagggagtgtgggaggaaaggttatgcccaccagagacccagggtcctgacggctggaggtccgcagtggggaaggtgggcagaggtgttgctcagatgtccccattcctgtttcgtttgcacagaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagtgagtgagctacctgtgtctttgctaggctagagggaaatgcagagaaggctgggtttggtcttgcaccaggttctgtgggagacgggttgctggcaactgtctacacaggaatgctgtctccagtacttggaggccgacatgtccttcctcaggagacttcgaaagtcaggatcttggtgacctggttcaggcacacttgagttactattcagatgttgatgaaagaaagcccatcttatagatgaggcctgagtatcatcatcttcacaggtaaggatatgtccaggtgttacatgataagatgtgagttcctgggagaagtaggttctttattttattttttttttgagactgagtcttgctctgttgcctaggctggagtgcagtggcacaatctctgctcgctgctacctctgcctcccagtttcaagtggttctcctgcctcagcctcctgagtagctgggactacagacacgtgccaccacacccatttaatttttgtatttttagtagagatggagtttcactatcttggccaggctggtcttgaactgctgacctcaggtgatctgcccgctttggcctcccaaagtgctgggattacaggcatgagccatcgcacatgggctaggtcgttatcttttatgtgtgtttgtgtctttgtcacacatgcctggcattgtgttttgcccatgagtaaatgctgaatttttgcacttgtaaagttttctacttagaaacaactaaaacgttcatcaactgatgaataaaatatagtccatcctggctgggtgcggtggctcacgcctgtcatcccagcactttgggaggccgaggcgggtggatcacctgaggtcaggagtttgagaccagcctggccaacatggcgaaaccccgtctctactaaaaataccaaaaattagccggtcatagtggtgggcgcctgtaattccagctactcggggggctgagacgagaattgcttgaacccgggaggcggaggtttcagtgagccgtgatcgcgccactgcactccatcctggggaagaagagcaaaactccgtctaaaaaaaaattgtgcagtttgaaattgtatttcatgttatgttttatctcaatacaacatttgcagttgtgaaaaaaaattgcacattctcaactcctcgggatggagcagtaaagcccctcagtaaatctttttttttttttttttttgagaccgagtttcgctcttgtcacccaggctggagcgcaggggcgcgatctcggctcactgcaatctccgcctcctgggttcaagggattctcctgcctcactctcccgagtagctgggattatagacgcccaccaccacgcccagcaaattttttgtatttttagtagagacagggtttcatcatgttgggcaggctggtctcaaactcctgacctctggtgatccacctgccttggccccccaaagtgcagggattacaggcctgagccaccgcggctcgtcaagtgaatcttgattccagaaagatctgttttaagtctctagtctggaaaatgcagtgggagtctttaggtggtttgtgacttgcagttaaggagaccgtggcctgagcactggcccctttttcttctttcatctctctccaggaactgagcatggaatgtggcctcaacaatcgcatccggatgatagggcagatttgtgaagtcgcaaaaaccaagaaatttgaagaggtaggtttatccagttgagctactagagagaggcacgtagactattcagagcctgagtttgctttttttaggaacatggttgacagctgactgccgatgatctggtttgcactttttttttttttttttttttgagatggagtcttgctctgtcgcccaggctggcacaatcttggctcactgcagcctctgcctcctgggttcaagcagttctcctgcctcagcctcctgagtagctgggattacaggcacgcgccaccacacccggctttttgtatttttagtagagacggggtttcgccatgttggccaggctggtcttgaactcctgacctcgtgaaccatatgcctcagcctcccaaagtgctgggattacaggcgtgagccactgcgcccagccagtttgcactgttttaggggaatttagctttcatcgtagtgatggggaagctactggaaatgccccgaatacaaccttgagggaccaatcaagcgtggaaatggggagcaaagggattaggcttttctagcaacaccagaaaggatttctatgccgagcgggggtgcgggggcttatgcctgtaatcctaggactttgggaggccgaggtgggtggatcacgaggtcaggagttcaagaccactctggccaacatggcgaaaccccgtctgtactaaaagatgatgagccgggcatggtggcacatgcctgtaatcccagctacttgggaggctgaggcaggagaatcgcttgaacccgggaggcacaggttgcagtgagccgagatcgccccactgcactccagtctgggtgacggagcaagactctgtctcaaaaaaaaaaaaaaggaagagtttgtagtggctgatagaaacgcatgctcactcgctctctcctgttacaagttcaggccaagaaaaatcaagaaagggtttgttccacagagaacaatcctaggcacgctggtcttggtgccattttgggagggtgactggtcggtggtattgggcgacctcacggacatagaaatatttattttgggcaaacattgccagactttcctgatgacttgtggacaggacaggaagtggtcattttgggagtgcaggttgctggtagagcacctgagggctctgcccttgccttgcccagcatttgtgtgtgggagagcagtgagacctggacctctcatgctcagatctgctaagaggagagtgattgctacctctgcagcagctcatctgaaacgtgctggccgtacgctaccaaagataggtgtaaagaacaggtgtccttagccgggcgcagtggttcacgcctgtaatcccagcactttgggaggccaaggtggatggatcacctgaggtgaggagttcgagacccgcctggccaatgtggcaaaaccctgtttctactaaagatacaaaaattagctgggcatggtgtcgggcacctgtaatcccagctacttgggaggctgagggaggagaatcgcttaaactcaggaggcagaggttgtggtgagctgagattgtgccattgcactgcagcctgggcaacagagcaagactgtctcagaaaacaaaaaaaagaacaagcgtcctgcatcctgttctgaaagttgtttgtgtgggtacggggcagcctgtgagtggataaataggcctccgaggctgggatggtcccgggccctgtgtccacggatctttgcagctcaggttgcaacggtaagagtattgtcaatgagacaaaggaggtgagagtgccagttgtctgaattggttgggatgttggtcagatgacatctaaaagaacacggccattttgttattatttggttagagacaaggtctcactctgtcacccaggccggggtgcagtgtcacaatcatggctcactacagcctcaacctgccaggctcacgtgatcctcctactttagcctctcaagtagctgggactacaggcatgcagcaccacgcctggctaagttttgtattttttgtcgtgacagggtctcactgtgttgcccaggctagtctgaaactcctgggctgacgtgaccctctcccctctgccacccgaagtgctgagattacaggtgtgagccaccgcacttggccagaacacggccattttagttcccctccttagaggagtaaggccaggaatgagcctgtggtctgaaagccgtggctgttggttaatgtggagaagggaaggtggtgagagccagcccaaacccctgccgagtgagactgattctggcagctttagggagcagggatgagcccctcacaggctgggtggtagttagaggaggcagatttcagaaggccacgcagcgctctttctcagcaggtcaggcaggcagcagaggtcgggcaggggcatggggtcgagggcccgatgctggtgtgttcactagaggagagccacaagcagggattctgggtcaggtgcaggcctagggcttagtgtgcacttgtggttctgagactgtcccatgacttcctgccagcattccggcagctctagtgggactccctcctggtccaggtgaggccaccattgctgccctggcttgctgctgtcctctcagcccccagtctgtcacctggtgggagttaaagggacctgctggggtttgaggaagctctgagccgttccctgtacgaagcctgtggtcatctcaggctgcaggagacacaggagatacgagctttggaggtggggctctcagtcacaagcccccgttgttcctccctgtcctccgctcacggcactgctccagttgccggggccagggttcttggagagcacatcctcaccgctgtcccctctgctggtgacagcacgcagtggaagcactctggaaggcggtcgcggatctgttgcagccggagcggccgctggaggcccggcacgcggtgctggctctgctgaaggccatcgtgcaggggcaggtaaggcccagggcgacgctgggatgggtgacgtcaggctgcccactgactgtcctgtccctgctgggccgtgtttggactcctgcctcggtgagttgctgggcacagggtctaggggctgatgggctctggagctggatggcctgtggggtctcctggtgtcatgaggtctgtgtgaccgtaggcactgcctcctcgcctgtaaacagatggtcactgcaccttcctcttatgggatgttctggggatcatatgaggcagttctcgcagagtgctgagatcgtacctggcagctggtgtggggctacggtgttgttttgcccttgcaccctttcggggccactcccctgctcactgcattccatctgtgctggtcttggctgaccctgaacacccaggcctcttggtgttcctgcctcccctggtcggccacttctactccttcatgtcccagctgctcagaagggccgtccactctcacaggctctcctgggtttcccccactcaggccttgtcctcagtctctgagcacaaggctgtctgccctgcaccgagtgcaggggtcgggcaggagctgtgtcatcccctgctctgcgccacccgctgtgccaggtcccgacacacagcagttgctccccatacgccgctctgcggtcggccggtgcatccggccccctgccctgtacaatgctgatgctgcagacctgtctcttgcagggcgcctctgtgggaaggagaggggtccagggctggagtccgggtgcccctgcacttcagggacttcttggcagccgtgtgggcgacgctggcaggctctgctgatcctgtggcttttgtctttagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctgggtgggtgccaccttgggttggaggtttctctggccttgacgatcaagtgtaacctggatgggaaggacctggggctggggaggggctgccgttctcagggatggcctgcagcgggtatgcccaccctgcttcatgcacctgggctcacctgcgtggccggagtgcccctgaggcacgtgttaaaaatgcagagtcctggccttcaccccagacctgctgactgtgagtctctggggcttggggcctccgaacacctctgcaacggcaggagctgggcgagttctgtcactgggaggtggtgctgctgacttggtctcaaccggagcgtactggtcccgtcttcctcctcctttctccactttgtggaccttcctcctgccatcctgtggtgggaggtttccattagtcttgggtctctgtgtcatgattctgggaagtagagaaagaggaggaagagatcggtctgactctggctttgctgttctgtcgcccagaaaagggcctcagtggctgggctgcctgcaggacaggtgccggccaggtgcctaccgtcaggtttcctgtctgaggtgacgtggccggcagccaagtgtgcacacgtctcctccgagccactctctgctgggggtggggaacgcccaggagtctggtgatgtcggcgtctcccagcctcgggttgggccctgagtgtacggcatacacacttctgctgccgcctcggcacagaccctctgtgcagccccaggggcggtagatcctagtgtccgtgcgtagccggcctgccctgggctcccctgagcctcttcgggcccagtgcgtggtctgtctgttgctgccgggggactgatgatggggtttctggcagtgacgggtttggacacactgtcctgcggcgggagggggaggtgagtgggagatgtagattcggcgtcctcgcaaactgccgccgcttctcccccagctgactttgtcctgcagtggatggatgttggcttgtcctcggaattccttctggtgctggtgaacttggtcaaattcaatagctgttacctcgacgagtacatcgcaaggatggttcagtaagaaaagaattgagatcctgttctgataatggtcctaagttcagctccgcagtgaataaagttgaaaccaccaaaaaaatagaggttgggctgggcacaatggctcacgcctgtaatctcagcactttgggaggccgaggcaggcggatcacgaggtcaggagttcgagaccagcctggccaacatggtgaaaccctgtctctactaaaaatacaaaaattagccgggcatggtggtgggagcctgtaatcccagctactcaggaggctgaggcaggagaattgcttgaaaccggaaggcagaggttgcagtgagcggagatcgtgccactgcactccagcctgggtgaaagagcaaaactccatctcaaaaaaaaaaaaaaaaaaagagaagtacgtagctatcttctgtttagctctcatctgatgtcttggttatctttttgttgtttgtttagaatgttgcatgagctctgtctcactcatgctgaacacccagcaccgagagcagtggctggcgcacagcaggcacctgagtgcttgttgggtgggtgggacccccagggaggatgagccatgcgtgttattgacgtcatagagtgactagaccacagcccgtggtggctcggccatccaggcagtgctgccgggactgagctcggtgctccctgcaggatgatctgtctgctgtgcgtccggaccgcgtcctctgtggacatagaggtcagtgcctcccctccccagggccggcccatttcaccctggtttctgggaggctggggcttgggggttgagccctgtgtgccacctgctggctgtgtagccctgggcaagctgctcggtctctctgagcctcaggagtcccccatgtaagtcaggatagccgggcgcctccatgtggagatgtagctcagggtggatgacagcatcaatgacccacagtgacagggacgtcaggtgcttcccacatgcccgcttgccctgtggcttggagagagggtgccatggcagcggggagaggtggcagcgcaggctgaaggaggtgggaaggaagcctgggtgtcctctcctgtggggaggagctggggtaggacgggcgtgagccgtctccctctccaccaggtctccctgcaggtgctggacgccgtggtctgctacaactgcctgccggctgagagcctcccgctgttcatcgttaccctctgtcgcaccatcaacgtcaaggagctctgcgagccttgctggaaggtggggtttctgaaactgctctggaaggttcctgagagcacatggatgggacaagggccatcctgtctcccatgaatggttgtctgattcttggggtggccagacaatggcctgttgagggacggccagtgtcattttcccaggcagttgagctgaggtcagggttttggtggcattttgagaaccctgctgcctctgtctttgggaggagatggtggcgagctggccggaccttgggtggctatagggcagcagccaggcggggccagcagcgggactggggctgggggcagggcttatgcctgccagcccctgacacgcattgtgtctcgcagctgatgcggaacctccttggcacccacctgggccacagcgccatctacaacatgtgccacctcatggaggacaggtgagtgtggtgggtggggcgcagggcagtggaggccagcacagccctcggggcagctccagtgtcccttgccaagcacacactggcttagagagtccttgtcctctcgggcagctgttccagaggctgccactagagcgaggcccatgacttctaggatccagcccctgtcctctccttcctctgtcagttcaacagaatatccacacccagctcagtgcctgccccatgctcggacgtcctccagcggtgctccccaactacttagcctgttacaaggcgaggctcggggtcttggcttgacgttgcccttgccctcacccccacagccaggctgtggccacttttgttgctttagccattagagatggctcagctctgcccacaccctggcctcccacccatgctgccagctccccctcctgctctcctgtatccatccgcgcctcctgaagcccactccatgcagcacccgggtggcctttttctgacacagatatgtcggtgtcaccctttgctggaagccaggtggttcccagcgcccttgggatgtaggcttctcctatggaaccaggccctggggccagccctgcctcagccctgcatctctcccagccctgcctcggcccctgcatctctcccagccctgcctcggcccctgcatctctcccagccctgcctcggcccctgcatctctcccagccctgcctcggcccctgcatctctcccagccctgcctcggcccctgcatctctcccagccctgcctcggcccctgcatctctcccagccctgcctcggcccctgcatctctcccagccctgcctcggcccctgcatctctcccagccctgcctcggccctgcatctttccttccctccatccttggaaccaggccctggggcccagccctgcctcagccctgcatctctcctagccctgcctcagcccctgcatctctccctccctcctcccgtagaaccaggccctgggggccagccctgcctcagcctgcatctctcccagccctgccccaccccctgcatctctcctttcctccatcttgccttctcccctccaccaagggcttgtgcatgccctgattcctcttgccagcaggttcttccacctttgccgagttactctgtttactgaggtcttagcgtggtcactgactcccccacctccctgagtagtttttgctgtggctttccttcttggctgtgattggaggaagagattttgcgtttacctgggagattatgtggctggcgcctgtctcccccagactgcgaggctgtgggccatccctcttgcctgcttcctgtccctggcatgacctgtagctcacagcgtggtcagcagtgatgggctgccgcctgtgcgcaggagtgaacaagagtgttactgctggcctctgttccctgcccttccccagcggtgctcctgccccccccaagcacagggacctctggggctgctgcaggagcctcggcaacctcacacatccatggcggaccctgggacagggccctgctcacattccgtctctctggggaacacttttagagcctacatggaggacgcgcccctgctgagaggagccgtgttttttgtgggcatggctctctggggagcccaccggctctattctctcaggaactcgccgacatctgtgttgccatcattttaccaggtaaggcggtttctgtgtgcagtgagctggcaggaacgggagagctcccctcacgcctgcccacccatcccactgggggtcctgctgcgggggctgcggtggcatttctaggcctttccaggcagttgctttgcagctgggggtgaggtttggggccctttgtaggctttagtcttttttttttttttgagaaggagttctgctctttctgcttggctgactgcaatctccgcctcccggattcaagtgattctattgcctcagactcctgagtagctgggattacaggtgcctggtaccatgcctggctaattttgtgtttttagtagagacggggtttcgccatgttggccaggctggtctcgaattcctgacctgaagtgatccacccatctcagactcccaaagtgctaggattacaggcgtgagccaccatgcctggccaaaggcttttttctctctctctttttttttttttttttttttgagacagagttttactcttgttgcccagggtggagtgcaatggtgcgatctcggctcactgcaacctctgcctccccagttcaagccattctgcctcagcctcctgagtagctgggattacaggtgcctgccacagtgcctggctaatggttttttttttttttttttttttttaatgggacagagtttcgctcttattgcccaggctggagtgcaatggcgcgatcttggctcagcgcaacctccgcctcccaggttcaagccattctcctgcctcagcctcctgagtagctgggattataggcatgggccactacacacagctaattttttatttttagtagagactgggtttctccacattggtcaggctggtctcaaactcccgacctcaggtgatccgccagcctcagcctcccaaagtgctggaattataggtatgagtcaccgtgcccggccaaggctaatgttttgtatttttattagagatggggtttcaccatgttggtcaggctggtcttgaactcctgacctcaggtgatccacccgccttggtctcccaaagtgctgagattataggcatgagccactgcgcgcagcccaaaggctttattctcaagcaaaccttacatcttgcgagtttcaccttctggagttggcagtggaggggtgaacgctgcctcgggggtagccgttctcttgctgttggcggctctgttttgtcaagtgctggtcttgtcctgtctctgcaatgacgccgtggcacagacgctggtggtacagcttcagtttccgcagtgccccgtgatgacagcgctttttgtgtccgtcctcgttctgtgctcacagctccctggagggtggggcgatcacgtcgtcctggttttatagtgatgagctgcggtgtgggtcacagggctctcctgatcctctgctcttcctgctacccccctccccgtaggggcggtggggggatgttgtctttgtgcacagcttgcagccgaactcagggcagctttcagttgctgctgggctggcccaccgggtgcccaggattcagttgctggtctgtccgagtcagggactttgcaggcaggcatgggggtggggcccgtctgggtcctgactgtgctggagcatgtagaaacccctcctgggcgccccacctgctgtttctgcggcccctgataaacgtgtggtgggcactgcgcgctcaggcgtgctactctcggtcccaagggtgactgggagggcgtcccacagcaagcaagcagctctgaccctgtgtgctggccgggctcgtgttccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccaggtggggtgggggcaggagctccggggagcaccgggaacccagacaggcaggctcggcccactcagaagatggtaccttgggccccatctctgggggtcccgcagagactgccagaaccgtgttctctggtgattcgcagtggcgctcatccaccttccaccggagacaggtctgatttttccagacgtggtgcatcgtttaggccccagacaggaatatgcagtaggtgagccggggctgggccagtgctgtccacagtccgcagagtgacctgcaggccgccttcgtggcctgagtgggccccggcacagttcccagagggatgccagtgtggcttccgcatgactttggaggaccgcattagtcgagtctgttaaccacagctttaaggaggactccacggccacacgggctcatcagcataggggccctggggaggcgaggctagtatccagcagcctcagggctgtgccttttcctggagcctggggcgggtgatgtacaggaggccaggcagcagaagggaggccgggacttcgccgggacttagcagggactgaagtcctctcagagcctgtcgctgggccagagcattgcccccgaccgctggtggcagtggcagaggtcatagcctggggcttctaaaagaggctggacctgggagaggcaagaaaggcttgtagttgtggctactcttggccctcctgcccgagcttccttcttggcccagctgcatgggcacagccaagattccttggggggtggggtacgggcaggaacagcagctgccatcacagccactgtggccccttgagaggatctggggggtgtcctgggccacgtgggtcagggtggcccctggagaggatctgggggtgtctcaacccatgaggcccggagcggcctcagagggctgggggcgtctgtccccatgcggcccagagcggcctgagagggctgagggtgtctccatgcggtgggtgtgtagcgaggcctctggtgccaagtccatgtggggagtggaagtcagcctgtgtcatcgtgcctggtactgcagaccttggacagcccggagctcaggaccatcgtccatgacctgttgaccacggtggaggagctgtgtgaccagaacgagttccacgggtctcaggagagatactttgaactggtggagagatgtgcggaccagaggcctgtgagaccccctcctgggtggggcctttgggctttggctggtggggaggggccgggtgctgggtgaagtgcagctttctgagcctcagaagccaagggccaggtgggcgcctgctttccaggtttctgcactcggcagggaaggctggcaggcacagcacgtgtttggtaacaagctcggggctagcccacccatcagtttcctcccacctgtgtggagcaagcttccatccggctctgtagagtcctgtggctcccaggcggccgcagtcattttgccaggaacactcagcttagggcccaggcttttccatgggtttggacacaagtcttccccgctgccaggagtgcctttgtgtctgggctgtgggctgcaggctgtgaggcggctgggctctgacagcaaaccagcctctcgaccagcagcccagtgtggagaaggagagcgccggaggggcagaggggcaacaccggctcttcttttgacaggagtcctccctcctgaacctgatctcctatagagcgcagtccatccacccggccaaggacggctggattcagaacctgcaggcgctgatggagagattcttcaggtagggggtcctctgtagccttgcctggcacctggagcctggccctgtctctgtctggggcccacccgggctgggtctcaggatgcccgatgagcagggccctcccctctgcctctggagagccctggctctgggtgagcaggtgctagcttgctttccagtccagcaggacaggtcctctcatgacgccactgggctccctcttttcgggggtcgtctggagagatgctccctgggaagcagagctctgtgccctgtgtgcctggccgcgggaggacccagagtcgggctggcctgcgccaggcagacgggctggtgtggggctgtggccgggcactccccacccgccccagcaggctgccgtcccgcaggagcgagtcccgaggcgccgtgcgcatcaaggtgctggacgtgctgtcctttgtgctgctcatcaacaggcagttctatgaggtgcgtgtccaggcggccgcagctgggggctcagggctatttctccgtgggcgggctgtctctgttgtgcacgtgctcccgcagagccgggctctgcctgggacttcggtcctgccggaccctctgcagcccccagcgtggtctgtttacccctgttcattcactggcttgctcgtcctgggtgcctctgccaggccttgacacgtggccaagtagcaaggaaggcacagtgcctgccctcagggagctccggccggttttcacccaacacaggagcctcttaaaaattctgtgtgagttcgtttcagccagtcttgcatggggacattgtcttccgtttcagtcctgacgttcaccctgtgcacctgcgtgatcgccagccctgcctggtctctcctctgcgggctctccctctccactccctcctctgggagctctgtggccccaggcccaccttccttgagagacatttgtgtgcctgccagtcatacccctttcccaggaggcgcagcttaggctctgaggctgtcccttcccaccgaactcctccctgcagcctcgcagtcctgccctcctgagagctgcccactctgctcctctccccagcgtccactgtccttgaattgccctttgctgggcattgcgatcccgcattctgtctgagggagctaagggcctcctggaagttcctctgggtcctctggcttctcccatcagggctggtcttgtcctggtctctgttcctgtggaactttttacctgcttctgtgaaaactcacgctgtcctcagcacagcacgcacacacacgcatattcacgcatgcacaggcacacacgtgcacatgcccacgcgtgcacacagccacacacaccctcacgcacacacgcacagcaccatgtgggaggggttctcggctgtgacagtgaagggcagggcctcacctcggctgctccttgtgagttgtgggccccgtgtctgtgcccggccgccctgcggtgctcaccagccttctgaacgaggagctggacaggatccctggaaggggccccggggtctctgagtcgcgctcagcgggtgcttgtgctctctgcccagctgtgctgaagtcccgagggacatgtccgctgcttgcgggtcggttcctgaggaattggaagtgtcacgagatgtggccctcgttgggctggcgctcattggcctcccttgtgcctgtgcaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgagagccgttgtacccggggccgggtgctagcgtgccagagctccgtgggcagcaatggcctctgggccctctgtcctcctcttcgagtgaccggatggctgtgtccgtaggtgaggctcccctccctgcagggtgggtgtcccgaggcctgtgcagggcctgccactgctggatttgtgtcctgactgaaagtcctggacatgggtgtcctgtcacactctgggacagctgggctgggcctcctggaccgacgctggagcccagacctggggctggggctttggcctgccgtcctccctgcccagccaacagctttgctctttgattttcagatgcattttggtttctgcacagtcactcgggtataaagggcatctttgcttttgagcaataaagatgaaggccgggcacagtggctcacgcctgtaatcccagcattttgggaggctgaggcaggtggattgcttgagttcaggagttcaagaccagcctggccaacatggtgaaatcctgtctctactaaaaatataaaaattagctgcacgtggtggcgggcacctgcaatcccagctgctcaggaggctgaggcaggagaatcgcttgaacctaggaggtgaaggttgcagtgagccaagattctgccactgcactccagcctggacgacagagcaagactctgtctcaaaaagaaaaaaaaaaagggccgggcacggtggctcatgcctgtaatcccagcactttgggaggccaaggcaggcggatcatgaggtcaggagatcaagaccatcctggctaacacggtgaaaccccatctctactaaaaatacaaaaaattagctgggcgtggtggcgggcgcctgtagtcctagctactggggaggctgaggcaggagaatggcgtgaacctgggaggcggagcttgtagtgagctgagattgtgccaccgcactccagcctgggcgacagagcaagactcgatctcaaaaaaaaaaaaaaaaaaaaaaaaggtgtttgtggtagaaagtgttctcacggctgctgactcagaaccatgagcctgtgtgtaagtcctggccttctcttcaaaggtgatggcccgctccctctccccacccccggagctggaagaaagggatgtggccgcatactcggcctccttggaggatgtgaagacagccgtcctggggcttctggtcatccttcaggtgggtgttctgcacgaggcctctgctcccggggcgcgcatggctagcgtccaccagctgcatctgcgttgtgttggagtctgttccccagcgggacccacaccctccctggatttgctgagggtgcggtggtctcagcaggcagcagaaccttcctcctgctcttgtggagggatggatgcaagaggccccgttgtacgccctgaccagagcttgtctctgtgctcctgagtcagggccggaaccatgtaccatcctcagcgtggcgcttgccctcgtcacccagcacagcacctgggaagtaagggtggccctccattcctgccctgcagtccgtttaatatttgcagctgttttgttgagatttaatttacatatcatgcaatttacccattcacagtgaacagttcagtggttttcagtaaattcacagagctctgcagccaaccccacagtcagcttgagaacctcctgagcataccagtagcacacgctcccatcccccgttgctcccgtacccccgggtaccatcaagctgcttcctgtctctgtggatttacctactctcaacatttcatggaagtggaatcacacaaaattcatccataagatgttggatggtagaacagtttcctgtctgctgactggattgttccacccagcgccatgtgtccaggcccgtccaggctgtggcagctgttggtgctcccctccttttcatggctgagtagtattccatcatctggaaggagcacattttgtctgtccgttcctccattggtggacatttggcctgtgtccgccttgcagctgcggtgagtggtgctgctgtgaaccttctcctacgagggctccgccgggcctgcattttcacttttgggtctgcacctaggagtgaattgttgggccctaggtttagtctgcatttggtgtttcaaggcgataccaggctgttttccactggtgctgtgccattttccatccactcgagcagcatgtaagggttctgatttatcttttttttttttttttttttttttgatacagtctcactctgtcgcccaggctggagtggagtgcagtggcgcgatcttggctcactgcaaccttcgcctcttgggttcaggcgattctcctacctcagcctcctgagcatctcgtattacaggcacctgccaacatactcggctaattttttgtattattagtagaaactgggtttcaccatgttggccaggctggtcttgaactcctgacctcaggtgatcctcccgccttggcctcccaaagtgctgggattacaggtgtgagccaccacgcccggcctgcctctacttttcaaagcctcacagcatcacttacgtgtgactgtcagtgtcagtatcgtgtaaaatataatgtatgaatcagtttgctcaaaagctcatccttaagatgttggatggtagaacaatttcctgtcatgtttatatgtcatgggtttttatttcttgccatggaagttgaaagtggtgatgatttttttttttaattaattttttgagacaagatctcactctgtcgcccaggctggggtgcagtgctgtgaccatagctcagtgcagccttgaactcctgtgaccaagtgatcgtcctgcctcggaggcctcccaagtagctgggaccataggcacacgtcaccacacctggctaattttttcattttttgtagagatggggtctttatatgttgcccagcctggcatcaacctcctggcctcaagcagttctcccaccatagcctcccaaagtgctgggattacaggcatgagccaccacacctggccgtggtgtttgattaaaaaccaggcatcagccgggtgtggtggctcatgcccgtaatcccagcactttgggaggctgaggtgggtggatcacctgaggttgggagttcaagaccagcctgaccaacatggagaaaccccgtctctactaaaaatacaaaattagccgggcgtggtggcgcatgcctgtagtcccagctactcgggaggctgaggcaggagaatcacttgaacccatgaggcagagggtacagtaagcccagatcacgccattgcactccagcctaggcaacaagaatgaaacaacgtctcaaaaacaaaacaaagcaaaaacaggcatcacctccttggtgtctcatccacatgagcaccatgctctttactgactggttgggaaggggtgtgctgggctgtgggggcctatggcctgggagaactgagaacctttctgcttctgcagagggaaggaaagaggttctgttgcccttacttggaactccagccctggaggcctgagggtctgggctgcagaactgagatatttcctagttgaggcagagtcctggttctggctgctttcatttctttatttttttgagatagagtctcaccactatgtcacccaggctggagtgcagcggcacgatctcacctcactgcaacctccgcctcccaggttcaagcaattctcttgcctcagcctcctgagtagctgagatgacaggtgcgcaccaccacacctggctaatttttgtatttttagtagtgacatggtttcaccatgttggccaggctggtctcaatctcctgacctcaagtgatccacccaccccagacccccaaagtgttgggattacaggcgtgagccatcgtgcctggcctgttttcatttcttttgttataattgaaaagtaacacagttgactcttgaacagtatggggctgggagtgccagcccctgtgcaggtgaaaatccccatctaacttttaactccccagaaactttaccaacagccctctgttgactagaagccttgctgatagcagacagtctattaatgtacagctcgtgtgttttatgtattctgtgtttttacagtgaagtaagctagagaaaagcaaatgctgttaagatgctaggcatggtgactcacgcctgtaatcctggcagtttgggaggccgaggcgggcagatcatgaggccaggagttcgagaccagcctgaccaacatggtgaaaccccgtctctactaaaaatacaaaaattagctggatgcggtggtgcgcacctgtaatcccagctactcgggaggctgaggtaggagaatcacttgaacctgggaggtggaggttgcagtgacctgagatcgtgccatagcactccagcctgggcgacagagaaagactccgtctcaaaaaaaaaaaaaaaaaaaaatcataaggaagcgaaaatacatttcctgttccttaagtggaagtggctcatcaccaaggtcttcattgttgtcatcctcatgttgaggggactgaggaggaaggagaggagacacatggtcttgctctctcgggtgggagaggcggaagaaaattggcatgtaagtgacccatgaaggccagcctcgtgctgttcgagggtcagagagtttgcacaatggacacggtgacaagtttgattccccttttcctgcctgcctagtgggcccggcagggcggcagctgctgttggttccatgtggccttcccagaatggggggtgccaggcactgtgtgaacccccacctccacctcttttttgtccgaggaagggatgttgcttttatgtcataatattttgagatgaggagaaactgttaatcatttaatcatctttttttttgagatggagtctcgctctgtcgccccagctggagtgcagtggcgcaatcttggttcactgcaacctccgcctcctgggttcaagcgattctcctgcctcagtctcctgagtagctgggatttacaggcatgcaccaccacacctggctaatttttttttttttttgagacagtcttgctctgtcgcccaggctggagtgcagtggcacgatctcggctcactgcaagctctgcctcctgggttcacgccattctcctgcctcagcctcccaagtagctgggactacaggtgcccaccaccacgcccggctaatttttttgtgtttttagtagagacagggtttcaccatgttagccaggatggtcttgatctcctgacctcatgatccacccgcctcggcttcccaaagtgctgggattacaggcgtgagccactgtgcccggcctaattttgtatttttagtagagatgggctttctccatgtaggtcaggctggtcttgaactcctaacttcgtgatccacccacttcagcctcccaaagtgctgggattacaggcgtgagccaccacacctggcctcagtcatttctttcaatgattttttaatcatttaaaggtgttaatcatttctttaaaagaataacagtgtaaccacttacctccagagtgctgcaaagggtccctcaggccagatttcccctggctcctgctggcctcggccccagggttgctggaggcaacagatgctcttcacaccttgccacacgtgtctgggaggtgcccttgaccttttgggaggggctgcctacacctgggatcgccctgcagcacacactccccgccccattctgccctgtctgccacgcagctggagcttctccattgaatggactcttcctcacctgttgatgactgccctgatgatgagatgggcacgaggttgggttttactttttgctgctgtggagagagagtcctggtggtcctgggtttgaaggtcgtgtgttttgaagcacgcactctagagcagccgccccggcccctgctccgggacaagggtgctgtcttaggactgcgttttcacctcctgcgccgtggtgagctgcgtcctctctctgcagaccaagctgtacaccctgcctgcaagccacgccacgcgtgtgtatgagatgctggtcagccacattcagctccactacaagcacagctacaccctgccaatcgcgagcagcatccggctgcaggtatggtggctggggttgcgcagccagttcctgggggcccagccaggtatccccgtctcggcaggtgtggttcctggaagctgcagagacggccccaggatggggcctcagctgaccgtccctcctctgcacccactgtggccgcagcctccccagtcctggtgtccttccctctgcctgcagtccacacatctgtggcttgtcgctctaagccgcacggtgacatgggttggggcagagaaaaggacgcacggcgacttccggggcagtgcatggccctgacgctcctggtgctgcagaatctgtgaaggacctgcagcagagggctgggcaggtgggcggcacagggcagagctgagagggcagagctgagacggcagggcagggctggagagggcagagctgagagggcagggcagggatgggcagaacagggctggaggagtttcgctgagtttgcgctatagatgttggcaccaggctgagcagaggtgactgggatgggagccctccctcctagagcaggtgctctctggggccacccctgtggcctcagagtcctgttcagcctgtcgatggaagaagtggcagggctgggagctgagctccgctttctggcagttgggggcgtgtggtgctgccagaggagcgaggcgcccatcccttccatcccaggcgggcccagctgtggtggtggggacaccaggctctgtgagctccgaggcaagggagggaggaggctgtgggtgctgggcctccggtgtcaccaggacagagcctgtgtctgtgttgggatgtgggtgtgtgcacatcagcaggtggccttttctgagtgcctgtggtgctggacgtgggtctgagcaggtgggacgccgcctgtcctgggcctgcacgagcttggctctggctttcaccatcctcttcctgacaggcctttgacttcctgttgctgctgcgggccgactcactgcaccgcctgggcctgcccaacaaggatggagtcgtgcggttcagcccctactgcgtctgcgactacatgtacgcgggacctcgcccacggcccatgaggctcagggcgtcagaggcgctggggctgtggtggcgctgtttgcatgtctgagggatgtcccagggttgggaagagccaagtctgttccgttcctgctgcggggacttggcctcagctgcttctcttgcttctgcagggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggtgagtggggccgggcagggaccatccgtcccacgttgggccaggaggacagggagctgccacctgcctgctgggcctccctccctgtctggcctgtggagggcagccctccctcagagctgagccttcccccttccccgagcagctgcagggacagaggcctgcgctgggcaggctcccccggctgagaacagggctccatagcccttgacgctgtgcagccacaaagcagagcctcagatgctagcttccgcctctgtctctagggtccagaaggccctgtcctgacgcctcctctcctcgcaggagtctgactggaaggtgctgaagctggttctgggcaggctgcctgagtccctgcgctataaagtgctcatctttacttccccttgcagtgtggaccagctgtgctctgctctctgctccatggtaccatggccggcctggggttggggtgggggacccagtagggtttttccccaaaagactgcgagcctctgggcagagcgagtgagacccttcgggctcgggctccatttccctcaaactcagctgcactctggagcgcagattgtgccttgggcagggtggagggacccctgccccagctcgcagcttttgggactgacgtcagaggtccccagccaagggcatgtcactgaatgtggatgtctcccatctgtgcttttcctaagtggggctcccgtgccgttcacctcacattcctggtgtgttacttggcaggcactcccaccactccgaaagggaggcccttcctgggagggaggcaagaaggctccccagcccctttgccccctttcctgggcctgcgttcccagggcctccccagcccctctggctaccccgtgacctggccgctggggagaggtttcatgcctggatttggtcatcagctttcaggcccaaagacactggagcggctccgaggcgccccagaaggcttctccagaactgacttgcacctggccgtggttccagtgctgacagcattaatctcttaccataactacctggacaaaaccaaacaggtaggaggtcagagcaggacaggcgagcttgatggggcctgggattcgagggcctggcccaggtaggccccacatttttctcataaacgagtttctgccaggccagggatgagtgagttggctctgcttccctgggtggctgccagatgcccagagtggggacatccgattccctggtgcttctagctctctttggggcctgggagccatccagtgttccctgtccaccccggacagcatctctgctctctgtagagcgttgcctggcttgttcctgctgtcccaagggggaggtggccatgccggttggtggagctgggctggttctgaggcgcagggtgggcaggccagagagtctggcttctgcctccctccacgccccatcaggtgccggaaactgtcccttcacctgcgatctgcctcgcccccgtcccagtcgcattcttccacacctctctttgacatggccctccgggacgaggagctggtgtcctagagattctggcctccgctcagggccatgcccgccaggagatgctgactctgaggcttggcccatctgtgccccgggcctcagcttctgatggtggccctgtagggagctgttgttgggttcccatccctcaggctcagccccaccctgttgggccccttcagcccctctgagaggctcactgggtcctcatgggtcttgcctcaaagcatagccagccttgctgggctgcaggttctgaggccttactggcccacagtgtatccgaggggtgaggccggctttgggaaatggaagctgttcccgggacactgcctggcaggccatctggccccgggctctgcctgagctccgctcatcttctgctgtcctcatggaagacactgcccagggttggtgtgggatctggtggcttggccacttcaggcagcactgccccttgcaacagagccagcctgtgaagggcccagaaccaggggatgagagcccagcatgtctgggttctgttggcctgtgggatcgtgtcggaatgcaactgaccggagcagtctgctgtgcagagtctgctcgggtagctcagcactgctggctctgccccacaggcattcagggacttgctaagcctcggctgttctcccggtggagcactcgaggttggcgaggggtaggcgaggctgcctctgctgcaagcgggtggggcctgaggtgtcctgtctcctgcagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccagtgagtccccgccctgcctgcgcatgcacccgagaggttcgggctgtgtaacctgtgcgggcttctctggtgccctctctcaggactccttggggaacctgggtgtctcgccttctgctgcctcagggcctgggcgtctctgcccggctgccatgagtgctctccttcctggctttgaggggcggctcctctcacccctctagtgtccatgtgaacgctcctccttgaagaagcctcttcccccccgagcagtggccctcccctggttttgggcctcctctctgtccaacagagcacacgccgcttcaggggggctttgttcgcttcccccagactgtgacttcaggagctcaggtgcctgtcccttcccctcaccgcctgtgcgcatctgggcaggccctcaatgttgagatggcagaagggcactgctgggcccgcacttggtgtagaggctggagagaagatcgtgtgtgctttgtgggccacatgcaggtcctgtcggtctttctgttttgttgataaccctttagaagtgtagaagcctggccaggcgcggtggctcaggcctgtcatcccagcactgtgggaggccgaggcgggtggatcacctgaggtcaggagttcgagaccagcctggccaacctggcgaaaccctgtctctactaagaatacaaaaattagccgggtgtggtggcgggtgcctgtagtcccagctactcaggaggctaaggcaggaggcaggagaatctcatgaacccaggaggtggagcttctagtgagctgagatcacgccaccgcactccagcctgggcaacagagcgagacaccgtctcaaaaaaaaaaaagagagaagtgaggccgggcacggtggctcacgcctgtaatcccagcactttcggaggccgaggcaggcggatcatgaggtcaggagatcgagaccatctggcgaacacggtgaaaccccgtctctaataaaaatacaaaaaaactagccaggcgtggtggcgggcgcctgtagtcccagctacttgggaggctgaggcaggagaatggcgtgaacccagggggtggagcttgcagtgagccgggatcgcgccactgcactccagcctgggcgacagagccagactcatctcaaaaaaaaaaaaaaaaaaaaaaaaagaggtgcggaagcctttcctcacggatcacacaaatggtaggcgacagctcgaattggcccagaagctgtggttggctggccatgggaccgagagttgaggccagggtcgggaaagccacgtccgtgtggccgtggccttctctcctctgcagcaccccatcgctgccgtgggcagagcagccgtgttggccttcagaggcgctgcacgggaccccggctcccctgaccaccctctccattaccgcagctctggccaggctgccgcacctctacaggaactttgccgcggagcagtatgccagtgtgttcgccatctccctgccgtacaccaacccctccaagtgagtggtcgccccaggccctgtgcctcccagccgtggcccccgctaggccttgcggcagaaagccccggcagcctttgtccccaaggcctgagcgcctcggttttttgcacttcatgccctggggatgtttccctgctgccaggatggagtgccagcccccttctcatctcaggtttaatcagtacatcgtgtgtctggcccatcacgtcatagccatgtggttcatcaggtgccgcctgcccttccggaaggattttgtccctttcatcactaaggtgggctcagggccggtgaaggctgtgtctctcggtaggccagggcttgctttgcccttggctgtccatggtcgggcagagtgacaggcaggtggagggcagtgggagggtgtttggggctgtgcctgtggcgctgggggctctgctgggcagcctgcagggctttgatgcgcggcaggcattgaggggtgggagctgggtgccgccgccttgcccctagcctgcagcttgtccctggccagggggcacccggcaggcctggtgagggcctccagcccccattgccacccctcactgtctgggtgtgctcactctgccagggcctgcggtccaatgtcctcttgtcttttgatgacacccccgagaaggacagcttcagggcccggagtactagtctcaacgagagacccaagaggtacggcctgcgggggtgtgcctggagtcggtgtggggtggggaaggacatggggctgtggcctgcctgacggtgcctccaagtcagtgagtggaaatgggtcctgtgtgccctggagtatgtgaggcagggcaggacctgcaagggccgctaacacccctcagcccctcagcaggttggccgtggtggcctgggtccgggctgcgtgtgccacgggcacctacttgtggaattgggggttggggtgcaagctttaggcgcctgagcccctcgaaggagccggccttgtctggggctgccccctcctctgcagcccccagcctgctgctagccggggactctgcttcatcaccgccgccttgccggaccgcaaagagctgagccagcctctgtgttcttgtttgcatttcatttgaacggctttctcctcctgtcccccaccttcctgcccgagctattttggctttccctagatgggaatacggcattttccagcgtgacctcaactcggaagctgttgtctccagcccctgggggccgggggccaagctcggccattacggccagagactactttctggggtcttggtctcttttcctagtgaccttcagggcctggccactgaggcctcagtgccgcctcggtcagagctgggcggtgcctgccttccgcgggtgggtgggattgcctggccagcacagcctggaatctgccgtgggggtgacccacacacgtttaatttgcactgacgttgtttgttttggtgtcatgcgtgaagccttacttgttctcagtcatgtttaccagacgtattatcatgcatttttgttttctgtctcttccccgctaactgccctttggcatggctctttttgctcatctcacccgcgggatctctccatcctgaccctgtggcctgggacctttcctcctcacccctccactggcttgttctccccttcccgggagctgggctctctggggcgttggggctccttcctcacccgatagtctgaggatagccagaccccccaaacaaggcttgaataactctccacccgtgaaagaattcaaggagagctctgcagccgaggccttccggtgccgcagcatcagtgtgtctgaacatgtggtccgcaggtagcgggactgtcgggtggggggcacggaccctggagcttggccccgtgagcacctgggtggcagtgcatggggctgcttgcatgacctcatcgtctgcccgtgtcctccctggccagcccagggggagccggtgacgaggggtggaaaggttgcattctgtccccaggccccgtatgagcacgggctggttgcacgcatccccaggccccctcggggtgccgctccgagagagccaggcgtgccgggcagcagcctccccaggctgtccccaagggccgcagtgtgggttgggggagacaccactcctggttttggccttttcgtattctctagaatggacgtttttcttcgggctttcttctcaacaaggtttattttttgttgtagctgaaagggaacaaggggcatttgtggagggtgctggggtggggcagcctgggagggcctgggtgggggctaggatcctgcagggcatgggcatgggcctgggccccaggccatggtcttagttctccccgcagtgtctgggtgcaggtgtgggctctcgggctctcggctgtcacctgcctgtgggtcatcgctgctggcactggcagaggggatacctgtctcctcctggaagcccgttgcaggccaaggggtcccatggccctcagtccatccacctcctcacctcaggccggcctctgctgggtgggacttggccaggggttggggtggtagaggtgctcggtgaggcttaaagccattttctagcacattctgtatcatgagcaaaatattgcctaggggctatgaaatttgtatcagaatgaactcccataagcctcttccctgtcactgggtgtggagctcaggcagccgctcgcctgcctgagggtgacggtggaaggccacatggggatcccagacctctgtgtgcttgccggaggcagcctgcgggcagaatgcaatctgggcctgtctgtgtggcctccgcctctctgcatgactacaccgtttcgccaggaggccgtaacctagtgctcccgtgggcttcggtgagggggatgtcggtctctagcctcctgagtctgctccgaccagtaggcctggtcttccccacccagcgtctccccgttctctgggacaatgtggtccacgtgattctcaagctgaggctcgctgggccgcccacgccctgttggggtctttccgagcgaggtcctcagccgtgcatgcgttgagctttggcccttggtgataggtggctcggcccgccctacctggcaccctgaccctggtcacggcctctccctccagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtccaggcggcactacagggctgggcgggcctgcgggagctccacgggcaagctgggtttcacgctccctgtcttctaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgaggtgactgcaccttcctttcctccgcgcctgccagcctcgacaccggctgtcccgagcccaggcccacgtggcaccctcgtaccagcctggggactaagtccaccctgtgcgtgggattctcttctcagctccagccccggggtgcatgtgagacagaccaaggaggcgccggccaagctggagtcccaggctgggcagcaggtgtcccgtggggcccgggatcgggtccgttccatgtcgggtgagccttggccccagccacctccacacaggcaccggggctccctcagttgctgctggtcccagtgttcaggaaggccccgagcccaggggccggggtggctggcttcaggcccggcccacgtcctgactctggggtgagccttccacagctcaccccagagccgtggagtggtggagtgtggcccgcttgctgcagaggggcctgctctgggtgctggtgtttcctgcgggttttcagctcggctcagtcctggagcccttctctgctccagcgagccgtggtctgactgcaggacaggttctgggtccctccctgtggccctgggttcactgaggccagcactgtggtgggccgtgccccaagggcagagctgccaccgtctctggctgcctgtggcactagcttgccaggctcggggggagcattcagcttgaggctggtggttttgcatcaggtaagtggtggtcaccagtcctctgccctcttcttcagggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacaggtactgggcggggctggcctgagcgccatctttctgccagtcacccacagagctgtggacactcaggggcgattgcagacttggccctcttgggatatttgggggtaacttttgttttttttttgagacagagtcttgctctgtggcccacgctggaacgcagtggcgcaatctcggctcactgcaagctccacctcccgggttcacgccattctcctgcctcagcctcccgagtagctgggaccacaggcgcccgccaccacgcctggccaatttttttgtatttctagtagagatggggtttcactgtgttagccaggatggtctcaatctcctgacctcgtgatccgcccgccttggcctcccaaagtgctgggattacaggcgtgagccaccgcgcccagccatttgggggtaacttgtaagtctccagaggtgagctgtgaggggcgatccaggtggctgaggtggggcaggggcctgtggcgaaccaagtgacttccatggcagagagttgccctccccgcctggaggctgcaagtccgagaccaaggtgctcctcggcaggaggtgctcctcagaggcctcaatccttggcatgcagttggttttttccctgtgtcctcacaggctctttcctggatgtctgcgtgttaatctcctcttgggaggaaaccggtcatggcttagggtccgctctggtcccttgctagccgtaattagctttctgaaacccagtctccagagacagtcccgttctgagttcctggggttgggactaaagcataccaacatgggggcacagctcagcctgttcccaggggcagagggagcccccgcagaggcccagagcccagggacagagggaggcctttgcagaggcccagagcccaggggcgcctgggtgtgccgtggctgaggggtgcaaagagtaggggttccagccctcgtggaggccttgggtccggactgtgaggctgtgggctggaggccgctgctctgaggtgcctggcggagcctggcctcgaggcaggggctgagcggggcagcagggtgggtggccgtcagagcagcgctggctccgacatcgtggtcctgaggattgtgggagggagcatgagggcaaaaccagggcccaggccaggaggcccctggggggccagagatgggtaaggggaggtactggcctcaggccaaaggtgctgccgcctccgcagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacaggtgagtggcatggcgggccttggcacgggctctgctcccactggcctggtgctcccggtgacggcaatgtggctcctctctgctgagggcgcccacacggctgggagtggtccctggcctgcctcagcaccattgttctccggtgtttgggaggaggctgacccgtgggaggtgtctgccctgctcaggaagctggggctggcagcttcagaagcagtaggggccctgtggagcctctgcccagcatcctccgtggggagtccagcactgcgggctccaggaggctctgcggcagcctccctccctgcctgggcccaggtttggacacctgagcccgcctgcgcactctgggcccccaccccactcggcaccgtgcttctcgccaggccctctggctcttccctgtggctgcagatggcacttagcggcctaggacgtctattcacgggaggagggaggcactgccctcctcaggtctgcccaagcagcttgtagctagcactgggccccgtgcgcgcccctgccggccgctggccctgccctctctcctctgcaggcacggggcctgtgctctctgctcgacctgtgtgtagcccctcctcctgctgacgtggccgcacacggccttcccttgcagtggcctctttctcctccctgtaccagtccagctgccaaggacagctgcacaggagcgtttcctgggcaggtatcgcctctcagagggaagcggttggctgcagagcgccactctgcctcataggtgctgtgctcgtcgcctcatccgcccacccccatggtccgtctgcctccattgccctggggagcaggtcccgactcgcatgaggacgtctgtgcagaatgtctttggcttggccagcgggatccccttgacttggtccctttgtggctgagccctgttcccacgctgtgcgagcactcccggcccagcttcaggcctgaggggtgggggtggcctgagtctccatggtgacatcagctgagctgcagactctgatgggtggcagctgtttagggggaagcccacccctgggcctgcaccgagcgggccttgccctggcctttggtggctcccctggcctctggaacccacagatggggctgcctcaagtcccaggttgaccaggggccctgcagaccgacctctgcctgttgcccccaagccctggtggggagtgctgtgacctgcatggtgctcccctgccaggtctccacgtgcagacgagctggtttggaagggctgcgtgggacgggccctggggtggctgactgcgcgtgtgcagggctgtggggcgcccgggggctgtgatggtcccctctgttgctgcttctacttcctctccccctgtcctgacgctggcacaggaaatgctgctttgggacctcccaccctctctccttagcgtccccagctgtgggtctggcttggagttggagggtgagcctctgctcttgggagcagtctgtttgcaaacagggacttcccccacgtcacggagtctccgcagctctcctcggttacgagggctggtttcaggctcccgctcttttagagctgaggcccgtcgggcggagagcgtcttgcccctgcctacctggaggcacaggggtggctgctggtggacactagggtgggcagagccgattgcctgcccaacccccgggcactcatgcaggagaggcctgtgtcggggtcacgtgcaggccttcccagcgtcctccctgcccgctcggtggatggcagcagtaagcagagccctggggaggctcgcagggctgctgtccctctggtcaggagaaggctggttctcggaggccacgtcagggccagggcctggcccagccccacatccagcagccccgtctgtgtcctcccagactccgccgtggtcatggaggagggaagtccgggcgaggttcctgtgctggtggagcccccagggttggaggacgttgaggcagcgctaggcatggacaggcgcacggatgcctacagcagggtgagtgtggctcagagcctggaccctgctgacctcggggggctccttaggggaggcagggctctgcgtgggtgtgcctgcaccctgggaactggctctgaacttgggggagatgttcttccacatccctcgtgcacagacggtctgcactttgcagccatccacctgggccggccctggctgctgggcagcctgtggtctcaggggatgctgatacctctgctcacgcagtgtggggcacagctggtggcagtgctgctgcgtcaacgggcgggggccgtagcctggtgctcgggctggtctgtggccctgggatggaggacagatagggcctcaccacctccaggtcaaccccaggtgggctcgagggtgcctgctgacaggggttctctttgggatggtcctttctagtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccaggtgggcctcttgcttccgggcggggctcctgacacctctcctgcgggaacctggtgcctcacttgccccaggccgagcgggctggggtggggtcctcgcctgtgccctagggctggctggaacccctgggagggcggtggagtgggagatggccaggctctgtgttcctccctgtgggctgtggctgccctggccaggccctcacctgggtgcccaccatcccctccctgtgcagtttcgtgttcctgcagctctaccattcccccttctttggcgacgagtcaaacaagccaatcctgctgcccaatgaggtaggcgtggcctccctctcctgcatccgctggagctgtgtggctcgggtgaatggtggggggcccagctctgctgctgggagctcaggcttgcagagggctctggcctaagctccctgtggcagcctgccgtgaccggcctgggtggggcggcctcctgtggacgggcgtctggggctcaggcagggctctgtgtgccacagtcacagtcctttgagcggtcggtgcagctcctcgaccagatcccatcatacgacacccacaagatcgccgtcctgtatgttggagaaggccaggtgaggctgcggggccggcctaggtgcctggacagggccagctgggcctcagcctgcagtgggtagggagtctgggcccccaacgccccacagagctcaacactgccgggtcccctacagcatgaagtgctcattgagctctgtgccaggtgctgctctgagtgctggggaccccggtgcgagtgacaggttagcgtgggagcacccggcacaccaaggagtgggaaggactgggcgggtggcaccggtcgcagggctggggagggcgctgttggtcagtgagctgacagctgagtggtgagggagcgggcagggggagcctgcataaggggtgggggcatcccacacaccagcagcgggggccgggcgcaccctgcccagcttgagcactggtgctgggcgagcacgggagccgacaggatgggcagcctcagcgccctataggctgcaccttcatcccaagggaaagggcagggcctgggctgcttctgagcagagggcacatggcctgactccgcccagtctcagtgagtccctcctgctgtgtggctcgaggaggtgggtggtgatggttcccgtgggagtggggtaggcccctgggggcaggctgctgaggggccagggccccgggtgtgctttgagtgtggagctccctgattttgccggccaggcacacacggggctgagggaagagagggagtcaaggatgacacccgatgtctggcctgggtggctgctggaatggatggtcttgtctgcctcagggatcagagtggggctcccggcagagcctgctgggcacccccaccctctgcggggcagggcccggcccgggagtgatgccaccctgcctctcccctctccccacagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaaggtacggcctggcgcctacccgctcctgctgccccaggcctcagggcacggctcccatccagtcctgctaccccacgccctggggcatggccctggcacccccacctgctccagctccccacgcctcaggttccgagcctaacagcgtgggcatggaggcagtgatggggctggtggctttgcgtcccaaagccctgcccctggggagagccgaggaccactggccaggcaccagaggacgtggtccccgcaggcccccagagcccctggagtaatcaggaggtgccccagtgcaaggcacagagggcctcagcactggccccacaaacccatccggccctgctcaccctcagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaaggtgagtgaggggccgtcagtgaggctgggccccaggcaggtgcccactgctgtgtcccgggttggtggcaggtcctcctccctgagcttcggtcacgaggagcaggaggagaggccgcagtgctcagggccccgtgggcacgagcttcaccccgagcctgcgttgtgtcctctgtgccctgaagcctgtggcgcctgctgctgagtgtctgtcaggagtaactggcaagtgcagactgggtgtgctgggtgggcacagtgtagttggtgcttcctgtctgtccggcgcggcccttgggcccccaccatctccccagtggcagctgtcaggctgctcagttggttatcgccacgcaccactaggcagcaaccagcgtcaccctcttcctggaggtgggctgggtcggccagtgtcacagcacggtccgggtgagccccagcatggcggggagagctggcatggcccaggcagggcagataggctggaggcctcactccaagggccccaggatgctgaggcagccactgaaccaaaaccccggggctggtagtcagagtccaggaggggcaggagcatagggaggtgggctctgctagatgccaagacaaccagttgggggggggggggcacctgggcggctgaggagggtgtggtggtgccgagatggggtgcacggctcacttcatggctgggcagacggattcggacgtgtggctgcagacaccctgggggccccagtgagtggaggtgccccagcaattagaggtgtcttgcctgtggctgcagcatatgtgggtgctgcgcccagatgtggagggggcttggcctgggggaggccagacaaacacagccccgctgccagaggggaaagttcaggggcagatgctgcccatggagctgacaggtgtctagcagtgcaaccaggcagtagccgagatcagccttcagcacacgctgtgtgcggggatgaccctttctcttgtccgggcagggccagttcaactttgtccacgtgatcgtcaccccgctggactacgagtgcaacctggtgtccctgcagtgcaggaaaggtagggccgggtggggccctgcagtgcaggaaaggtagggccgggtggggccctgcagtgtggcgccaagagccctgggcctggcgtgaccaccaagtctccccagacatggagggccttgtggacaccagcgtggccaagatcgtgtctgaccgcaacctgcccttcgtggcccgccagatggccctgcacgcaaatgtgagtgggggtgggtccaggcgtgagctggtgggacaggcccaggtgccacctgatagtgagctcaccccctgcctacgtccccagatggcctcacaggtgcatcatagccgctccaaccccaccgatatctacccctccaagtggattgcccggctccgccacatcaagcggctccgccagcgggtagggaatatggggctccctcagcggggtgtgctggctgcccaagctgtggggcgggtgtgtgggcagagcggttgccacgcctcccagacttactgcccaagccgcctctgccttcagatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcagtcagaca

SEQ ID NO: 441 - RNA, 40826 nt, Homo sapiens
uuuccgccagagggcggcacagaacuacaacucccagcaagcucccaaggcggcccuccgcgcaaugccgcuaccggaagugcgggucgcgcuuccggcggcgucccggggccaggggggugcgccuuucuccgcgucggggcggcccggagcgcgguggcgcggcgcgggguaaguggcgguccccacggggcaaguggcgguccccacggggcagcggccuagagaggcggaccccgcaguguccgggucccgggcccucacccgcgcccacugcaacccgacuccggagcuccgagcaucccuuaguuuuaagucauggcgggugcgaacgggucucugcugcaggcggcuccgugacagcuccugcuucacauggguagaggagagacggcaaacgucggggcucccaggacuucgcggcggcaguccuaacccgugcacugagucgggcggggcgggcggcagcgucugaguagagagcucucuagaccaggccuggugucucccgggcuuuccuaggugccuguuugcgagcuggucagcugggcuguaguugaguucucccagggagugugggaggaaagguuaugcccaccagagacccaggguccugacggcuggagguccgcaguggggaaggugggcagagguguugcucagauguccccauuccuguuucguuugcacagagggguuuucuggugcguccugguccaccauggccaaaccaacaagcaaagauucaggcuugaaggagaaguuuaagauucuguugggacugggaacaccgaggccaaaucccaggucugcagaggguaaacagacggaguuuaucaucaccgcggaaauacugagagugagugagcuaccugugucuuugcuaggcuagagggaaaugcagagaaggcuggguuuggucuugcaccagguucugugggagacggguugcuggcaacugucuacacaggaaugcugucuccaguacuuggaggccgacauguccuuccucaggagacuucgaaagucaggaucuuggugaccugguucaggcacacuugaguuacuauucagauguugaugaaagaaagcccaucuuauagaugaggccugaguaucaucaucuucacagguaaggauauguccagguguuacaugauaagaugugaguuccugggagaaguagguucuuuauuuuauuuuuuuuuugagacugagucuugcucuguugccuaggcuggagugcaguggcacaaucucugcucgcugcuaccucugccucccaguuucaagugguucuccugccucagccuccugaguagcugggacuacagacacgugccaccacacccauuuaauuuuuguauuuuuaguagagauggaguuucacuaucuuggccaggcuggucuugaacugcugaccucaggugaucugcccgcuuuggccucccaaagugcugggauuacaggcaugagccaucgcacaugggcuaggucguuaucuuuuauguguguuugugucuuugucacacaugccuggcauuguguuuugcccaugaguaaaugcugaauuuuugcacuuguaaaguuuucuacuuagaaacaacuaaaacguucaucaacugaugaauaaaauauaguccauccuggcugggugcgguggcucacgccugucaucccagcacuuugggaggccgaggcggguggaucaccugaggucaggaguuugagaccagccuggccaacauggcgaaaccccgucucuacuaaaaauaccaaaaauuagccggucauaguggugggcgccuguaauuccagcuacucggggggcugagacgagaauugcuugaacccgggaggcggagguuucagugagccgugaucgcgccacugcacuccauccuggggaagaagagcaaaacuccgucuaaaaaaaaauugugcaguuugaaauuguauuucauguuauguuuuaucucaauacaacauuugcaguugugaaaaaaaauugcacauucucaacuccucgggauggagcaguaaagccccucaguaaaucuuuuuuuuuuuuuuuuuuugagaccgaguuucgcucuugucacccaggcuggagcgcaggggcgcgaucucggcucacugcaaucuccgccuccuggguucaagggauucuccugccucacucucccgaguagcugggauuauagacgcccaccaccacgcccagcaaauuuuuuguauuuuuaguagagacaggguuucaucauguugggcaggcuggucucaaacuccugaccucuggugauccaccugccuuggccccccaaagugcagggauuacaggccugagccaccgcggcucgucaagugaaucuugauuccagaaagaucuguuuuaagucucuagucuggaaaaugcagugggagucuuuaggugguuugugacuugcaguuaaggagaccguggccugagcacuggccccuuuuucuucuuucaucucucuccaggaacugagcauggaauguggccucaacaaucgcauccggaugauagggcagauuugugaagucgcaaaaaccaagaaauuugaagagguagguuuauccaguugagcuacuagagagaggcacguagacuauucagagccugaguuugcuuuuuuuaggaacaugguugacagcugacugccgaugaucugguuugcacuuuuuuuuuuuuuuuuuuuuugagauggagucuugcucugucgcccaggcuggcacaaucuuggcucacugcagccucugccuccuggguucaagcaguucuccugccucagccuccugaguagcugggauuacaggcacgcgccaccacacccggcuuuuuguauuuuuaguagagacgggguuucgccauguuggccaggcuggucuugaacuccugaccucgugaaccauaugccucagccucccaaagugcugggauuacaggcgugagccacugcgcccagccaguuugcacuguuuuaggggaauuuagcuuucaucguagugauggggaagcuacuggaaaugccccgaauacaaccuugagggaccaaucaagcguggaaauggggagcaaagggauuaggcuuuucuagcaacaccagaaaggauuucuaugccgagcgggggugcgggggcuuaugccuguaauccuaggacuuugggaggccgagguggguggaucacgaggucaggaguucaagaccacucuggccaacauggcgaaaccccgucuguacuaaaagaugaugagccgggcaugguggcacaugccuguaaucccagcuacuugggaggcugaggcaggagaaucgcuugaacccgggaggcacagguugcagugagccgagaucgccccacugcacuccagucugggugacggagcaagacucugucucaaaaaaaaaaaaaaggaagaguuuguaguggcugauagaaacgcaugcucacucgcucucuccuguuacaaguucaggccaagaaaaaucaagaaaggguuuguuccacagagaacaauccuaggcacgcuggucuuggugccauuuugggagggugacuggucggugguauugggcgaccucacggacauagaaauauuuauuuugggcaaacauugccagacuuuccugaugacuuguggacaggacaggaaguggucauuuugggagugcagguugcugguagagcaccugagggcucugcccuugccuugcccagcauuugugugugggagagcagugagaccuggaccucucaugcucagaucugcuaagaggagagugauugcuaccucugcagcagcucaucugaaacgugcuggccguacgcuaccaaagauagguguaaagaacagguguccuuagccgggcgcagugguucacgccuguaaucccagcacuuugggaggccaagguggauggaucaccugaggugaggaguucgagacccgccuggccaauguggcaaaacccuguuucuacuaaagauacaaaaauuagcugggcauggugucgggcaccuguaaucccagcuacuugggaggcugagggaggagaaucgcuuaaacucaggaggcagagguuguggugagcugagauugugccauugcacugcagccugggcaacagagcaagacugucucagaaaacaaaaaaaagaacaagcguccugcauccuguucugaaaguuguuuguguggguacggggcagccugugaguggauaaauaggccuccgaggcugggauggucccgggcccuguguccacggaucuuugcagcucagguugcaacgguaagaguauugucaaugagacaaaggaggugagagugccaguugucugaauugguugggauguuggucagaugacaucuaaaagaacacggccauuuuguuauuauuugguuagagacaaggucucacucugucacccaggccggggugcagugucacaaucauggcucacuacagccucaaccugccaggcucacgugauccuccuacuuuagccucucaaguagcugggacuacaggcaugcagcaccacgccuggcuaaguuuuguauuuuuugucgugacagggucucacuguguugcccaggcuagucugaaacuccugggcugacgugacccucuccccucugccacccgaagugcugagauuacaggugugagccaccgcacuuggccagaacacggccauuuuaguuccccuccuuagaggaguaaggccaggaaugagccuguggucugaaagccguggcuguugguuaauguggagaagggaagguggugagagccagcccaaaccccugccgagugagacugauucuggcagcuuuagggagcagggaugagccccucacaggcugggugguaguuagaggaggcagauuucagaaggccacgcagcgcucuuucucagcaggucaggcaggcagcagaggucgggcaggggcauggggucgagggcccgaugcugguguguucacuagaggagagccacaagcagggauucugggucaggugcaggccuagggcuuagugugcacuugugguucugagacugucccaugacuuccugccagcauuccggcagcucuagugggacucccuccugguccaggugaggccaccauugcugcccuggcuugcugcuguccucucagcccccagucugucaccuggugggaguuaaagggaccugcugggguuugaggaagcucugagccguucccuguacgaagccuguggucaucucaggcugcaggagacacaggagauacgagcuuuggagguggggcucucagucacaagcccccguuguuccucccuguccuccgcucacggcacugcuccaguugccggggccaggguucuuggagagcacauccucaccgcuguccccucugcuggugacagcacgcaguggaagcacucuggaaggcggucgcggaucuguugcagccggagcggccgcuggaggcccggcacgcggugcuggcucugcugaaggccaucgugcaggggcagguaaggcccagggcgacgcugggaugggugacgucaggcugcccacugacuguccugucccugcugggccguguuuggacuccugccucggugaguugcugggcacagggucuaggggcugaugggcucuggagcuggauggccuguggggucuccuggugucaugaggucugugugaccguaggcacugccuccucgccuguaaacagauggucacugcaccuuccucuuaugggauguucuggggaucauaugaggcaguucucgcagagugcugagaucguaccuggcagcugguguggggcuacgguguuguuuugcccuugcacccuuucggggccacuccccugcucacugcauuccaucugugcuggucuuggcugacccugaacacccaggccucuugguguuccugccuccccuggucggccacuucuacuccuucaugucccagcugcucagaagggccguccacucucacaggcucuccuggguuucccccacucaggccuuguccucagucucugagcacaaggcugucugcccugcaccgagugcaggggucgggcaggagcugugucauccccugcucugcgccacccgcugugccaggucccgacacacagcaguugcuccccauacgccgcucugcggucggccggugcauccggcccccugcccuguacaaugcugaugcugcagaccugucucuugcagggcgccucugugggaaggagagggguccagggcuggaguccgggugccccugcacuucagggacuucuuggcagccgugugggcgacgcuggcaggcucugcugauccuguggcuuuugucuuuagggcgagcguuuggggguccucagagcccucuucuuuaaggucaucaaggauuacccuuccaacgaagaccuucacgaaaggcuggagguuuucaaggcccucacagacaaugggagacacaucaccuacuuggaggaagagcugggugggugccaccuuggguuggagguuucucuggccuugacgaucaaguguaaccuggaugggaaggaccuggggcuggggaggggcugccguucucagggauggccugcagcggguaugcccacccugcuucaugcaccugggcucaccugcguggccggagugccccugaggcacguguuaaaaaugcagaguccuggccuucaccccagaccugcugacugugagucucuggggcuuggggccuccgaacaccucugcaacggcaggagcugggcgaguucugucacugggagguggugcugcugacuuggucucaaccggagcguacuggucccgucuuccuccuccuuucuccacuuuguggaccuuccuccugccauccuguggugggagguuuccauuagucuugggucucugugucaugauucugggaaguagagaaagaggaggaagagaucggucugacucuggcuuugcuguucugucgcccagaaaagggccucaguggcugggcugccugcaggacaggugccggccaggugccuaccgucagguuuccugucugaggugacguggccggcagccaagugugcacacgucuccuccgagccacucucugcuggggguggggaacgcccaggagucuggugaugucggcgucucccagccucggguugggcccugaguguacggcauacacacuucugcugccgccucggcacagacccucugugcagccccaggggcgguagauccuaguguccgugcguagccggccugcccugggcuccccugagccucuucgggcccagugcguggucugucuguugcugccgggggacugaugaugggguuucuggcagugacggguuuggacacacuguccugcggcgggagggggaggugagugggagauguagauucggcguccucgcaaacugccgccgcuucucccccagcugacuuuguccugcaguggauggauguuggcuuguccucggaauuccuucuggugcuggugaacuuggucaaauucaauagcuguuaccucgacgaguacaucgcaaggaugguucaguaagaaaagaauugagauccuguucugauaaugguccuaaguucagcuccgcagugaauaaaguugaaaccaccaaaaaaauagagguugggcugggcacaauggcucacgccuguaaucucagcacuuugggaggccgaggcaggcggaucacgaggucaggaguucgagaccagccuggccaacauggugaaacccugucucuacuaaaaauacaaaaauuagccgggcaugguggugggagccuguaaucccagcuacucaggaggcugaggcaggagaauugcuugaaaccggaaggcagagguugcagugagcggagaucgugccacugcacuccagccugggugaaagagcaaaacuccaucucaaaaaaaaaaaaaaaaaaagagaaguacguagcuaucuucuguuuagcucucaucugaugucuugguuaucuuuuuguuguuuguuuagaauguugcaugagcucugucucacucaugcugaacacccagcaccgagagcaguggcuggcgcacagcaggcaccugagugcuuguugggugggugggacccccagggaggaugagccaugcguguuauugacgucauagagugacuagaccacagcccgugguggcucggccauccaggcagugcugccgggacugagcucggugcucccugcaggaugaucugucugcugugcguccggaccgcguccucuguggacauagaggucagugccuccccuccccagggccggcccauuucacccugguuucugggaggcuggggcuuggggguugagcccugugugccaccugcuggcuguguagcccugggcaagcugcucggucucucugagccucaggagucccccauguaagucaggauagccgggcgccuccauguggagauguagcucaggguggaugacagcaucaaugacccacagugacagggacgucaggugcuucccacaugcccgcuugcccuguggcuuggagagagggugccauggcagcggggagagguggcagcgcaggcugaaggaggugggaaggaagccuggguguccucuccuguggggaggagcugggguaggacgggcgugagccgucucccucuccaccaggucucccugcaggugcuggacgccguggucugcuacaacugccugccggcugagagccucccgcuguucaucguuacccucugucgcaccaucaacgucaaggagcucugcgagccuugcuggaaggugggguuucugaaacugcucuggaagguuccugagagcacauggaugggacaagggccauccugucucccaugaaugguugucugauucuugggguggccagacaauggccuguugagggacggccagugucauuuucccaggcaguugagcugaggucaggguuuugguggcauuuugagaacccugcugccucugucuuugggaggagaugguggcgagcuggccggaccuuggguggcuauagggcagcagccaggcggggccagcagcgggacuggggcugggggcagggcuuaugccugccagccccugacacgcauugugucucgcagcugaugcggaaccuccuuggcacccaccugggccacagcgccaucuacaacaugugccaccucauggaggacaggugagugugguggguggggcgcagggcaguggaggccagcacagcccucggggcagcuccagugucccuugccaagcacacacuggcuuagagaguccuuguccucucgggcagcuguuccagaggcugccacuagagcgaggcccaugacuucuaggauccagccccuguccucuccuuccucugucaguucaacagaauauccacacccagcucagugccugccccaugcucggacguccuccagcggugcuccccaacuacuuagccuguuacaaggcgaggcucggggucuuggcuugacguugcccuugcccucacccccacagccaggcuguggccacuuuuguugcuuuagccauuagagauggcucagcucugcccacacccuggccucccacccaugcugccagcucccccuccugcucuccuguauccauccgcgccuccugaagcccacuccaugcagcacccggguggccuuuuucugacacagauaugucggugucacccuuugcuggaagccaggugguucccagcgcccuugggauguaggcuucuccuauggaaccaggcccuggggccagcccugccucagcccugcaucucucccagcccugccucggccccugcaucucucccagcccugccucggccccugcaucucucccagcccugccucggccccugcaucucucccagcccugccucggccccugcaucucucccagcccugccucggccccugcaucucucccagcccugccucggccccugcaucucucccagcccugccucggccccugcaucucucccagcccugccucggccccugcaucucucccagcccugccucggcccugcaucuuuccuucccuccauccuuggaaccaggcccuggggcccagcccugccucagcccugcaucucuccuagcccugccucagccccugcaucucucccucccuccucccguagaaccaggcccugggggccagcccugccucagccugcaucucucccagcccugccccacccccugcaucucuccuuuccuccaucuugccuucuccccuccaccaagggcuugugcaugcccugauuccucuugccagcagguucuuccaccuuugccgaguuacucuguuuacugaggucuuagcguggucacugacucccccaccucccugaguaguuuuugcuguggcuuuccuucuuggcugugauuggaggaagagauuuugcguuuaccugggagauuauguggcuggcgccugucucccccagacugcgaggcugugggccaucccucuugccugcuuccugucccuggcaugaccuguagcucacagcguggucagcagugaugggcugccgccugugcgcaggagugaacaagaguguuacugcuggccucuguucccugcccuuccccagcggugcuccugccccccccaagcacagggaccucuggggcugcugcaggagccucggcaaccucacacauccauggcggacccugggacagggcccugcucacauuccgucucucuggggaacacuuuuagagccuacauggaggacgcgccccugcugagaggagccguguuuuuugugggcauggcucucuggggagcccaccggcucuauucucucaggaacucgccgacaucuguguugccaucauuuuaccagguaaggcgguuucugugugcagugagcuggcaggaacgggagagcuccccucacgccugcccacccaucccacuggggguccugcugcgggggcugcgguggcauuucuaggccuuuccaggcaguugcuuugcagcugggggugagguuuggggcccuuuguaggcuuuagucuuuuuuuuuuuuuugagaaggaguucugcucuuucugcuuggcugacugcaaucuccgccucccggauucaagugauucuauugccucagacuccugaguagcugggauuacaggugccugguaccaugccuggcuaauuuuguguuuuuaguagagacgggguuucgccauguuggccaggcuggucucgaauuccugaccugaagugauccacccaucucagacucccaaagugcuaggauuacaggcgugagccaccaugccuggccaaaggcuuuuuucucucucucuuuuuuuuuuuuuuuuuuuuugagacagaguuuuacucuuguugcccaggguggagugcaauggugcgaucucggcucacugcaaccucugccuccccaguucaagccauucugccucagccuccugaguagcugggauuacaggugccugccacagugccuggcuaaugguuuuuuuuuuuuuuuuuuuuuuuuaaugggacagaguuucgcucuuauugcccaggcuggagugcaauggcgcgaucuuggcucagcgcaaccuccgccucccagguucaagccauucuccugccucagccuccugaguagcugggauuauaggcaugggccacuacacacagcuaauuuuuuauuuuuaguagagacuggguuucuccacauuggucaggcuggucucaaacucccgaccucaggugauccgccagccucagccucccaaagugcuggaauuauagguaugagucaccgugcccggccaaggcuaauguuuuguauuuuuauuagagaugggguuucaccauguuggucaggcuggucuugaacuccugaccucaggugauccacccgccuuggucucccaaagugcugagauuauaggcaugagccacugcgcgcagcccaaaggcuuuauucucaagcaaaccuuacaucuugcgaguuucaccuucuggaguuggcaguggaggggugaacgcugccucggggguagccguucucuugcuguuggcggcucuguuuugucaagugcuggucuuguccugucucugcaaugacgccguggcacagacgcuggugguacagcuucaguuuccgcagugccccgugaugacagcgcuuuuuguguccguccucguucugugcucacagcucccuggaggguggggcgaucacgucguccugguuuuauagugaugagcugcggugugggucacagggcucuccugauccucugcucuuccugcuaccccccuccccguaggggcgguggggggauguugucuuugugcacagcuugcagccgaacucagggcagcuuucaguugcugcugggcuggcccaccgggugcccaggauucaguugcuggucuguccgagucagggacuuugcaggcaggcauggggguggggcccgucuggguccugacugugcuggagcauguagaaaccccuccugggcgccccaccugcuguuucugcggccccugauaaacguguggugggcacugcgcgcucaggcgugcuacucucggucccaagggugacugggagggcgucccacagcaagcaagcagcucugacccugugugcuggccgggcucguguuccaggccauggcauguccgaacgaggugguguccuaugagaucguccuguccaucaccaggcucaucaagaaguauaggaaggagcuccaggugguggcgugggacauucugcugaacaucaucgaacggcuccuucagcagcuccagguggggugggggcaggagcuccggggagcaccgggaacccagacaggcaggcucggcccacucagaagaugguaccuugggccccaucucugggggucccgcagagacugccagaaccguguucucuggugauucgcaguggcgcucauccaccuuccaccggagacaggucugauuuuuccagacguggugcaucguuuaggccccagacaggaauaugcaguaggugagccggggcugggccagugcuguccacaguccgcagagugaccugcaggccgccuucguggccugagugggccccggcacaguucccagagggaugccaguguggcuuccgcaugacuuuggaggaccgcauuagucgagucuguuaaccacagcuuuaaggaggacuccacggccacacgggcucaucagcauaggggcccuggggaggcgaggcuaguauccagcagccucagggcugugccuuuuccuggagccuggggcgggugauguacaggaggccaggcagcagaagggaggccgggacuucgccgggacuuagcagggacugaaguccucucagagccugucgcugggccagagcauugcccccgaccgcugguggcaguggcagaggucauagccuggggcuucuaaaagaggcuggaccugggagaggcaagaaaggcuuguaguuguggcuacucuuggcccuccugcccgagcuuccuucuuggcccagcugcaugggcacagccaagauuccuuggggggugggguacgggcaggaacagcagcugccaucacagccacuguggccccuugagaggaucugggggguguccugggccacgugggucaggguggccccuggagaggaucugggggugucucaacccaugaggcccggagcggccucagagggcugggggcgucuguccccaugcggcccagagcggccugagagggcugagggugucuccaugcgguggguguguagcgaggccucuggugccaaguccauguggggaguggaagucagccugugucaucgugccugguacugcagaccuuggacagcccggagcucaggaccaucguccaugaccuguugaccacgguggaggagcugugugaccagaacgaguuccacgggucucaggagagauacuuugaacugguggagagaugugcggaccagaggccugugagacccccuccuggguggggccuuugggcuuuggcugguggggaggggccgggugcugggugaagugcagcuuucugagccucagaagccaagggccaggugggcgccugcuuuccagguuucugcacucggcagggaaggcuggcaggcacagcacguguuugguaacaagcucggggcuagcccacccaucaguuuccucccaccuguguggagcaagcuuccauccggcucuguagaguccuguggcucccaggcggccgcagucauuuugccaggaacacucagcuuagggcccaggcuuuuccauggguuuggacacaagucuuccccgcugccaggagugccuuugugucugggcugugggcugcaggcugugaggcggcugggcucugacagcaaaccagccucucgaccagcagcccaguguggagaaggagagcgccggaggggcagaggggcaacaccggcucuucuuuugacaggaguccucccuccugaaccugaucuccuauagagcgcaguccauccacccggccaaggacggcuggauucagaaccugcaggcgcugauggagagauucuucagguaggggguccucuguagccuugccuggcaccuggagccuggcccugucucugucuggggcccacccgggcugggucucaggaugcccgaugagcagggcccuccccucugccucuggagagcccuggcucugggugagcaggugcuagcuugcuuuccaguccagcaggacagguccucucaugacgccacugggcucccucuuuucgggggucgucuggagagaugcucccugggaagcagagcucugugcccugugugccuggccgcgggaggacccagagucgggcuggccugcgccaggcagacgggcugguguggggcuguggccgggcacuccccacccgccccagcaggcugccgucccgcaggagcgagucccgaggcgccgugcgcaucaaggugcuggacgugcuguccuuugugcugcucaucaacaggcaguucuaugaggugcguguccaggcggccgcagcugggggcucagggcuauuucuccgugggcgggcugucucuguugugcacgugcucccgcagagccgggcucugccugggacuucgguccugccggacccucugcagcccccagcguggucuguuuaccccuguucauucacuggcuugcucguccugggugccucugccaggccuugacacguggccaaguagcaaggaaggcacagugccugcccucagggagcuccggccgguuuucacccaacacaggagccucuuaaaaauucugugugaguucguuucagccagucuugcauggggacauugucuuccguuucaguccugacguucacccugugcaccugcgugaucgccagcccugccuggucucuccucugcgggcucucccucuccacucccuccucugggagcucuguggccccaggcccaccuuccuugagagacauuugugugccugccagucauaccccuuucccaggaggcgcagcuuaggcucugaggcugucccuucccaccgaacuccucccugcagccucgcaguccugcccuccugagagcugcccacucugcuccucuccccagcguccacuguccuugaauugcccuuugcugggcauugcgaucccgcauucugucugagggagcuaagggccuccuggaaguuccucuggguccucuggcuucucccaucagggcuggucuuguccuggucucuguuccuguggaacuuuuuaccugcuucugugaaaacucacgcuguccucagcacagcacgcacacacacgcauauucacgcaugcacaggcacacacgugcacaugcccacgcgugcacacagccacacacacccucacgcacacacgcacagcaccaugugggagggguucucggcugugacagugaagggcagggccucaccucggcugcuccuugugaguugugggccccgugucugugcccggccgcccugcggugcucaccagccuucugaacgaggagcuggacaggaucccuggaaggggccccggggucucugagucgcgcucagcgggugcuugugcucucugcccagcugugcugaagucccgagggacauguccgcugcuugcgggucgguuccugaggaauuggaagugucacgagauguggcccucguugggcuggcgcucauuggccucccuugugccugugcaggaggagcugauuaacucaguggucaucucgcagcucucccacauccccgaggauaaagaccaccagguccgaaagcuggccacccaguugcugguggaccuggcagagggcugccacacacaccacuucaacagccugcuggacaucaucgagaaggugagagccguuguacccggggccgggugcuagcgugccagagcuccgugggcagcaauggccucugggcccucuguccuccucuucgagugaccggauggcuguguccguaggugaggcuccccucccugcagggugggugucccgaggccugugcagggccugccacugcuggauuuguguccugacugaaaguccuggacauggguguccugucacacucugggacagcugggcugggccuccuggaccgacgcuggagcccagaccuggggcuggggcuuuggccugccguccucccugcccagccaacagcuuugcucuuugauuuucagaugcauuuugguuucugcacagucacucggguauaaagggcaucuuugcuuuugagcaauaaagaugaaggccgggcacaguggcucacgccuguaaucccagcauuuugggaggcugaggcagguggauugcuugaguucaggaguucaagaccagccuggccaacauggugaaauccugucucuacuaaaaauauaaaaauuagcugcacgugguggcgggcaccugcaaucccagcugcucaggaggcugaggcaggagaaucgcuugaaccuaggaggugaagguugcagugagccaagauucugccacugcacuccagccuggacgacagagcaagacucugucucaaaaagaaaaaaaaaaagggccgggcacgguggcucaugccuguaaucccagcacuuugggaggccaaggcaggcggaucaugaggucaggagaucaagaccauccuggcuaacacggugaaaccccaucucuacuaaaaauacaaaaaauuagcugggcgugguggcgggcgccuguaguccuagcuacuggggaggcugaggcaggagaauggcgugaaccugggaggcggagcuuguagugagcugagauugugccaccgcacuccagccugggcgacagagcaagacucgaucucaaaaaaaaaaaaaaaaaaaaaaaagguguuugugguagaaaguguucucacggcugcugacucagaaccaugagccuguguguaaguccuggccuucucuucaaaggugauggcccgcucccucuccccacccccggagcuggaagaaagggauguggccgcauacucggccuccuuggaggaugugaagacagccguccuggggcuucuggucauccuucagguggguguucugcacgaggccucugcucccggggcgcgcauggcuagcguccaccagcugcaucugcguuguguuggagucuguuccccagcgggacccacacccucccuggauuugcugagggugcgguggucucagcaggcagcagaaccuuccuccugcucuuguggagggauggaugcaagaggccccguuguacgcccugaccagagcuugucucugugcuccugagucagggccggaaccauguaccauccucagcguggcgcuugcccucgucacccagcacagcaccugggaaguaaggguggcccuccauuccugcccugcaguccguuuaauauuugcagcuguuuuguugagauuuaauuuacauaucaugcaauuuacccauucacagugaacaguucagugguuuucaguaaauucacagagcucugcagccaaccccacagucagcuugagaaccuccugagcauaccaguagcacacgcucccaucccccguugcucccguacccccggguaccaucaagcugcuuccugucucuguggauuuaccuacucucaacauuucauggaaguggaaucacacaaaauucauccauaagauguuggaugguagaacaguuuccugucugcugacuggauuguuccacccagcgccauguguccaggcccguccaggcuguggcagcuguuggugcuccccuccuuuucauggcugaguaguauuccaucaucuggaaggagcacauuuugucuguccguuccuccauugguggacauuuggccuguguccgccuugcagcugcggugaguggugcugcugugaaccuucuccuacgagggcuccgccgggccugcauuuucacuuuugggucugcaccuaggagugaauuguugggcccuagguuuagucugcauuugguguuucaaggcgauaccaggcuguuuuccacuggugcugugccauuuuccauccacucgagcagcauguaaggguucugauuuaucuuuuuuuuuuuuuuuuuuuuuuuugauacagucucacucugucgcccaggcuggaguggagugcaguggcgcgaucuuggcucacugcaaccuucgccucuuggguucaggcgauucuccuaccucagccuccugagcaucucguauuacaggcaccugccaacauacucggcuaauuuuuuguauuauuaguagaaacuggguuucaccauguuggccaggcuggucuugaacuccugaccucaggugauccucccgccuuggccucccaaagugcugggauuacaggugugagccaccacgcccggccugccucuacuuuucaaagccucacagcaucacuuacgugugacugucagugucaguaucguguaaaauauaauguaugaaucaguuugcucaaaagcucauccuuaagauguuggaugguagaacaauuuccugucauguuuauaugucauggguuuuuauuucuugccauggaaguugaaaguggugaugauuuuuuuuuuuaauuaauuuuuugagacaagaucucacucugucgcccaggcuggggugcagugcugugaccauagcucagugcagccuugaacuccugugaccaagugaucguccugccucggaggccucccaaguagcugggaccauaggcacacgucaccacaccuggcuaauuuuuucauuuuuuguagagauggggucuuuauauguugcccagccuggcaucaaccuccuggccucaagcaguucucccaccauagccucccaaagugcugggauuacaggcaugagccaccacaccuggccgugguguuugauuaaaaaccaggcaucagccgggugugguggcucaugcccguaaucccagcacuuugggaggcugagguggguggaucaccugagguugggaguucaagaccagccugaccaacauggagaaaccccgucucuacuaaaaauacaaaauuagccgggcgugguggcgcaugccuguagucccagcuacucgggaggcugaggcaggagaaucacuugaacccaugaggcagaggguacaguaagcccagaucacgccauugcacuccagccuaggcaacaagaaugaaacaacgucucaaaaacaaaacaaagcaaaaacaggcaucaccuccuuggugucucauccacaugagcaccaugcucuuuacugacugguugggaaggggugugcugggcugugggggccuauggccugggagaacugagaaccuuucugcuucugcagagggaaggaaagagguucuguugcccuuacuuggaacuccagcccuggaggccugagggucugggcugcagaacugagauauuuccuaguugaggcagaguccugguucuggcugcuuucauuucuuuauuuuuuugagauagagucucaccacuaugucacccaggcuggagugcagcggcacgaucucaccucacugcaaccuccgccucccagguucaagcaauucucuugccucagccuccugaguagcugagaugacaggugcgcaccaccacaccuggcuaauuuuuguauuuuuaguagugacaugguuucaccauguuggccaggcuggucucaaucuccugaccucaagugauccacccaccccagacccccaaaguguugggauuacaggcgugagccaucgugccuggccuguuuucauuucuuuuguuauaauugaaaaguaacacaguugacucuugaacaguauggggcugggagugccagccccugugcaggugaaaauccccaucuaacuuuuaacuccccagaaacuuuaccaacagcccucuguugacuagaagccuugcugauagcagacagucuauuaauguacagcucguguguuuuauguauucuguguuuuuacagugaaguaagcuagagaaaagcaaaugcuguuaagaugcuaggcauggugacucacgccuguaauccuggcaguuugggaggccgaggcgggcagaucaugaggccaggaguucgagaccagccugaccaacauggugaaaccccgucucuacuaaaaauacaaaaauuagcuggaugcgguggugcgcaccuguaaucccagcuacucgggaggcugagguaggagaaucacuugaaccugggagguggagguugcagugaccugagaucgugccauagcacuccagccugggcgacagagaaagacuccgucucaaaaaaaaaaaaaaaaaaaaaucauaaggaagcgaaaauacauuuccuguuccuuaaguggaaguggcucaucaccaaggucuucauuguugucauccucauguugaggggacugaggaggaaggagaggagacacauggucuugcucucucgggugggagaggcggaagaaaauuggcauguaagugacccaugaaggccagccucgugcuguucgagggucagagaguuugcacaauggacacggugacaaguuugauuccccuuuuccugccugccuagugggcccggcagggcggcagcugcuguugguuccauguggccuucccagaauggggggugccaggcacugugugaacccccaccuccaccucuuuuuuguccgaggaagggauguugcuuuuaugucauaauauuuugagaugaggagaaacuguuaaucauuuaaucaucuuuuuuuuugagauggagucucgcucugucgccccagcuggagugcaguggcgcaaucuugguucacugcaaccuccgccuccuggguucaagcgauucuccugccucagucuccugaguagcugggauuuacaggcaugcaccaccacaccuggcuaauuuuuuuuuuuuuuugagacagucuugcucugucgcccaggcuggagugcaguggcacgaucucggcucacugcaagcucugccuccuggguucacgccauucuccugccucagccucccaaguagcugggacuacaggugcccaccaccacgcccggcuaauuuuuuuguguuuuuaguagagacaggguuucaccauguuagccaggauggucuugaucuccugaccucaugauccacccgccucggcuucccaaagugcugggauuacaggcgugagccacugugcccggccuaauuuuguauuuuuaguagagaugggcuuucuccauguaggucaggcuggucuugaacuccuaacuucgugauccacccacuucagccucccaaagugcugggauuacaggcgugagccaccacaccuggccucagucauuucuuucaaugauuuuuuaaucauuuaaagguguuaaucauuucuuuaaaagaauaacaguguaaccacuuaccuccagagugcugcaaagggucccucaggccagauuuccccuggcuccugcuggccucggccccaggguugcuggaggcaacagaugcucuucacaccuugccacacgugucugggaggugcccuugaccuuuugggaggggcugccuacaccugggaucgcccugcagcacacacuccccgccccauucugcccugucugccacgcagcuggagcuucuccauugaauggacucuuccucaccuguugaugacugcccugaugaugagaugggcacgagguuggguuuuacuuuuugcugcuguggagagagaguccuggugguccuggguuugaaggucguguguuuugaagcacgcacucuagagcagccgccccggccccugcuccgggacaagggugcugucuuaggacugcguuuucaccuccugcgccguggugagcugcguccucucucugcagaccaagcuguacacccugccugcaagccacgccacgcguguguaugagaugcuggucagccacauucagcuccacuacaagcacagcuacacccugccaaucgcgagcagcauccggcugcagguaugguggcugggguugcgcagccaguuccugggggcccagccagguauccccgucucggcaggugugguuccuggaagcugcagagacggccccaggauggggccucagcugaccgucccuccucugcacccacuguggccgcagccuccccaguccugguguccuucccucugccugcaguccacacaucuguggcuugucgcucuaagccgcacggugacauggguuggggcagagaaaaggacgcacggcgacuuccggggcagugcauggcccugacgcuccuggugcugcagaaucugugaaggaccugcagcagagggcugggcaggugggcggcacagggcagagcugagagggcagagcugagacggcagggcagggcuggagagggcagagcugagagggcagggcagggaugggcagaacagggcuggaggaguuucgcugaguuugcgcuauagauguuggcaccaggcugagcagaggugacugggaugggagcccucccuccuagagcaggugcucucuggggccaccccuguggccucagaguccuguucagccugucgauggaagaaguggcagggcugggagcugagcuccgcuuucuggcaguugggggcguguggugcugccagaggagcgaggcgcccaucccuuccaucccaggcgggcccagcuguggugguggggacaccaggcucugugagcuccgaggcaagggagggaggaggcugugggugcugggccuccggugucaccaggacagagccugugucuguguugggaugugggugugugcacaucagcagguggccuuuucugagugccuguggugcuggacgugggucugagcaggugggacgccgccuguccugggccugcacgagcuuggcucuggcuuucaccauccucuuccugacaggccuuugacuuccuguugcugcugcgggccgacucacugcaccgccugggccugcccaacaaggauggagucgugcgguucagccccuacugcgucugcgacuacauguacgcgggaccucgcccacggcccaugaggcucagggcgucagaggcgcuggggcugugguggcgcuguuugcaugucugagggaugucccaggguugggaagagccaagucuguuccguuccugcugcggggacuuggccucagcugcuucucuugcuucugcagggagccagagagaggcucugagaagaagaccagcggcccccuuucuccucccacagggccuccuggcccggcgccugcaggccccgccgugcggcugggguccgugcccuacucccugcucuuccgcguccugcugcagugcuugaagcaggugaguggggccgggcagggaccauccgucccacguugggccaggaggacagggagcugccaccugccugcugggccucccucccugucuggccuguggagggcagcccucccucagagcugagccuucccccuuccccgagcagcugcagggacagaggccugcgcugggcaggcucccccggcugagaacagggcuccauagcccuugacgcugugcagccacaaagcagagccucagaugcuagcuuccgccucugucucuaggguccagaaggcccuguccugacgccuccucuccucgcaggagucugacuggaaggugcugaagcugguucugggcaggcugccugagucccugcgcuauaaagugcucaucuuuacuuccccuugcaguguggaccagcugugcucugcucucugcuccaugguaccauggccggccugggguuggggugggggacccaguaggguuuuuccccaaaagacugcgagccucugggcagagcgagugagacccuucgggcucgggcuccauuucccucaaacucagcugcacucuggagcgcagauugugccuugggcaggguggagggaccccugccccagcucgcagcuuuugggacugacgucagagguccccagccaagggcaugucacugaauguggaugucucccaucugugcuuuuccuaaguggggcucccgugccguucaccucacauuccugguguguuacuuggcaggcacucccaccacuccgaaagggaggcccuuccugggagggaggcaagaaggcuccccagccccuuugcccccuuuccugggccugcguucccagggccuccccagccccucuggcuaccccgugaccuggccgcuggggagagguuucaugccuggauuuggucaucagcuuucaggcccaaagacacuggagcggcuccgaggcgccccagaaggcuucuccagaacugacuugcaccuggccgugguuccagugcugacagcauuaaucucuuaccauaacuaccuggacaaaaccaaacagguaggaggucagagcaggacaggcgagcuugauggggccugggauucgagggccuggcccagguaggccccacauuuuucucauaaacgaguuucugccaggccagggaugagugaguuggcucugcuucccuggguggcugccagaugcccagaguggggacauccgauucccuggugcuucuagcucucuuuggggccugggagccauccaguguucccuguccaccccggacagcaucucugcucucuguagagcguugccuggcuuguuccugcugucccaagggggagguggccaugccgguugguggagcugggcugguucugaggcgcagggugggcaggccagagagucuggcuucugccucccuccacgccccaucaggugccggaaacugucccuucaccugcgaucugccucgcccccgucccagucgcauucuuccacaccucucuuugacauggcccuccgggacgaggagcugguguccuagagauucuggccuccgcucagggccaugcccgccaggagaugcugacucugaggcuuggcccaucugugccccgggccucagcuucugaugguggcccuguagggagcuguuguuggguucccaucccucaggcucagccccacccuguugggccccuucagccccucugagaggcucacuggguccucaugggucuugccucaaagcauagccagccuugcugggcugcagguucugaggccuuacuggcccacaguguauccgaggggugaggccggcuuugggaaauggaagcuguucccgggacacugccuggcaggccaucuggccccgggcucugccugagcuccgcucaucuucugcuguccucauggaagacacugcccaggguuggugugggaucugguggcuuggccacuucaggcagcacugccccuugcaacagagccagccugugaagggcccagaaccaggggaugagagcccagcaugucuggguucuguuggccugugggaucgugucggaaugcaacugaccggagcagucugcugugcagagucugcucggguagcucagcacugcuggcucugccccacaggcauucagggacuugcuaagccucggcuguucucccgguggagcacucgagguuggcgagggguaggcgaggcugccucugcugcaagcggguggggccugagguguccugucuccugcagcgcgagauggucuacugccuggagcagggccucauccaccgcugugccagccagugcgucguggccuuguccaucugcagcguggagaugccugacaucaucaucaaggcgcugccuguucugguggugaagcucacgcacaucucagccacagccagcauggccgucccacugcuggaguuccuguccagugaguccccgcccugccugcgcaugcacccgagagguucgggcuguguaaccugugcgggcuucucuggugcccucucucaggacuccuuggggaaccugggugucucgccuucugcugccucagggccugggcgucucugcccggcugccaugagugcucuccuuccuggcuuugaggggcggcuccucucaccccucuaguguccaugugaacgcuccuccuugaagaagccucuucccccccgagcaguggcccuccccugguuuugggccuccucucuguccaacagagcacacgccgcuucaggggggcuuuguucgcuucccccagacugugacuucaggagcucaggugccugucccuuccccucaccgccugugcgcaucugggcaggcccucaauguugagauggcagaagggcacugcugggcccgcacuugguguagaggcuggagagaagaucgugugugcuuugugggccacaugcagguccugucggucuuucuguuuuguugauaacccuuuagaaguguagaagccuggccaggcgcgguggcucaggccugucaucccagcacugugggaggccgaggcggguggaucaccugaggucaggaguucgagaccagccuggccaaccuggcgaaacccugucucuacuaagaauacaaaaauuagccgggugugguggcgggugccuguagucccagcuacucaggaggcuaaggcaggaggcaggagaaucucaugaacccaggagguggagcuucuagugagcugagaucacgccaccgcacuccagccugggcaacagagcgagacaccgucucaaaaaaaaaaaagagagaagugaggccgggcacgguggcucacgccuguaaucccagcacuuucggaggccgaggcaggcggaucaugaggucaggagaucgagaccaucuggcgaacacggugaaaccccgucucuaauaaaaauacaaaaaaacuagccaggcgugguggcgggcgccuguagucccagcuacuugggaggcugaggcaggagaauggcgugaacccaggggguggagcuugcagugagccgggaucgcgccacugcacuccagccugggcgacagagccagacucaucucaaaaaaaaaaaaaaaaaaaaaaaaagaggugcggaagccuuuccucacggaucacacaaaugguaggcgacagcucgaauuggcccagaagcugugguuggcuggccaugggaccgagaguugaggccagggucgggaaagccacguccguguggccguggccuucucuccucugcagcaccccaucgcugccgugggcagagcagccguguuggccuucagaggcgcugcacgggaccccggcuccccugaccacccucuccauuaccgcagcucuggccaggcugccgcaccucuacaggaacuuugccgcggagcaguaugccaguguguucgccaucucccugccguacaccaaccccuccaagugaguggucgccccaggcccugugccucccagccguggcccccgcuaggccuugcggcagaaagccccggcagccuuuguccccaaggccugagcgccucgguuuuuugcacuucaugcccuggggauguuucccugcugccaggauggagugccagcccccuucucaucucagguuuaaucaguacaucgugugucuggcccaucacgucauagccaugugguucaucaggugccgccugcccuuccggaaggauuuugucccuuucaucacuaaggugggcucagggccggugaaggcugugucucucgguaggccagggcuugcuuugcccuuggcuguccauggucgggcagagugacaggcagguggagggcagugggaggguguuuggggcugugccuguggcgcugggggcucugcugggcagccugcagggcuuugaugcgcggcaggcauugaggggugggagcugggugccgccgccuugccccuagccugcagcuugucccuggccagggggcacccggcaggccuggugagggccuccagcccccauugccaccccucacugucugggugugcucacucugccagggccugcgguccaauguccucuugucuuuugaugacacccccgagaaggacagcuucagggcccggaguacuagucucaacgagagacccaagagguacggccugcgggggugugccuggagucggugugggguggggaaggacauggggcuguggccugccugacggugccuccaagucagugaguggaaauggguccugugugcccuggaguaugugaggcagggcaggaccugcaagggccgcuaacaccccucagccccucagcagguuggccgugguggccuggguccgggcugcgugugccacgggcaccuacuuguggaauuggggguuggggugcaagcuuuaggcgccugagccccucgaaggagccggccuugucuggggcugcccccuccucugcagcccccagccugcugcuagccggggacucugcuucaucaccgccgccuugccggaccgcaaagagcugagccagccucuguguucuuguuugcauuucauuugaacggcuuucuccuccugucccccaccuuccugcccgagcuauuuuggcuuucccuagaugggaauacggcauuuuccagcgugaccucaacucggaagcuguugucuccagccccugggggccgggggccaagcucggccauuacggccagagacuacuuucuggggucuuggucucuuuuccuagugaccuucagggccuggccacugaggccucagugccgccucggucagagcugggcggugccugccuuccgcgggugggugggauugccuggccagcacagccuggaaucugccgugggggugacccacacacguuuaauuugcacugacguuguuuguuuuggugucaugcgugaagccuuacuuguucucagucauguuuaccagacguauuaucaugcauuuuuguuuucugucucuuccccgcuaacugcccuuuggcauggcucuuuuugcucaucucacccgcgggaucucuccauccugacccuguggccugggaccuuuccuccucaccccuccacuggcuuguucuccccuucccgggagcugggcucucuggggcguuggggcuccuuccucacccgauagucugaggauagccagaccccccaaacaaggcuugaauaacucuccacccgugaaagaauucaaggagagcucugcagccgaggccuuccggugccgcagcaucagugugucugaacaugugguccgcagguagcgggacugucggguggggggcacggacccuggagcuuggccccgugagcaccuggguggcagugcauggggcugcuugcaugaccucaucgucugcccguguccucccuggccagcccagggggagccggugacgagggguggaaagguugcauucuguccccaggccccguaugagcacgggcugguugcacgcauccccaggcccccucggggugccgcuccgagagagccaggcgugccgggcagcagccuccccaggcuguccccaagggccgcaguguggguugggggagacaccacuccugguuuuggccuuuucguauucucuagaauggacguuuuucuucgggcuuucuucucaacaagguuuauuuuuuguuguagcugaaagggaacaaggggcauuuguggagggugcugggguggggcagccugggagggccugggugggggcuaggauccugcagggcaugggcaugggccugggccccaggccauggucuuaguucuccccgcagugucugggugcaggugugggcucucgggcucucggcugucaccugccugugggucaucgcugcuggcacuggcagaggggauaccugucuccuccuggaagcccguugcaggccaaggggucccauggcccucaguccauccaccuccucaccucaggccggccucugcugggugggacuuggccagggguuggggugguagaggugcucggugaggcuuaaagccauuuucuagcacauucuguaucaugagcaaaauauugccuaggggcuaugaaauuuguaucagaaugaacucccauaagccucuucccugucacuggguguggagcucaggcagccgcucgccugccugagggugacgguggaaggccacauggggaucccagaccucugugugcuugccggaggcagccugcgggcagaaugcaaucugggccugucuguguggccuccgccucucugcaugacuacaccguuucgccaggaggccguaaccuagugcucccgugggcuucggugagggggaugucggucucuagccuccugagucugcuccgaccaguaggccuggucuuccccacccagcgucuccccguucucugggacaaugugguccacgugauucucaagcugaggcucgcugggccgcccacgcccuguuggggucuuuccgagcgagguccucagccgugcaugcguugagcuuuggcccuuggugauagguggcucggcccgcccuaccuggcacccugacccuggucacggccucucccuccagcaggauacagacgucccucaccagugccagcuuggggucugcagaugagaacuccguggcccaggcugacgauagccugaaaaaccuccaccuggagcucacggaaaccugucuggacaugauggcucgauacgucuucuccaacuucacggcugucccgaagagguccaggcggcacuacagggcugggcgggccugcgggagcuccacgggcaagcuggguuucacgcucccugucuucuaggucuccugugggcgaguuccuccuagcggguggcaggaccaaaaccuggcugguugggaacaagcuugucacugugacgacaagcgugggaaccgggacccggucguuacuaggccuggacucgggggagcugcaguccggcccggagucgaggugacugcaccuuccuuuccuccgcgccugccagccucgacaccggcugucccgagcccaggcccacguggcacccucguaccagccuggggacuaaguccacccugugcgugggauucucuucucagcuccagccccggggugcaugugagacagaccaaggaggcgccggccaagcuggagucccaggcugggcagcaggugucccguggggcccgggaucggguccguuccaugucgggugagccuuggccccagccaccuccacacaggcaccggggcucccucaguugcugcuggucccaguguucaggaaggccccgagcccaggggccgggguggcuggcuucaggcccggcccacguccugacucuggggugagccuuccacagcucaccccagagccguggagugguggaguguggcccgcuugcugcagaggggccugcucugggugcugguguuuccugcggguuuucagcucggcucaguccuggagcccuucucugcuccagcgagccguggucugacugcaggacagguucugggucccucccuguggcccuggguucacugaggccagcacuguggugggccgugccccaagggcagagcugccaccgucucuggcugccuguggcacuagcuugccaggcucggggggagcauucagcuugaggcuggugguuuugcaucagguaagugguggucaccaguccucugcccucuucuucagggggccauggucuucgaguuggcgcccuggacgugccggccucccaguuccugggcagugccacuucuccaggaccacggacugcaccagccgcgaaaccugagaaggccucagcuggcacccggguuccugugcaggagaagacgaaccuggcggccuaugugccccugcugacccagggcugggcggagauccugguccggaggcccacagguacugggcggggcuggccugagcgccaucuuucugccagucacccacagagcuguggacacucaggggcgauugcagacuuggcccucuugggauauuuggggguaacuuuuguuuuuuuuuugagacagagucuugcucuguggcccacgcuggaacgcaguggcgcaaucucggcucacugcaagcuccaccucccggguucacgccauucuccugccucagccucccgaguagcugggaccacaggcgcccgccaccacgccuggccaauuuuuuuguauuucuaguagagaugggguuucacuguguuagccaggauggucucaaucuccugaccucgugauccgcccgccuuggccucccaaagugcugggauuacaggcgugagccaccgcgcccagccauuuggggguaacuuguaagucuccagaggugagcugugaggggcgauccagguggcugagguggggcaggggccuguggcgaaccaagugacuuccauggcagagaguugcccuccccgccuggaggcugcaaguccgagaccaaggugcuccucggcaggaggugcuccucagaggccucaauccuuggcaugcaguugguuuuuucccuguguccucacaggcucuuuccuggaugucugcguguuaaucuccucuugggaggaaaccggucauggcuuaggguccgcucuggucccuugcuagccguaauuagcuuucugaaacccagucuccagagacagucccguucugaguuccugggguugggacuaaagcauaccaacaugggggcacagcucagccuguucccaggggcagagggagcccccgcagaggcccagagcccagggacagagggaggccuuugcagaggcccagagcccaggggcgccugggugugccguggcugaggggugcaaagaguagggguuccagcccucguggaggccuuggguccggacugugaggcugugggcuggaggccgcugcucugaggugccuggcggagccuggccucgaggcaggggcugagcggggcagcaggguggguggccgucagagcagcgcuggcuccgacaucgugguccugaggauugugggagggagcaugagggcaaaaccagggcccaggccaggaggccccuggggggccagagauggguaaggggagguacuggccucaggccaaaggugcugccgccuccgcagggaacaccagcuggcugaugagccuggagaacccgcucagcccuuucuccucggacaucaacaacaugccccugcaggagcugucuaacgcccucauggcggcugagcgcuucaaggagcaccgggacacagcccuguacaagucacugucggugccggcagccagcacggccaaacccccuccucugccucgcuccaacacaggugaguggcauggcgggccuuggcacgggcucugcucccacuggccuggugcucccggugacggcaauguggcuccucucugcugagggcgcccacacggcugggaguggucccuggccugccucagcaccauuguucuccgguguuugggaggaggcugacccgugggaggugucugcccugcucaggaagcuggggcuggcagcuucagaagcaguaggggcccuguggagccucugcccagcauccuccguggggaguccagcacugcgggcuccaggaggcucugcggcagccucccucccugccugggcccagguuuggacaccugagcccgccugcgcacucugggcccccaccccacucggcaccgugcuucucgccaggcccucuggcucuucccuguggcugcagauggcacuuagcggccuaggacgucuauucacgggaggagggaggcacugcccuccucaggucugcccaagcagcuuguagcuagcacugggccccgugcgcgccccugccggccgcuggcccugcccucucuccucugcaggcacggggccugugcucucugcucgaccuguguguagccccuccuccugcugacguggccgcacacggccuucccuugcaguggccucuuucuccucccuguaccaguccagcugccaaggacagcugcacaggagcguuuccugggcagguaucgccucucagagggaagcgguuggcugcagagcgccacucugccucauaggugcugugcucgucgccucauccgcccacccccaugguccgucugccuccauugcccuggggagcaggucccgacucgcaugaggacgucugugcagaaugucuuuggcuuggccagcgggauccccuugacuuggucccuuuguggcugagcccuguucccacgcugugcgagcacucccggcccagcuucaggccugagggguggggguggccugagucuccauggugacaucagcugagcugcagacucugauggguggcagcuguuuagggggaagcccaccccugggccugcaccgagcgggccuugcccuggccuuugguggcuccccuggccucuggaacccacagauggggcugccucaagucccagguugaccaggggcccugcagaccgaccucugccuguugcccccaagcccugguggggagugcugugaccugcauggugcuccccugccaggucuccacgugcagacgagcugguuuggaagggcugcgugggacgggcccugggguggcugacugcgcgugugcagggcuguggggcgcccgggggcugugaugguccccucuguugcugcuucuacuuccucucccccuguccugacgcuggcacaggaaaugcugcuuugggaccucccacccucucuccuuagcguccccagcugugggucuggcuuggaguuggagggugagccucugcucuugggagcagucuguuugcaaacagggacuucccccacgucacggagucuccgcagcucuccucgguuacgagggcugguuucaggcucccgcucuuuuagagcugaggcccgucgggcggagagcgucuugccccugccuaccuggaggcacagggguggcugcugguggacacuagggugggcagagccgauugccugcccaacccccgggcacucaugcaggagaggccugugucggggucacgugcaggccuucccagcguccucccugcccgcucgguggauggcagcaguaagcagagcccuggggaggcucgcagggcugcugucccucuggucaggagaaggcugguucucggaggccacgucagggccagggccuggcccagccccacauccagcagccccgucuguguccucccagacuccgccguggucauggaggagggaaguccgggcgagguuccugugcugguggagcccccaggguuggaggacguugaggcagcgcuaggcauggacaggcgcacggaugccuacagcagggugaguguggcucagagccuggacccugcugaccucggggggcuccuuaggggaggcagggcucugcgugggugugccugcacccugggaacuggcucugaacuugggggagauguucuuccacaucccucgugcacagacggucugcacuuugcagccauccaccugggccggcccuggcugcugggcagccuguggucucaggggaugcugauaccucugcucacgcaguguggggcacagcugguggcagugcugcugcgucaacgggcgggggccguagccuggugcucgggcuggucuguggcccugggauggaggacagauagggccucaccaccuccaggucaaccccaggugggcucgagggugccugcugacagggguucucuuugggaugguccuuucuagucguccucagucuccagccaggaggagaagucgcuccacgcggaggagcugguuggcaggggcauccccaucgagcgagucgucuccucggaggguggccggcccucuguggaccucuccuuccagcccucgcagccccugagcaaguccagcuccucucccgagcugcagacucugcaggacauccucggggacccuggggacaaggccgacgugggccggcugagcccugagguuaaggcccggucacagucagggacccuggacggggaaagugcugccuggucggccucgggcgaagacagucggggccagcccgagggucccuugccuuccagcuccccccgcucgcccaguggccuccggccccgagguuacaccaucuccgacucggccccaucacgcaggggcaagagaguagagagggacgccuuaaagagcagagccacagccuccaaugcagagaaagugccaggcaucaaccccaggugggccucuugcuuccgggcggggcuccugacaccucuccugcgggaaccuggugccucacuugccccaggccgagcgggcuggggugggguccucgccugugcccuagggcuggcuggaaccccugggagggcgguggagugggagauggccaggcucuguguuccucccugugggcuguggcugcccuggccaggcccucaccugggugcccaccauccccucccugugcaguuucguguuccugcagcucuaccauucccccuucuuuggcgacgagucaaacaagccaauccugcugcccaaugagguaggcguggccucccucuccugcauccgcuggagcuguguggcucgggugaaugguggggggcccagcucugcugcugggagcucaggcuugcagagggcucuggccuaagcucccuguggcagccugccgugaccggccuggguggggcggccuccuguggacgggcgucuggggcucaggcagggcucugugugccacagucacaguccuuugagcggucggugcagcuccucgaccagaucccaucauacgacacccacaagaucgccguccuguauguuggagaaggccaggugaggcugcggggccggccuaggugccuggacagggccagcugggccucagccugcaguggguagggagucugggcccccaacgccccacagagcucaacacugccggguccccuacagcaugaagugcucauugagcucugugccaggugcugcucugagugcuggggaccccggugcgagugacagguuagcgugggagcacccggcacaccaaggagugggaaggacugggcggguggcaccggucgcagggcuggggagggcgcuguuggucagugagcugacagcugaguggugagggagcgggcagggggagccugcauaaggggugggggcaucccacacaccagcagcgggggccgggcgcacccugcccagcuugagcacuggugcugggcgagcacgggagccgacaggaugggcagccucagcgcccuauaggcugcaccuucaucccaagggaaagggcagggccugggcugcuucugagcagagggcacauggccugacuccgcccagucucagugagucccuccugcuguguggcucgaggagguggguggugaugguucccgugggagugggguaggccccugggggcaggcugcugaggggccagggccccgggugugcuuugaguguggagcucccugauuuugccggccaggcacacacggggcugagggaagagagggagucaaggaugacacccgaugucuggccuggguggcugcuggaauggauggucuugucugccucagggaucagaguggggcucccggcagagccugcugggcacccccacccucugcggggcagggcccggcccgggagugaugccacccugccucuccccucuccccacagagcaacagcgagcucgccauccuguccaaugagcauggcuccuacagguacacggaguuccugacgggccugggccggcucaucgagcugaaggacugccagccggacaagguguaccugggaggccuggacguguguggugaggacggccaguucaccuacugcuggcacgaugacaucaugcaagguacggccuggcgccuacccgcuccugcugccccaggccucagggcacggcucccauccaguccugcuaccccacgcccuggggcauggcccuggcacccccaccugcuccagcuccccacgccucagguuccgagccuaacagcgugggcauggaggcagugauggggcugguggcuuugcgucccaaagcccugccccuggggagagccgaggaccacuggccaggcaccagaggacgugguccccgcaggcccccagagccccuggaguaaucaggaggugccccagugcaaggcacagagggccucagcacuggccccacaaacccauccggcccugcucacccucagccgucuuccacaucgccacccugaugcccaccaaggacguggacaagcaccgcugcgacaagaagcgccaccugggcaacgacuuuguguccauugucuacaaugacuccggugaggacuucaagcuuggcaccaucaaggugagugaggggccgucagugaggcugggccccaggcaggugcccacugcugugucccggguugguggcagguccuccucccugagcuucggucacgaggagcaggaggagaggccgcagugcucagggccccgugggcacgagcuucaccccgagccugcguuguguccucugugcccugaagccuguggcgccugcugcugagugucugucaggaguaacuggcaagugcagacugggugugcugggugggcacaguguaguuggugcuuccugucuguccggcgcggcccuugggcccccaccaucuccccaguggcagcugucaggcugcucaguugguuaucgccacgcaccacuaggcagcaaccagcgucacccucuuccuggaggugggcugggucggccagugucacagcacgguccgggugagccccagcauggcggggagagcuggcauggcccaggcagggcagauaggcuggaggccucacuccaagggccccaggaugcugaggcagccacugaaccaaaaccccggggcugguagucagaguccaggaggggcaggagcauagggaggugggcucugcuagaugccaagacaaccaguugggggggggggggcaccugggcggcugaggagggugugguggugccgagauggggugcacggcucacuucauggcugggcagacggauucggacguguggcugcagacacccugggggccccagugaguggaggugccccagcaauuagaggugucuugccuguggcugcagcauaugugggugcugcgcccagauguggagggggcuuggccugggggaggccagacaaacacagccccgcugccagaggggaaaguucaggggcagaugcugcccauggagcugacaggugucuagcagugcaaccaggcaguagccgagaucagccuucagcacacgcugugugcggggaugacccuuucucuuguccgggcagggccaguucaacuuuguccacgugaucgucaccccgcuggacuacgagugcaaccuggugucccugcagugcaggaaagguagggccggguggggcccugcagugcaggaaagguagggccggguggggcccugcaguguggcgccaagagcccugggccuggcgugaccaccaagucuccccagacauggagggccuuguggacaccagcguggccaagaucgugucugaccgcaaccugcccuucguggcccgccagauggcccugcacgcaaaugugaguggggguggguccaggcgugagcuggugggacaggcccaggugccaccugauagugagcucacccccugccuacguccccagauggccucacaggugcaucauagccgcuccaaccccaccgauaucuaccccuccaaguggauugcccggcuccgccacaucaagcggcuccgccagcggguagggaauauggggcucccucagcggggugugcuggcugcccaagcuguggggcgggugugugggcagagcgguugccacgccucccagacuuacugcccaagccgccucugccuucagaucugcgaggaagccgccuacuccaaccccagccuaccucuggugcacccuccgucccauagcaaagccccugcacagacuccagccgagcccacaccuggcuaugaggugggccagcggaagcgccucaucuccucgguggaggacuucaccgaguuugugugaggccggggcccucccuccugcacuggccuuggacgguauugccugucagugaaauaaauaaaguccugaccccagugcacagacauagaggcacagauugcagucagaca

SEQ ID NO: 442 - RNA, 40826 nt, Homo sapiens; identical to SEQ ID NO: 441

SEQ ID NO: 443 - RNA, 40826 nt, Homo sapiens; identical to SEQ ID NO: 441

SEQ ID NO: 444 - RNA, 40826 nt, Homo sapiens; identical to SEQ ID NO: 441

SEQ ID NO: 445 - RNA, 40826 nt, Homo sapiens; identical to SEQ ID NO: 441

SEQ ID NO: 446 - RNA, 40519 nt, Homo sapiens
aguuuuaagucauggcgggugcgaacgggucucugcugcaggcggcuccgugacagcuccugcuucacauggguagaggagagacggcaaacgucggggcucccaggacuucgcggcggcaguccuaacccgugcacugagucgggcggggcgggcggcagcgucugaguagagagcucucuagaccaggccuggugucucccgggcuuuccuaggugccuguuugcgagcuggucagcugggcuguaguugaguucucccagggagugugggaggaaagguuaugcccaccagagacccaggguccugacggcuggagguccgcaguggggaaggugggcagagguguugcucagauguccccauuccuguuucguuugcacagagggguuuucuggugcguccugguccaccauggccaaaccaacaagcaaagauucaggcuugaaggagaaguuuaagauucuguugggacugggaacaccgaggccaaaucccaggucugcagaggguaaacagacggaguuuaucaucaccgcggaaauacugagagugagugagcuaccugugucuuugcuaggcuagagggaaaugcagagaaggcuggguuuggucuugcaccagguucugugggagacggguugcuggcaacugucuacacaggaaugcugucuccaguacuuggaggccgacauguccuuccucaggagacuucgaaagucaggaucuuggugaccugguucaggcacacuugaguuacuauucagauguugaugaaagaaagcccaucuuauagaugaggccugaguaucaucaucuucacagguaaggauauguccagguguuacaugauaagaugugaguuccugggagaaguagguucuuuauuuuauuuuuuuuuugagacugagucuugcucuguugccuaggcuggagugcaguggcacaaucucugcucgcugcuaccucugccucccaguuucaagugguucuccugccucagccuccugaguagcugggacuacagacacgugccaccacacccauuuaauuuuuguauuuuuaguagagauggaguuucacuaucuuggccaggcuggucuugaacugcugaccucaggugaucugcccgcuuuggccucccaaagugcugggauuacaggcaugagccaucgcacaugggcuaggucguuaucuuuuauguguguuugugucuuugucacacaugccuggcauuguguuuugcccaugaguaaaugcugaauuuuugcacuuguaaaguuuucuacuuagaaacaacuaaaacguucaucaacugaugaauaaaauauaguccauccuggcugggugcgguggcucacgccugucaucccagcacuuugggaggccgaggcggguggaucaccugaggucaggaguuugagaccagccuggccaacauggcgaaaccccgucucuacuaaaaauaccaaaaauuagccggucauaguggugggcgccuguaauuccagcuacucggggggcugagacgagaauugcuugaacccgggaggcggagguuucagugagccgugaucgcgccacugcacuccauccuggggaagaagagcaaaacuccgucuaaaaaaaaauugugcaguuugaaauuguauuucauguuauguuuuaucucaauacaacauuugcaguugugaaaaaaaauugcacauucucaacuccucgggauggagcaguaaagccccucaguaaaucuuuuuuuuuuuuuuuuuuugagaccgaguuucgcucuugucacccaggcuggagcgcaggggcgcgaucucggcucacugcaaucuccgccuccuggguucaagggauucuccugccucacucucccgaguagcugggauuauagacgcccaccaccacgcccagcaaauuuuuuguauuuuuaguagagacaggguuucaucauguugggcaggcuggucucaaacuccugaccucuggugauccaccugccuuggccccccaaagugcagggauuacaggccugagccaccgcggcucgucaagugaaucuugauuccagaaagaucuguuuuaagucucuagucuggaaaaugcagugggagucuuuaggugguuugugacuugcaguuaaggagaccguggccugagcacuggccccuuuuucuucuuucaucucucuccaggaacugagcauggaauguggccucaacaaucgcauccggaugauagggcagauuugugaagucgcaaaaaccaagaaauuugaagagguagguuuauccaguugagcuacuagagagaggcacguagacuauucagagccugaguuugcuuuuuuuaggaacaugguugacagcugacugccgaugaucugguuugcacuuuuuuuuuuuuuuuuuuuuugagauggagucuugcucugucgcccaggcuggcacaaucuuggcucacugcagccucugccuccuggguucaagcaguucuccugccucagccuccugaguagcugggauuacaggcacgcgccaccacacccggcuuuuuguauuuuuaguagagacgggguuucgccauguuggccaggcuggucuugaacuccugaccucgugaaccauaugccucagccucccaaagugcugggauuacaggcgugagccacugcgcccagccaguuugcacuguuuuaggggaauuuagcuuucaucguagugauggggaagcuacuggaaaugccccgaauacaaccuugagggaccaaucaagcguggaaauggggagcaaagggauuaggcuuuucuagcaacaccagaaaggauuucuaugccgagcgggggugcgggggcuuaugccuguaauccuaggacuuugggaggccgagguggguggaucacgaggucaggaguucaagaccacucuggccaacauggcgaaaccccgucuguacuaaaagaugaugagccgggcaugguggcacaugccuguaaucccagcuacuugggaggcugaggcaggagaaucgcuugaacccgggaggcacagguugcagugagccgagaucgccccacugcacuccagucugggugacggagcaagacucugucucaaaaaaaaaaaaaaggaagaguuuguaguggcugauagaaacgcaugcucacucgcucucuccuguuacaaguucaggccaagaaaaaucaagaaaggguuuguuccacagagaacaauccuaggcacgcuggucuuggugccauuuugggagggugacuggucggugguauugggcgaccucacggacauagaaauauuuauuuugggcaaacauugccagacuuuccugaugacuuguggacaggacaggaaguggucauuuugggagugcagguugcugguagagcaccugagggcucugcccuugccuugcccagcauuugugugugggagagcagugagaccuggaccucucaugcucagaucugcuaagaggagagugauugcuaccucugcagcagcucaucugaaacgugcuggccguacgcuaccaaagauagguguaaagaacagguguccuuagccgggcgcagugguucacgccuguaaucccagcacuuugggaggccaagguggauggaucaccugaggugaggaguucgagacccgccuggccaauguggcaaaacccuguuucuacuaaagauacaaaaauuagcugggcauggugucgggcaccuguaaucccagcuacuugggaggcugagggaggagaaucgcuuaaacucaggaggcagagguuguggugagcugagauugugccauugcacugcagccugggcaacagagcaagacugucucagaaaacaaaaaaaagaacaagcguccugcauccuguucugaaaguuguuuguguggguacggggcagccugugaguggauaaauaggccuccgaggcugggauggucccgggcccuguguccacggaucuuugcagcucagguugcaacgguaagaguauugucaaugagacaaaggaggugagagugccaguugucugaauugguugggauguuggucagaugacaucuaaaagaacacggccauuuuguuauuauuugguuagagacaaggucucacucugucacccaggccggggugcagugucacaaucauggcucacuacagccucaaccugccaggcucacgugauccuccuacuuuagccucucaaguagcugggacuacaggcaugcagcaccacgccuggcuaaguuuuguauuuuuugucgugacagggucucacuguguugcccaggcuagucugaaacuccugggcugacgugacccucuccccucugccacccgaagugcugagauuacaggugugagccaccgcacuuggccagaacacggccauuuuaguuccccuccuuagaggaguaaggccaggaaugagccuguggucugaaagccguggcuguugguuaauguggagaagggaagguggugagagccagcccaaaccccugccgagugagacugauucuggcagcuuuagggagcagggaugagccccucacaggcugggugguaguuagaggaggcagauuucagaaggccacgcagcgcucuuucucagcaggucaggcaggcagcagaggucgggcaggggcauggggucgagggcccgaugcugguguguucacuagaggagagccacaagcagggauucugggucaggugcaggccuagggcuuagugugcacuugugguucugagacugucccaugacuuccugccagcauuccggcagcucuagugggacucccuccugguccaggugaggccaccauugcugcccuggcuugcugcuguccucucagcccccagucugucaccuggugggaguuaaagggaccugcugggguuugaggaagcucugagccguucccuguacgaagccuguggucaucucaggcugcaggagacacaggagauacgagcuuuggagguggggcucucagucacaagcccccguuguuccucccuguccuccgcucacggcacugcuccaguugccggggccaggguucuuggagagcacauccucaccgcuguccccucugcuggugacagcacgcaguggaagcacucuggaaggcggucgcggaucuguugcagccggagcggccgcuggaggcccggcacgcggugcuggcucugcugaaggccaucgugcaggggcagguaaggcccagggcgacgcugggaugggugacgucaggcugcccacugacuguccugucccugcugggccguguuuggacuccugccucggugaguugcugggcacagggucuaggggcugaugggcucuggagcuggauggccuguggggucuccuggugucaugaggucugugugaccguaggcacugccuccucgccuguaaacagauggucacugcaccuuccucuuaugggauguucuggggaucauaugaggcaguucucgcagagugcugagaucguaccuggcagcugguguggggcuacgguguuguuuugcccuugcacccuuucggggccacuccccugcucacugcauuccaucugugcuggucuuggcugacccugaacacccaggccucuugguguuccugccuccccuggucggccacuucuacuccuucaugucccagcugcucagaagggccguccacucucacaggcucuccuggguuucccccacucaggccuuguccucagucucugagcacaaggcugucugcccugcaccgagugcaggggucgggcaggagcugugucauccccugcucugcgccacccgcugugccaggucccgacacacagcaguugcuccccauacgccgcucugcggucggccggugcauccggcccccugcccuguacaaugcugaugcugcagaccugucucuugcagggcgccucugugggaaggagagggguccagggcuggaguccgggugccccugcacuucagggacuucuuggcagccgugugggcgacgcuggcaggcucugcugauccuguggcuuuugucuuuagggcgagcguuuggggguccucagagcccucuucuuuaaggucaucaaggauuacccuuccaacgaagaccuucacgaaaggcuggagguuuucaaggcccucacagacaaugggagacacaucaccuacuuggaggaagagcugggugggugccaccuuggguuggagguuucucuggccuugacgaucaaguguaaccuggaugggaaggaccuggggcuggggaggggcugccguucucagggauggccugcagcggguaugcccacccugcuucaugcaccugggcucaccugcguggccggagugccccugaggcacguguuaaaaaugcagaguccuggccuucaccccagaccugcugacugugagucucuggggcuuggggccuccgaacaccucugcaacggcaggagcugggcgaguucugucacugggagguggugcugcugacuuggucucaaccggagcguacuggucccgucuuccuccuccuuucuccacuuuguggaccuuccuccugccauccuguggugggagguuuccauuagucuugggucucugugucaugauucugggaaguagagaaagaggaggaagagaucggucugacucuggcuuugcuguucugucgcccagaaaagggccucaguggcugggcugccugcaggacaggugccggccaggugccuaccgucagguuuccugucugaggugacguggccggcagccaagugugcacacgucuccuccgagccacucucugcuggggguggggaacgcccaggagucuggugaugucggcgucucccagccucggguugggcccugaguguacggcauacacacuucugcugccgccucggcacagacccucugugcagccccaggggcgguagauccuaguguccgugcguagccggccugcccugggcuccccugagccucuucgggcccagugcguggucugucuguugcugccgggggacugaugaugggguuucuggcagugacggguuuggacacacuguccugcggcgggagggggaggugagugggagauguagauucggcguccucgcaaacugccgccgcuucucccccagcugacuuuguccugcaguggauggauguuggcuuguccucggaauuccuucuggugcuggugaacuuggucaaauucaauagcuguuaccucgacgaguacaucgcaaggaugguucaguaagaaaagaauugagauccuguucugauaaugguccuaaguucagcuccgcagugaauaaaguugaaaccaccaaaaaaauagagguugggcugggcacaauggcucacgccuguaaucucagcacuuugggaggccgaggcaggcggaucacgaggucaggaguucgagaccagccuggccaacauggugaaacccugucucuacuaaaaauacaaaaauuagccgggcaugguggugggagccuguaaucccagcuacucaggaggcugaggcaggagaauugcuugaaaccggaaggcagagguugcagugagcggagaucgugccacugcacuccagccugggugaaagagcaaaacuccaucucaaaaaaaaaaaaaaaaaaagagaaguacguagcuaucuucuguuuagcucucaucugaugucuugguuaucuuuuuguuguuuguuuagaauguugcaugagcucugucucacucaugcugaacacccagcaccgagagcaguggcuggcgcacagcaggcaccugagugcuuguugggugggugggacccccagggaggaugagccaugcguguuauugacgucauagagugacuagaccacagcccgugguggcucggccauccaggcagugcugccgggacugagcucggugcucccugcaggaugaucugucugcugugcguccggaccgcguccucuguggacauagaggucagugccuccccuccccagggccggcccauuucacccugguuucugggaggcuggggcuuggggguugagcccugugugccaccugcuggcuguguagcccugggcaagcugcucggucucucugagccucaggagucccccauguaagucaggauagccgggcgccuccauguggagauguagcucaggguggaugacagcaucaaugacccacagugacagggacgucaggugcuucccacaugcccgcuugcccuguggcuuggagagagggugccauggcagcggggagagguggcagcgcaggcugaaggaggugggaaggaagccuggguguccucuccuguggggaggagcugggguaggacgggcgugagccgucucccucuccaccaggucucccugcaggugcuggacgccguggucugcuacaacugccugccggcugagagccucccgcuguucaucguuacccucugucgcaccaucaacgucaaggagcucugcgagccuugcuggaaggugggguuucugaaacugcucuggaagguuccugagagcacauggaugggacaagggccauccugucucccaugaaugguugucugauucuugggguggccagacaauggccuguugagggacggccagugucauuuucccaggcaguugagcugaggucaggguuuugguggcauuuugagaacccugcugccucugucuuugggaggagaugguggcgagcuggccggaccuuggguggcuauagggcagcagccaggcggggccagcagcgggacuggggcugggggcagggcuuaugccugccagccccugacacgcauugugucucgcagcugaugcggaaccuccuuggcacccaccugggccacagcgccaucuacaacaugugccaccucauggaggacaggugagugugguggguggggcgcagggcaguggaggccagcacagcccucggggcagcuccagugucccuugccaagcacacacuggcuuagagaguccuuguccucucgggcagcuguuccagaggcugccacuagagcgaggcccaugacuucuaggauccagccccuguccucuccuuccucugucaguucaacagaauauccacacccagcucagugccugccccaugcucggacguccuccagcggugcuccccaacuacuuagccuguuacaaggcgaggcucggggucuuggcuugacguugcccuugcccucacccccacagccaggcuguggccacuuuuguugcuuuagccauuagagauggcucagcucugcccacacccuggccucccacccaugcugccagcucccccuccugcucuccuguauccauccgcgccuccugaagcccacuccaugcagcacccggguggccuuuuucugacacagauaugucggugucacccuuugcuggaagccaggugguucccagcgcccuugggauguaggcuucuccuauggaaccaggcccuggggccagcccugccucagcccugcaucucucccagcccugccucggccccugcaucucucccagcccugccucggccccugcaucucucccagcccugccucggccccugcaucucucccagcccugccucggccccugcaucucucccagcccugccucggccccugcaucucucccagcccugccucggccccugcaucucucccagcccugccucggccccugcaucucucccagcccugccucggccccugcaucucucccagcccugccucggcccugcaucuuuccuucccuccauccuuggaaccaggcccuggggcccagcccugccucagcccugcaucucuccuagcccugccucagccccugcaucucucccucccuccucccguagaaccaggcccugggggccagcccugccucagccugcaucucucccagcccugccccacccccugcaucucuccuuuccuccaucuugccuucuccccuccaccaagggcuugugcaugcccugauuccucuugccagcagguucuuccaccuuugccgaguuacucuguuuacugaggucuuagcguggucacugacucccccaccucccugaguaguuuuugcuguggcuuuccuucuuggcugugauuggaggaagagauuuugcguuuaccugggagauuauguggcuggcgccugucucccccagacugcgaggcugugggccaucccucuugccugcuuccugucccuggcaugaccuguagcucacagcguggucagcagugaugggcugccgccugugcgcaggagugaacaagaguguuacugcuggccucuguucccugcccuuccccagcggugcuccugccccccccaagcacagggaccucuggggcugcugcaggagccucggcaaccucacacauccauggcggacccugggacagggcccugcucacauuccgucucucuggggaacacuuuuagagccuacauggaggacgcgccccugcugagaggagccguguuuuuugugggcauggcucucuggggagcccaccggcucuauucucucaggaacucgccgacaucuguguugccaucauuuuaccagguaaggcgguuucugugugcagugagcuggcaggaacgggagagcuccccucacgccugcccacccaucccacuggggguccugcugcgggggcugcgguggcauuucuaggccuuuccaggcaguugcuuugcagcugggggugagguuuggggcccuuuguaggcuuuagucuuuuuuuuuuuuuugagaaggaguucugcucuuucugcuuggcugacugcaaucuccgccucccggauucaagugauucuauugccucagacuccugaguagcugggauuacaggugccugguaccaugccuggcuaauuuuguguuuuuaguagagacgggguuucgccauguuggccaggcuggucucgaauuccugaccugaagugauccacccaucucagacucccaaagugcuaggauuacaggcgugagccaccaugccuggccaaaggcuuuuuucucucucucuuuuuuuuuuuuuuuuuuuuugagacagaguuuuacucuuguugcccaggguggagugcaauggugcgaucucggcucacugcaaccucugccuccccaguucaagccauucugccucagccuccugaguagcugggauuacaggugccugccacagugccuggcuaaugguuuuuuuuuuuuuuuuuuuuuuuuaaugggacagaguuucgcucuuauugcccaggcuggagugcaauggcgcgaucuuggcucagcgcaaccuccgccucccagguucaagccauucuccugccucagccuccugaguagcugggauuauaggcaugggccacuacacacagcuaauuuuuuauuuuuaguagagacuggguuucuccacauuggucaggcuggucucaaacucccgaccucaggugauccgccagccucagccucccaaagugcuggaauuauagguaugagucaccgugcccggccaaggcuaauguuuuguauuuuuauuagagaugggguuucaccauguuggucaggcuggucuugaacuccugaccucaggugauccacccgccuuggucucccaaagugcugagauuauaggcaugagccacugcgcgcagcccaaaggcuuuauucucaagcaaaccuuacaucuugcgaguuucaccuucuggaguuggcaguggaggggugaacgcugccucggggguagccguucucuugcuguuggcggcucuguuuugucaagugcuggucuuguccugucucugcaaugacgccguggcacagacgcuggugguacagcuucaguuuccgcagugccccgugaugacagcgcuuuuuguguccguccucguucugugcucacagcucccuggaggguggggcgaucacgucguccugguuuuauagugaugagcugcggugugggucacagggcucuccugauccucugcucuuccugcuaccccccuccccguaggggcgguggggggauguugucuuugugcacagcuugcagccgaacucagggcagcuuucaguugcugcugggcuggcccaccgggugcccaggauucaguugcuggucuguccgagucagggacuuugcaggcaggcauggggguggggcccgucuggguccugacugugcuggagcauguagaaaccccuccugggcgccccaccugcuguuucugcggccccugauaaacguguggugggcacugcgcgcucaggcgugcuacucucggucccaagggugacugggagggcgucccacagcaagcaagcagcucugacccugugugcuggccgggcucguguuccaggccauggcauguccgaacgaggugguguccuaugagaucguccuguccaucaccaggcucaucaagaaguauaggaaggagcuccaggugguggcgugggacauucugcugaacaucaucgaacggcuccuucagcagcuccagguggggugggggcaggagcuccggggagcaccgggaacccagacaggcaggcucggcccacucagaagaugguaccuugggccccaucucugggggucccgcagagacugccagaaccguguucucuggugauucgcaguggcgcucauccaccuuccaccggagacaggucugauuuuuccagacguggugcaucguuuaggccccagacaggaauaugcaguaggugagccggggcugggccagugcuguccacaguccgcagagugaccugcaggccgccuucguggccugagugggccccggcacaguucccagagggaugccaguguggcuuccgcaugacuuuggaggaccgcauuagucgagucuguuaaccacagcuuuaaggaggacuccacggccacacgggcucaucagcauaggggcccuggggaggcgaggcuaguauccagcagccucagggcugugccuuuuccuggagccuggggcgggugauguacaggaggccaggcagcagaagggaggccgggacuucgccgggacuuagcagggacugaaguccucucagagccugucgcugggccagagcauugcccccgaccgcugguggcaguggcagaggucauagccuggggcuucuaaaagaggcuggaccugggagaggcaagaaaggcuuguaguuguggcuacucuuggcccuccugcccgagcuuccuucuuggcccagcugcaugggcacagccaagauuccuuggggggugggguacgggcaggaacagcagcugccaucacagccacuguggccccuugagaggaucugggggguguccugggccacgugggucaggguggccccuggagaggaucugggggugucucaacccaugaggcccggagcggccucagagggcugggggcgucuguccccaugcggcccagagcggccugagagggcugagggugucuccaugcgguggguguguagcgaggccucuggugccaaguccauguggggaguggaagucagccugugucaucgugccugguacugcagaccuuggacagcccggagcucaggaccaucguccaugaccuguugaccacgguggaggagcugugugaccagaacgaguuccacgggucucaggagagauacuuugaacugguggagagaugugcggaccagaggccugugagacccccuccuggguggggccuuugggcuuuggcugguggggaggggccgggugcugggugaagugcagcuuucugagccucagaagccaagggccaggugggcgccugcuuuccagguuucugcacucggcagggaaggcuggcaggcacagcacguguuugguaacaagcucggggcuagcccacccaucaguuuccucccaccuguguggagcaagcuuccauccggcucuguagaguccuguggcucccaggcggccgcagucauuuugccaggaacacucagcuuagggcccaggcuuuuccauggguuuggacacaagucuuccccgcugccaggagugccuuugugucugggcugugggcugcaggcugugaggcggcugggcucugacagcaaaccagccucucgaccagcagcccaguguggagaaggagagcgccggaggggcagaggggcaacaccggcucuucuuuugacaggaguccucccuccugaaccugaucuccuauagagcgcaguccauccacccggccaaggacggcuggauucagaaccugcaggcgcugauggagagauucuucagguaggggguccucuguagccuugccuggcaccuggagccuggcccugucucugucuggggcccacccgggcugggucucaggaugcccgaugagcagggcccuccccucugccucuggagagcccuggcucugggugagcaggugcuagcuugcuuuccaguccagcaggacagguccucucaugacgccacugggcucccucuuuucgggggucgucuggagagaugcucccugggaagcagagcucugugcccugugugccuggccgcgggaggacccagagucgggcuggccugcgccaggcagacgggcugguguggggcuguggccgggcacuccccacccgccccagcaggcugccgucccgcaggagcgagucccgaggcgccgugcgcaucaaggugcuggacgugcuguccuuugugcugcucaucaacaggcaguucuaugaggugcguguccaggcggccgcagcugggggcucagggcuauuucuccgugggcgggcugucucuguugugcacgugcucccgcagagccgggcucugccugggacuucgguccugccggacccucugcagcccccagcguggucuguuuaccccuguucauucacuggcuugcucguccugggugccucugccaggccuugacacguggccaaguagcaaggaaggcacagugccugcccucagggagcuccggccgguuuucacccaacacaggagccucuuaaaaauucugugugaguucguuucagccagucuugcauggggacauugucuuccguuucaguccugacguucacccugugcaccugcgugaucgccagcccugccuggucucuccucugcgggcucucccucuccacucccuccucugggagcucuguggccccaggcccaccuuccuugagagacauuugugugccugccagucauaccccuuucccaggaggcgcagcuuaggcucugaggcugucccuucccaccgaacuccucccugcagccucgcaguccugcccuccugagagcugcccacucugcuccucuccccagcguccacuguccuugaauugcccuuugcugggcauugcgaucccgcauucugucugagggagcuaagggccuccuggaaguuccucuggguccucuggcuucucccaucagggcuggucuuguccuggucucuguuccuguggaacuuuuuaccugcuucugugaaaacucacgcuguccucagcacagcacgcacacacacgcauauucacgcaugcacaggcacacacgugcacaugcccacgcgugcacacagccacacacacccucacgcacacacgcacagcaccaugugggagggguucucggcugugacagugaagggcagggccucaccucggcugcuccuugugaguugugggccccgugucugugcccggccgcccugcggugcucaccagccuucugaacgaggagcuggacaggaucccuggaaggggccccggggucucugagucgcgcucagcgggugcuugugcucucugcccagcugugcugaagucccgagggacauguccgcugcuugcgggucgguuccugaggaauuggaagugucacgagauguggcccucguugggcuggcgcucauuggccucccuugugccugugcaggaggagcugauuaacucaguggucaucucgcagcucucccacauccccgaggauaaagaccaccagguccgaaagcuggccacccaguugcugguggaccuggcagagggcugccacacacaccacuucaacagccugcuggacaucaucgagaaggugagagccguuguacccggggccgggugcuagcgugccagagcuccgugggcagcaauggccucugggcccucuguccuccucuucgagugaccggauggcuguguccguaggugaggcuccccucccugcagggugggugucccgaggccugugcagggccugccacugcuggauuuguguccugacugaaaguccuggacauggguguccugucacacucugggacagcugggcugggccuccuggaccgacgcuggagcccagaccuggggcuggggcuuuggccugccguccucccugcccagccaacagcuuugcucuuugauuuucagaugcauuuugguuucugcacagucacucggguauaaagggcaucuuugcuuuugagcaauaaagaugaaggccgggcacaguggcucacgccuguaaucccagcauuuugggaggcugaggcagguggauugcuugaguucaggaguucaagaccagccuggccaacauggugaaauccugucucuacuaaaaauauaaaaauuagcugcacgugguggcgggcaccugcaaucccagcugcucaggaggcugaggcaggagaaucgcuugaaccuaggaggugaagguugcagugagccaagauucugccacugcacuccagccuggacgacagagcaagacucugucucaaaaagaaaaaaaaaaagggccgggcacgguggcucaugccuguaaucccagcacuuugggaggccaaggcaggcggaucaugaggucaggagaucaagaccauccuggcuaacacggugaaaccccaucucuacuaaaaauacaaaaaauuagcugggcgugguggcgggcgccuguaguccuagcuacuggggaggcugaggcaggagaauggcgugaaccugggaggcggagcuuguagugagcugagauugugccaccgcacuccagccugggcgacagagcaagacucgaucucaaaaaaaaaaaaaaaaaaaaaaaagguguuugugguagaaaguguucucacggcugcugacucagaaccaugagccuguguguaaguccuggccuucucuucaaaggugauggcccgcucccucuccccacccccggagcuggaagaaagggauguggccgcauacucggccuccuuggaggaugugaagacagccguccuggggcuucuggucauccuucagguggguguucugcacgaggccucugcucccggggcgcgcauggcuagcguccaccagcugcaucugcguuguguuggagucuguuccccagcgggacccacacccucccuggauuugcugagggugcgguggucucagcaggcagcagaaccuuccuccugcucuuguggagggauggaugcaagaggccccguuguacgcccugaccagagcuugucucugugcuccugagucagggccggaaccauguaccauccucagcguggcgcuugcccucgucacccagcacagcaccugggaaguaaggguggcccuccauuccugcccugcaguccguuuaauauuugcagcuguuuuguugagauuuaauuuacauaucaugcaauuuacccauucacagugaacaguucagugguuuucaguaaauucacagagcucugcagccaaccccacagucagcuugagaaccuccugagcauaccaguagcacacgcucccaucccccguugcucccguacccccggguaccaucaagcugcuuccugucucuguggauuuaccuacucucaacauuucauggaaguggaaucacacaaaauucauccauaagauguuggaugguagaacaguuuccugucugcugacuggauuguuccacccagcgccauguguccaggcccguccaggcuguggcagcuguuggugcuccccuccuuuucauggcugaguaguauuccaucaucuggaaggagcacauuuugucuguccguuccuccauugguggacauuuggccuguguccgccuugcagcugcggugaguggugcugcugugaaccuucuccuacgagggcuccgccgggccugcauuuucacuuuugggucugcaccuaggagugaauuguugggcccuagguuuagucugcauuugguguuucaaggcgauaccaggcuguuuuccacuggugcugugccauuuuccauccacucgagcagcauguaaggguucugauuuaucuuuuuuuuuuuuuuuuuuuuuuuugauacagucucacucugucgcccaggcuggaguggagugcaguggcgcgaucuuggcucacugcaaccuucgccucuuggguucaggcgauucuccuaccucagccuccugagcaucucguauuacaggcaccugccaacauacucggcuaauuuuuuguauuauuaguagaaacuggguuucaccauguuggccaggcuggucuugaacuccugaccucaggugauccucccgccuuggccucccaaagugcugggauuacaggugugagccaccacgcccggccugccucuacuuuucaaagccucacagcaucacuuacgugugacugucagugucaguaucguguaaaauauaauguaugaaucaguuugcucaaaagcucauccuuaagauguuggaugguagaacaauuuccugucauguuuauaugucauggguuuuuauuucuugccauggaaguugaaaguggugaugauuuuuuuuuuuaauuaauuuuuugagacaagaucucacucugucgcccaggcuggggugcagugcugugaccauagcucagugcagccuugaacuccugugaccaagugaucguccugccucggaggccucccaaguagcugggaccauaggcacacgucaccacaccuggcuaauuuuuucauuuuuuguagagauggggucuuuauauguugcccagccuggcaucaaccuccuggccucaagcaguucucccaccauagccucccaaagugcugggauuacaggcaugagccaccacaccuggccgugguguuugauuaaaaaccaggcaucagccgggugugguggcucaugcccguaaucccagcacuuugggaggcugagguggguggaucaccugagguugggaguucaagaccagccugaccaacauggagaaaccccgucucuacuaaaaauacaaaauuagccgggcgugguggcgcaugccuguagucccagcuacucgggaggcugaggcaggagaaucacuugaacccaugaggcagaggguacaguaagcccagaucacgccauugcacuccagccuaggcaacaagaaugaaacaacgucucaaaaacaaaacaaagcaaaaacaggcaucaccuccuuggugucucauccacaugagcaccaugcucuuuacugacugguugggaaggggugugcugggcugugggggccuauggccugggagaacugagaaccuuucugcuucugcagagggaaggaaagagguucuguugcccuuacuuggaacuccagcccuggaggccugagggucugggcugcagaacugagauauuuccuaguugaggcagaguccugguucuggcugcuuucauuucuuuauuuuuuugagauagagucucaccacuaugucacccaggcuggagugcagcggcacgaucucaccucacugcaaccuccgccucccagguucaagcaauucucuugccucagccuccugaguagcugagaugacaggugcgcaccaccacaccuggcuaauuuuuguauuuuuaguagugacaugguuucaccauguuggccaggcuggucucaaucuccugaccucaagugauccacccaccccagacccccaaaguguugggauuacaggcgugagccaucgugccuggccuguuuucauuucuuuuguuauaauugaaaaguaacacaguugacucuugaacaguauggggcugggagugccagccccugugcaggugaaaauccccaucuaacuuuuaacuccccagaaacuuuaccaacagcccucuguugacuagaagccuugcugauagcagacagucuauuaauguacagcucguguguuuuauguauucuguguuuuuacagugaaguaagcuagagaaaagcaaaugcuguuaagaugcuaggcauggugacucacgccuguaauccuggcaguuugggaggccgaggcgggcagaucaugaggccaggaguucgagaccagccugaccaacauggugaaaccccgucucuacuaaaaauacaaaaauuagcuggaugcgguggugcgcaccuguaaucccagcuacucgggaggcugagguaggagaaucacuugaaccugggagguggagguugcagugaccugagaucgugccauagcacuccagccugggcgacagagaaagacuccgucucaaaaaaaaaaaaaaaaaaaaaucauaaggaagcgaaaauacauuuccuguuccuuaaguggaaguggcucaucaccaaggucuucauuguugucauccucauguugaggggacugaggaggaaggagaggagacacauggucuugcucucucgggugggagaggcggaagaaaauuggcauguaagugacccaugaaggccagccucgugcuguucgagggucagagaguuugcacaauggacacggugacaaguuugauuccccuuuuccugccugccuagugggcccggcagggcggcagcugcuguugguuccauguggccuucccagaauggggggugccaggcacugugugaacccccaccuccaccucuuuuuuguccgaggaagggauguugcuuuuaugucauaauauuuugagaugaggagaaacuguuaaucauuuaaucaucuuuuuuuuugagauggagucucgcucugucgccccagcuggagugcaguggcgcaaucuugguucacugcaaccuccgccuccuggguucaagcgauucuccugccucagucuccugaguagcugggauuuacaggcaugcaccaccacaccuggcuaauuuuuuuuuuuuuuugagacagucuugcucugucgcccaggcuggagugcaguggcacgaucucggcucacugcaagcucugccuccuggguucacgccauucuccugccucagccucccaaguagcugggacuacaggugcccaccaccacgcccggcuaauuuuuuuguguuuuuaguagagacaggguuucaccauguuagccaggauggucuugaucuccugaccucaugauccacccgccucggcuucccaaagugcugggauuacaggcgugagccacugugcccggccuaauuuuguauuuuuaguagagaugggcuuucuccauguaggucaggcuggucuugaacuccuaacuucgugauccacccacuucagccucccaaagugcugggauuacaggcgugagccaccacaccuggccucagucauuucuuucaaugauuuuuuaaucauuuaaagguguuaaucauuucuuuaaaagaauaacaguguaaccacuuaccuccagagugcugcaaagggucccucaggccagauuuccccuggcuccugcuggccucggccccaggguugcuggaggcaacagaugcucuucacaccuugccacacgugucugggaggugcccuugaccuuuugggaggggcugccuacaccugggaucgcccugcagcacacacuccccgccccauucugcccugucugccacgcagcuggagcuucuccauugaauggacucuuccucaccuguugaugacugcccugaugaugagaugggcacgagguuggguuuuacuuuuugcugcuguggagagagaguccuggugguccuggguuugaaggucguguguuuugaagcacgcacucuagagcagccgccccggccccugcuccgggacaagggugcugucuuaggacugcguuuucaccuccugcgccguggugagcugcguccucucucugcagaccaagcuguacacccugccugcaagccacgccacgcguguguaugagaugcuggucagccacauucagcuccacuacaagcacagcuacacccugccaaucgcgagcagcauccggcugcagguaugguggcugggguugcgcagccaguuccugggggcccagccagguauccccgucucggcaggugugguuccuggaagcugcagagacggccccaggauggggccucagcugaccgucccuccucugcacccacuguggccgcagccuccccaguccugguguccuucccucugccugcaguccacacaucuguggcuugucgcucuaagccgcacggugacauggguuggggcagagaaaaggacgcacggcgacuuccggggcagugcauggcccugacgcuccuggugcugcagaaucugugaaggaccugcagcagagggcugggcaggugggcggcacagggcagagcugagagggcagagcugagacggcagggcagggcuggagagggcagagcugagagggcagggcagggaugggcagaacagggcuggaggaguuucgcugaguuugcgcuauagauguuggcaccaggcugagcagaggugacugggaugggagcccucccuccuagagcaggugcucucuggggccaccccuguggccucagaguccuguucagccugucgauggaagaaguggcagggcugggagcugagcuccgcuuucuggcaguugggggcguguggugcugccagaggagcgaggcgcccaucccuuccaucccaggcgggcccagcuguggugguggggacaccaggcucugugagcuccgaggcaagggagggaggaggcugugggugcugggccuccggugucaccaggacagagccugugucuguguugggaugugggugugugcacaucagcagguggccuuuucugagugccuguggugcuggacgugggucugagcaggugggacgccgccuguccugggccugcacgagcuuggcucuggcuuucaccauccucuuccugacaggccuuugacuuccuguugcugcugcgggccgacucacugcaccgccugggccugcccaacaaggauggagucgugcgguucagccccuacugcgucugcgacuacauguacgcgggaccucgcccacggcccaugaggcucagggcgucagaggcgcuggggcugugguggcgcuguuugcaugucugagggaugucccaggguugggaagagccaagucuguuccguuccugcugcggggacuuggccucagcugcuucucuugcuucugcagggagccagagagaggcucugagaagaagaccagcggcccccuuucuccucccacagggccuccuggcccggcgccugcaggccccgccgugcggcugggguccgugcccuacucccugcucuuccgcguccugcugcagugcuugaagcaggugaguggggccgggcagggaccauccgucccacguugggccaggaggacagggagcugccaccugccugcugggccucccucccugucuggccuguggagggcagcccucccucagagcugagccuucccccuuccccgagcagcugcagggacagaggccugcgcugggcaggcucccccggcugagaacagggcuccauagcccuugacgcugugcagccacaaagcagagccucagaugcuagcuuccgccucugucucuaggguccagaaggcccuguccugacgccuccucuccucgcaggagucugacuggaaggugcugaagcugguucugggcaggcugccugagucccugcgcuauaaagugcucaucuuuacuuccccuugcaguguggaccagcugugcucugcucucugcuccaugguaccauggccggccugggguuggggugggggacccaguaggguuuuuccccaaaagacugcgagccucugggcagagcgagugagacccuucgggcucgggcuccauuucccucaaacucagcugcacucuggagcgcagauugugccuugggcaggguggagggaccccugccccagcucgcagcuuuugggacugacgucagagguccccagccaagggcaugucacugaauguggaugucucccaucugugcuuuuccuaaguggggcucccgugccguucaccucacauuccugguguguuacuuggcaggcacucccaccacuccgaaagggaggcccuuccugggagggaggcaagaaggcuccccagccccuuugcccccuuuccugggccugcguucccagggccuccccagccccucuggcuaccccgugaccuggccgcuggggagagguuucaugccuggauuuggucaucagcuuucaggcccaaagacacuggagcggcuccgaggcgccccagaaggcuucuccagaacugacuugcaccuggccgugguuccagugcugacagcauuaaucucuuaccauaacuaccuggacaaaaccaaacagguaggaggucagagcaggacaggcgagcuugauggggccugggauucgagggccuggcccagguaggccccacauuuuucucauaaacgaguuucugccaggccagggaugagugaguuggcucugcuucccuggguggcugccagaugcccagaguggggacauccgauucccuggugcuucuagcucucuuuggggccugggagccauccaguguucccuguccaccccggacagcaucucugcucucuguagagcguugccuggcuuguuccugcugucccaagggggagguggccaugccgguugguggagcugggcugguucugaggcgcagggugggcaggccagagagucuggcuucugccucccuccacgccccaucaggugccggaaacugucccuucaccugcgaucugccucgcccccgucccagucgcauucuuccacaccucucuuugacauggcccuccgggacgaggagcugguguccuagagauucuggccuccgcucagggccaugcccgccaggagaugcugacucugaggcuuggcccaucugugccccgggccucagcuucugaugguggcccuguagggagcuguuguuggguucccaucccucaggcucagccccacccuguugggccccuucagccccucugagaggcucacuggguccucaugggucuugccucaaagcauagccagccuugcugggcugcagguucugaggccuuacuggcccacaguguauccgaggggugaggccggcuuugggaaauggaagcuguucccgggacacugccuggcaggccaucuggccccgggcucugccugagcuccgcucaucuucugcuguccucauggaagacacugcccaggguuggugugggaucugguggcuuggccacuucaggcagcacugccccuugcaacagagccagccugugaagggcccagaaccaggggaugagagcccagcaugucuggguucuguuggccugugggaucgugucggaaugcaacugaccggagcagucugcugugcagagucugcucggguagcucagcacugcuggcucugccccacaggcauucagggacuugcuaagccucggcuguucucccgguggagcacucgagguuggcgagggguaggcgaggcugccucugcugcaagcggguggggccugagguguccugucuccugcagcgcgagauggucuacugccuggagcagggccucauccaccgcugugccagccagugcgucguggccuuguccaucugcagcguggagaugccugacaucaucaucaaggcgcugccuguucugguggugaagcucacgcacaucucagccacagccagcauggccgucccacugcuggaguuccuguccagugaguccccgcccugccugcgcaugcacccgagagguucgggcuguguaaccugugcgggcuucucuggugcccucucucaggacuccuuggggaaccugggugucucgccuucugcugccucagggccugggcgucucugcccggcugccaugagugcucuccuuccuggcuuugaggggcggcuccucucaccccucuaguguccaugugaacgcuccuccuugaagaagccucuucccccccgagcaguggcccuccccugguuuugggccuccucucuguccaacagagcacacgccgcuucaggggggcuuuguucgcuucccccagacugugacuucaggagcucaggugccugucccuuccccucaccgccugugcgcaucugggcaggcccucaauguugagauggcagaagggcacugcugggcccgcacuugguguagaggcuggagagaagaucgugugugcuuugugggccacaugcagguccugucggucuuucuguuuuguugauaacccuuuagaaguguagaagccuggccaggcgcgguggcucaggccugucaucccagcacugugggaggccgaggcggguggaucaccugaggucaggaguucgagaccagccuggccaaccuggcgaaacccugucucuacuaagaauacaaaaauuagccgggugugguggcgggugccuguagucccagcuacucaggaggcuaaggcaggaggcaggagaaucucaugaacccaggagguggagcuucuagugagcugagaucacgccaccgcacuccagccugggcaacagagcgagacaccgucucaaaaaaaaaaaagagagaagugaggccgggcacgguggcucacgccuguaaucccagcacuuucggaggccgaggcaggcggaucaugaggucaggagaucgagaccaucuggcgaacacggugaaaccccgucucuaauaaaaauacaaaaaaacuagccaggcgugguggcgggcgccuguagucccagcuacuugggaggcugaggcaggagaauggcgugaacccaggggguggagcuugcagugagccgggaucgcgccacugcacuccagccugggcgacagagccagacucaucucaaaaaaaaaaaaaaaaaaaaaaaaagaggugcggaagccuuuccucacggaucacacaaaugguaggcgacagcucgaauuggcccagaagcugugguuggcuggccaugggaccgagaguugaggccagggucgggaaagccacguccguguggccguggccuucucuccucugcagcaccccaucgcugccgugggcagagcagccguguuggccuucagaggcgcugcacgggaccccggcuccccugaccacccucuccauuaccgcagcucuggccaggcugccgcaccucuacaggaacuuugccgcggagcaguaugccaguguguucgccaucucccugccguacaccaaccccuccaagugaguggucgccccaggcccugugccucccagccguggcccccgcuaggccuugcggcagaaagccccggcagccuuuguccccaaggccugagcgccucgguuuuuugcacuucaugcccuggggauguuucccugcugccaggauggagugccagcccccuucucaucucagguuuaaucaguacaucgugugucuggcccaucacgucauagccaugugguucaucaggugccgccugcccuuccggaaggauuuugucccuuucaucacuaaggugggcucagggccggugaaggcugugucucucgguaggccagggcuugcuuugcccuuggcuguccauggucgggcagagugacaggcagguggagggcagugggaggguguuuggggcugugccuguggcgcugggggcucugcugggcagccugcagggcuuugaugcgcggcaggcauugaggggugggagcugggugccgccgccuugccccuagccugcagcuugucccuggccagggggcacccggcaggccuggugagggccuccagcccccauugccaccccucacugucugggugugcucacucugccagggccugcgguccaauguccucuugucuuuugaugacacccccgagaaggacagcuucagggcccggaguacuagucucaacgagagacccaagagguacggccugcgggggugugccuggagucggugugggguggggaaggacauggggcuguggccugccugacggugccuccaagucagugaguggaaauggguccugugugcccuggaguaugugaggcagggcaggaccugcaagggccgcuaacaccccucagccccucagcagguuggccgugguggccuggguccgggcugcgugugccacgggcaccuacuuguggaauuggggguuggggugcaagcuuuaggcgccugagccccucgaaggagccggccuugucuggggcugcccccuccucugcagcccccagccugcugcuagccggggacucugcuucaucaccgccgccuugccggaccgcaaagagcugagccagccucuguguucuuguuugcauuucauuugaacggcuuucuccuccugucccccaccuuccugcccgagcuauuuuggcuuucccuagaugggaauacggcauuuuccagcgugaccucaacucggaagcuguugucuccagccccugggggccgggggccaagcucggccauuacggccagagacuacuuucuggggucuuggucucuuuuccuagugaccuucagggccuggccacugaggccucagugccgccucggucagagcugggcggugccugccuuccgcgggugggugggauugccuggccagcacagccuggaaucugccgugggggugacccacacacguuuaauuugcacugacguuguuuguuuuggugucaugcgugaagccuuacuuguucucagucauguuuaccagacguauuaucaugcauuuuuguuuucugucucuuccccgcuaacugcccuuuggcauggcucuuuuugcucaucucacccgcgggaucucuccauccugacccuguggccugggaccuuuccuccucaccccuccacuggcuuguucuccccuucccgggagcugggcucucuggggcguuggggcuccuuccucacccgauagucugaggauagccagaccccccaaacaaggcuugaauaacucuccacccgugaaagaauucaaggagagcucugcagccgaggccuuccggugccgcagcaucagugugucugaacaugugguccgcagguagcgggacugucggguggggggcacggacccuggagcuuggccccgugagcaccuggguggcagugcauggggcugcuugcaugaccucaucgucugcccguguccucccuggccagcccagggggagccggugacgagggguggaaagguugcauucuguccccaggccccguaugagcacgggcugguugcacgcauccccaggcccccucggggugccgcuccgagagagccaggcgugccgggcagcagccuccccaggcuguccccaagggccgcaguguggguugggggagacaccacuccugguuuuggccuuuucguauucucuagaauggacguuuuucuucgggcuuucuucucaacaagguuuauuuuuuguuguagcugaaagggaacaaggggcauuuguggagggugcugggguggggcagccugggagggccugggugggggcuaggauccugcagggcaugggcaugggccugggccccaggccauggucuuaguucuccccgcagugucugggugcaggugugggcucucgggcucucggcugucaccugccugugggucaucgcugcuggcacuggcagaggggauaccugucuccuccuggaagcccguugcaggccaaggggucccauggcccucaguccauccaccuccucaccucaggccggccucugcugggugggacuuggccagggguuggggugguagaggugcucggugaggcuuaaagccauuuucuagcacauucuguaucaugagcaaaauauugccuaggggcuaugaaauuuguaucagaaugaacucccauaagccucuucccugucacuggguguggagcucaggcagccgcucgccugccugagggugacgguggaaggccacauggggaucccagaccucugugugcuugccggaggcagccugcgggcagaaugcaaucugggccugucuguguggccuccgccucucugcaugacuacaccguuucgccaggaggccguaaccuagugcucccgugggcuucggugagggggaugucggucucuagccuccugagucugcuccgaccaguaggccuggucuuccccacccagcgucuccccguucucugggacaaugugguccacgugauucucaagcugaggcucgcugggccgcccacgcccuguuggggucuuuccgagcgagguccucagccgugcaugcguugagcuuuggcccuuggugauagguggcucggcccgcccuaccuggcacccugacccuggucacggccucucccuccagcaggauacagacgucccucaccagugccagcuuggggucugcagaugagaacuccguggcccaggcugacgauagccugaaaaaccuccaccuggagcucacggaaaccugucuggacaugauggcucgauacgucuucuccaacuucacggcugucccgaagagguccaggcggcacuacagggcugggcgggccugcgggagcuccacgggcaagcuggguuucacgcucccugucuucuaggucuccugugggcgaguuccuccuagcggguggcaggaccaaaaccuggcugguugggaacaagcuugucacugugacgacaagcgugggaaccgggacccggucguuacuaggccuggacucgggggagcugcaguccggcccggagucgaggugacugcaccuuccuuuccuccgcgccugccagccucgacaccggcugucccgagcccaggcccacguggcacccucguaccagccuggggacuaaguccacccugugcgugggauucucuucucagcuccagccccggggugcaugugagacagaccaaggaggcgccggccaagcuggagucccaggcugggcagcaggugucccguggggcccgggaucggguccguuccaugucgggugagccuuggccccagccaccuccacacaggcaccggggcucccucaguugcugcuggucccaguguucaggaaggccccgagcccaggggccgggguggcuggcuucaggcccggcccacguccugacucuggggugagccuuccacagcucaccccagagccguggagugguggaguguggcccgcuugcugcagaggggccugcucugggugcugguguuuccugcggguuuucagcucggcucaguccuggagcccuucucugcuccagcgagccguggucugacugcaggacagguucugggucccucccuguggcccuggguucacugaggccagcacuguggugggccgugccccaagggcagagcugccaccgucucuggcugccuguggcacuagcuugccaggcucggggggagcauucagcuugaggcuggugguuuugcaucagguaagugguggucaccaguccucugcccucuucuucagggggccauggucuucgaguuggcgcccuggacgugccggccucccaguuccugggcagugccacuucuccaggaccacggacugcaccagccgcgaaaccugagaaggccucagcuggcacccggguuccugugcaggagaagacgaaccuggcggccuaugugccccugcugacccagggcugggcggagauccugguccggaggcccacagguacugggcggggcuggccugagcgccaucuuucugccagucacccacagagcuguggacacucaggggcgauugcagacuuggcccucuugggauauuuggggguaacuuuuguuuuuuuuuugagacagagucuugcucuguggcccacgcuggaacgcaguggcgcaaucucggcucacugcaagcuccaccucccggguucacgccauucuccugccucagccucccgaguagcugggaccacaggcgcccgccaccacgccuggccaauuuuuuuguauuucuaguagagaugggguuucacuguguuagccaggauggucucaaucuccugaccucgugauccgcccgccuuggccucccaaagugcugggauuacaggcgugagccaccgcgcccagccauuuggggguaacuuguaagucuccagaggugagcugugaggggcgauccagguggcugagguggggcaggggccuguggcgaaccaagugacuuccauggcagagaguugcccuccccgccuggaggcugcaaguccgagaccaaggugcuccucggcaggaggugcuccucagaggccucaauccuuggcaugcaguugguuuuuucccuguguccucacaggcucuuuccuggaugucugcguguuaaucuccucuugggaggaaaccggucauggcuuaggguccgcucuggucccuugcuagccguaauuagcuuucugaaacccagucuccagagacagucccguucugaguuccugggguugggacuaaagcauaccaacaugggggcacagcucagccuguucccaggggcagagggagcccccgcagaggcccagagcccagggacagagggaggccuuugcagaggcccagagcccaggggcgccugggugugccguggcugaggggugcaaagaguagggguuccagcccucguggaggccuuggguccggacugugaggcugugggcuggaggccgcugcucugaggugccuggcggagccuggccucgaggcaggggcugagcggggcagcaggguggguggccgucagagcagcgcuggcuccgacaucgugguccugaggauugugggagggagcaugagggcaaaaccagggcccaggccaggaggccccuggggggccagagauggguaaggggagguacuggccucaggccaaaggugcugccgccuccgcagggaacaccagcuggcugaugagccuggagaacccgcucagcccuuucuccucggacaucaacaacaugccccugcaggagcugucuaacgcccucauggcggcugagcgcuucaaggagcaccgggacacagcccuguacaagucacugucggugccggcagccagcacggccaaacccccuccucugccucgcuccaacacaggugaguggcauggcgggccuuggcacgggcucugcucccacuggccuggugcucccggugacggcaauguggcuccucucugcugagggcgcccacacggcugggaguggucccuggccugccucagcaccauuguucuccgguguuugggaggaggcugacccgugggaggugucugcccugcucaggaagcuggggcuggcagcuucagaagcaguaggggcccuguggagccucugcccagcauccuccguggggaguccagcacugcgggcuccaggaggcucugcggcagccucccucccugccugggcccagguuuggacaccugagcccgccugcgcacucugggcccccaccccacucggcaccgugcuucucgccaggcccucuggcucuucccuguggcugcagauggcacuuagcggccuaggacgucuauucacgggaggagggaggcacugcccuccucaggucugcccaagcagcuuguagcuagcacugggccccgugcgcgccccugccggccgcuggcccugcccucucuccucugcaggcacggggccugugcucucugcucgaccuguguguagccccuccuccugcugacguggccgcacacggccuucccuugcaguggccucuuucuccucccuguaccaguccagcugccaaggacagcugcacaggagcguuuccugggcagguaucgccucucagagggaagcgguuggcugcagagcgccacucugccucauaggugcugugcucgucgccucauccgcccacccccaugguccgucugccuccauugcccuggggagcaggucccgacucgcaugaggacgucugugcagaaugucuuuggcuuggccagcgggauccccuugacuuggucccuuuguggcugagcccuguucccacgcugugcgagcacucccggcccagcuucaggccugagggguggggguggccugagucuccauggugacaucagcugagcugcagacucugauggguggcagcuguuuagggggaagcccaccccugggccugcaccgagcgggccuugcccuggccuuugguggcuccccuggccucuggaacccacagauggggcugccucaagucccagguugaccaggggcccugcagaccgaccucugccuguugcccccaagcccugguggggagugcugugaccugcauggugcuccccugccaggucuccacgugcagacgagcugguuuggaagggcugcgugggacgggcccugggguggcugacugcgcgugugcagggcuguggggcgcccgggggcugugaugguccccucuguugcugcuucuacuuccucucccccuguccugacgcuggcacaggaaaugcugcuuugggaccucccacccucucuccuuagcguccccagcugugggucuggcuuggaguuggagggugagccucugcucuugggagcagucuguuugcaaacagggacuucccccacgucacggagucuccgcagcucuccucgguuacgagggcugguuucaggcucccgcucuuuuagagcugaggcccgucgggcggagagcgucuugccccugccuaccuggaggcacagggguggcugcugguggacacuagggugggcagagccgauugccugcccaacccccgggcacucaugcaggagaggccugugucggggucacgugcaggccuucccagcguccucccugcccgcucgguggauggcagcaguaagcagagcccuggggaggcucgcagggcugcugucccucuggucaggagaaggcugguucucggaggccacgucagggccagggccuggcccagccccacauccagcagccccgucuguguccucccagacuccgccguggucauggaggagggaaguccgggcgagguuccugugcugguggagcccccaggguuggaggacguugaggcagcgcuaggcauggacaggcgcacggaugccuacagcagggugaguguggcucagagccuggacccugcugaccucggggggcuccuuaggggaggcagggcucugcgugggugugccugcacccugggaacuggcucugaacuugggggagauguucuuccacaucccucgugcacagacggucugcacuuugcagccauccaccugggccggcccuggcugcugggcagccuguggucucaggggaugcugauaccucugcucacgcaguguggggcacagcugguggcagugcugcugcgucaacgggcgggggccguagccuggugcucgggcuggucuguggcccugggauggaggacagauagggccucaccaccuccaggucaaccccaggugggcucgagggugccugcugacagggguucucuuugggaugguccuuucuagucguccucagucuccagccaggaggagaagucgcuccacgcggaggagcugguuggcaggggcauccccaucgagcgagucgucuccucggaggguggccggcccucuguggaccucuccuuccagcccucgcagccccugagcaaguccagcuccucucccgagcugcagacucugcaggacauccucggggacccuggggacaaggccgacgugggccggcugagcccugagguuaaggcccggucacagucagggacccuggacggggaaagugcugccuggucggccucgggcgaagacagucggggccagcccgagggucccuugccuuccagcuccccccgcucgcccaguggccuccggccccgagguuacaccaucuccgacucggccccaucacgcaggggcaagagaguagagagggacgccuuaaagagcagagccacagccuccaaugcagagaaagugccaggcaucaaccccaggugggccucuugcuuccgggcggggcuccugacaccucuccugcgggaaccuggugccucacuugccccaggccgagcgggcuggggugggguccucgccugugcccuagggcuggcuggaaccccugggagggcgguggagugggagauggccaggcucuguguuccucccugugggcuguggcugcccuggccaggcccucaccugggugcccaccauccccucccugugcaguuucguguuccugcagcucuaccauucccccuucuuuggcgacgagucaaacaagccaauccugcugcccaaugagguaggcguggccucccucuccugcauccgcuggagcuguguggcucgggugaaugguggggggcccagcucugcugcugggagcucaggcuugcagagggcucuggccuaagcucccuguggcagccugccgugaccggccuggguggggcggccuccuguggacgggcgucuggggcucaggcagggcucugugugccacagucacaguccuuugagcggucggugcagcuccucgaccagaucccaucauacgacacccacaagaucgccguccuguauguuggagaaggccaggugaggcugcggggccggccuaggugccuggacagggccagcugggccucagccugcaguggguagggagucugggcccccaacgccccacagagcucaacacugccggguccccuacagcaugaagugcucauugagcucugugccaggugcugcucugagugcuggggaccccggugcgagugacagguuagcgugggagcacccggcacaccaaggagugggaaggacugggcggguggcaccggucgcagggcuggggagggcgcuguuggucagugagcugacagcugaguggugagggagcgggcagggggagccugcauaaggggugggggcaucccacacaccagcagcgggggccgggcgcacccugcccagcuugagcacuggugcugggcgagcacgggagccgacaggaugggcagccucagcgcccuauaggcugcaccuucaucccaagggaaagggcagggccugggcugcuucugagcagagggcacauggccugacuccgcccagucucagugagucccuccugcuguguggcucgaggagguggguggugaugguucccgugggagugggguaggccccugggggcaggcugcugaggggccagggccccgggugugcuuugaguguggagcucccugauuuugccggccaggcacacacggggcugagggaagagagggagucaaggaugacacccgaugucuggccuggguggcugcuggaauggauggucuugucugccucagggaucagaguggggcucccggcagagccugcugggcacccccacccucugcggggcagggcccggcccgggagugaugccacccugccucuccccucuccccacagagcaacagcgagcucgccauccuguccaaugagcauggcuccuacagguacacggaguuccugacgggccugggccggcucaucgagcugaaggacugccagccggacaagguguaccugggaggccuggacguguguggugaggacggccaguucaccuacugcuggcacgaugacaucaugcaagguacggccuggcgccuacccgcuccugcugccccaggccucagggcacggcucccauccaguccugcuaccccacgcccuggggcauggcccuggcacccccaccugcuccagcuccccacgccucagguuccgagccuaacagcgugggcauggaggcagugauggggcugguggcuuugcgucccaaagcccugccccuggggagagccgaggaccacuggccaggcaccagaggacgugguccccgcaggcccccagagccccuggaguaaucaggaggugccccagugcaaggcacagagggccucagcacuggccccacaaacccauccggcccugcucacccucagccgucuuccacaucgccacccugaugcccaccaaggacguggacaagcaccgcugcgacaagaagcgccaccugggcaacgacuuuguguccauugucuacaaugacuccggugaggacuucaagcuuggcaccaucaaggugagugaggggccgucagugaggcugggccccaggcaggugcccacugcugugucccggguugguggcagguccuccucccugagcuucggucacgaggagcaggaggagaggccgcagugcucagggccccgugggcacgagcuucaccccgagccugcguuguguccucugugcccugaagccuguggcgccugcugcugagugucugucaggaguaacuggcaagugcagacugggugugcugggugggcacaguguaguuggugcuuccugucuguccggcgcggcccuugggcccccaccaucuccccaguggcagcugucaggcugcucaguugguuaucgccacgcaccacuaggcagcaaccagcgucacccucuuccuggaggugggcugggucggccagugucacagcacgguccgggugagccccagcauggcggggagagcuggcauggcccaggcagggcagauaggcuggaggccucacuccaagggccccaggaugcugaggcagccacugaaccaaaaccccggggcugguagucagaguccaggaggggcaggagcauagggaggugggcucugcuagaugccaagacaaccaguugggggggggggggcaccugggcggcugaggagggugugguggugccgagauggggugcacggcucacuucauggcugggcagacggauucggacguguggcugcagacacccugggggccccagugaguggaggugccccagcaauuagaggugucuugccuguggcugcagcauaugugggugcugcgcccagauguggagggggcuuggccugggggaggccagacaaacacagccccgcugccagaggggaaaguucaggggcagaugcugcccauggagcugacaggugucuagcagugcaaccaggcaguagccgagaucagccuucagcacacgcugugugcggggaugacccuuucucuuguccgggcagggccaguucaacuuuguccacgugaucgucaccccgcuggacuacgagugcaaccuggugucccugcagugcaggaaagguagggccggguggggcccugcagugcaggaaagguagggccggguggggcccugcaguguggcgccaagagcccugggccuggcgugaccaccaagucuccccagacauggagggccuuguggacaccagcguggccaagaucgugucugaccgcaaccugcccuucguggcccgccagauggcccugcacgcaaaugugaguggggguggguccaggcgugagcuggugggacaggcccaggugccaccugauagugagcucacccccugccuacguccccagauggccucacaggugcaucauagccgcuccaaccccaccgauaucuaccccuccaaguggauugcccggcuccgccacaucaagcggcuccgccagcggguagggaauauggggcucccucagcggggugugcuggcugcccaagcuguggggcgggugugugggcagagcgguugccacgccucccagacuuacugcccaagccgccucugccuucagaucugcgaggaagccgccuacuccaaccccagccuaccucuggugcacccuccgucccauagcaaagccccugcacagacuccagccgagcccacaccuggcuaugaggugggccagcggaagcgccucaucuccucgguggaggacuucaccgaguuugugugaggccggggcccucccuccugcacuggccuuggacgguauugccugucagugaaauaaauaaaguccugaccccagugcacagacauagaggcacagauugcagucagaca

SEQ ID NO: 447 - RNA, 40826 nt, Homo sapiens; identical to SEQ ID NO: 441

SEQ ID NO: 448 - RNA, 18 nt, Artificial Sequence
  Description of Artificial Sequence: Synthetic oligonucleotide
agaggacauuggaccgca

SEQ ID NO: 449 - RNA, 18 nt, Artificial Sequence
  Description of Artificial Sequence: Synthetic oligonucleotide
agacaagaggacauugga

SEQ ID NO: 450 - RNA, 18 nt, Artificial Sequence
  Description of Artificial Sequence: Synthetic oligonucleotide
ucaaaagacaagaggaca

SEQ ID NO: 451 - RNA, 18 nt, Artificial Sequence
  Description of Artificial Sequence: Synthetic oligonucleotide
ugucaucaaaagacaaga

SEQ ID NO: 452 - RNA, 18 nt, Artificial Sequence
  Description of Artificial Sequence: Synthetic oligonucleotide
gaagcuguccuucucggg

SEQ ID NO: 453 - RNA, 18 nt, Artificial Sequence
  Description of Artificial Sequence: Synthetic oligonucleotide
gcccugaagcuguccuuc

SEQ ID NO: 454 - RNA, 18 nt, Artificial Sequence
  Description of Artificial Sequence: Synthetic oligonucleotide
uccgggcccugaagcugu

SEQ ID NO: 455 - RNA, 18 nt, Artificial Sequence
  Description of Artificial Sequence: Synthetic oligonucleotide
aguacuccgggcccugaa

SEQ ID NO: 456 - RNA, 18 nt, Artificial Sequence
  Description of Artificial Sequence: Synthetic oligonucleotide
agacuaguacuccgggcc

SEQ ID NO: 457 - RNA, 18 nt, Artificial Sequence
  Description of Artificial Sequence: Synthetic oligonucleotide
cguugagacuaguacucc

SEQ ID NO: 458 - RNA, 18 nt, Artificial Sequence
  Description of Artificial Sequence: Synthetic oligonucleotide
ucucucguugagacuagu

SEQ ID NO: 459 - RNA, 18 nt, Artificial Sequence
  Description of Artificial Sequence: Synthetic oligonucleotide
uugggucucucguugaga

SEQ ID NO: 460 - RNA, 18 nt, Artificial Sequence
  Description of Artificial Sequence: Synthetic oligonucleotide
aggcacacccccgcaggc

SEQ ID NO: 461 - RNA, 18 nt, Artificial Sequence
  Description of Artificial Sequence: Synthetic oligonucleotide
acuccaggcacacccccg

SEQ ID NO: 462 - RNA, 18 nt, Artificial Sequence
  Description of Artificial Sequence: Synthetic oligonucleotide
caccgacuccaggcacac

SEQ ID NO: 463 - RNA, 18 nt, Artificial Sequence
  Description of Artificial Sequence: Synthetic oligonucleotide
ccccacaccgacuccagg

SEQ ID NO: 464 - RNA, 18 nt, Artificial Sequence
  Description of Artificial Sequence: Synthetic oligonucleotide
ccccaccccacaccgacu

SEQ ID NO: 465 - RNA, 18 nt, Artificial Sequence
  Description of Artificial Sequence: Synthetic oligonucleotide
uccuuccccaccccacac

SEQ ID NO: 466 - RNA, 18 nt, Artificial Sequence
  Description of Artificial Sequence: Synthetic oligonucleotide
ccauguccuuccccaccc

SEQ ID NO: 467 - RNA, 18 nt, Artificial Sequence
  Description of Artificial Sequence: Synthetic oligonucleotide
cagccccauguccuuccc

SEQ ID NO: 468 - RNA, 18 nt, Artificial Sequence
  Description of Artificial Sequence: Synthetic oligonucleotide
ggccacagccccaugucc

SEQ ID NO: 469 - RNA, 18 nt, Artificial Sequence
  Description of Artificial Sequence: Synthetic oligonucleotide
aggcaggccacagcccca

SEQ ID NO: 470 - RNA, 18 nt, Artificial Sequence
  Description of Artificial Sequence: Synthetic oligonucleotide
ccgucaggcaggccacag

SEQ ID NO: 471 - RNA, 18 nt, Artificial Sequence
  Description of Artificial Sequence: Synthetic oligonucleotide
aggcaccgucaggcaggc

SEQ ID NO: 472 - RNA, 18 nt, Artificial Sequence
  Description of Artificial Sequence: Synthetic oligonucleotide
cuuggaggcaccgucagg

SEQ ID NO: 473 - RNA, 18 nt, Artificial Sequence
  Description of Artificial Sequence: Synthetic oligonucleotide
acugacuuggaggcaccg

SEQ ID NO: 474 - RNA, 18 nt, Artificial Sequence
  Description of Artificial Sequence: Synthetic oligonucleotide
cacucacugacuuggagg

SEQ ID NO: 475 - RNA, 18 nt, Artificial Sequence
  Description of Artificial Sequence: Synthetic oligonucleotide
auuuccacucacugacuu

SEQ ID NO: 476 - RNA, 18 nt, Artificial Sequence
  Description of Artificial Sequence: Synthetic oligonucleotide
gacccauuuccacucacu

SEQ ID NO: 477 - RNA, 18 nt, Artificial Sequence
  Description of Artificial Sequence: Synthetic oligonucleotide
cacaggacccauuuccac

SEQ ID NO: 478 - RNA, 18 nt, Artificial Sequence
  Description of Artificial Sequence: Synthetic oligonucleotide
gggcacacaggacccauu

SEQ ID NO: 479 - RNA, 18 nt, Artificial Sequence
  Description of Artificial Sequence: Synthetic oligonucleotide
cuccagggcacacaggac

SEQ ID NO: 480 - RNA, 18 nt, Artificial Sequence
  Description of Artificial Sequence: Synthetic oligonucleotide
acauacuccagggcacac

SEQ ID NO: 481 - RNA, 18 nt, Artificial Sequence
  Description of Artificial Sequence: Synthetic oligonucleotide
gccucacauacuccaggg

SEQ ID NO: 482 - RNA, 18 nt, Artificial Sequence
  Description of Artificial Sequence: Synthetic oligonucleotide
gcccugccucacauacuc

SEQ ID NO: 483 - RNA, 18 nt, Artificial Sequence
  Description of Artificial Sequence: Synthetic oligonucleotide
guccugcccugccucaca

SEQ ID NO: 484 - RNA, 18 nt, Artificial Sequence
  Description of Artificial Sequence: Synthetic oligonucleotide
ugcagguccugcccugcc

SEQ ID NO: 485 - RNA, 18 nt, Artificial Sequence
  Description of Artificial Sequence: Synthetic oligonucleotide
gcccuugcagguccugcc

SEQ ID NO: 486 - RNA, 18 nt, Artificial Sequence
  Description of Artificial Sequence: Synthetic oligonucleotide
uagcggcccuugcagguc

SEQ ID NO: 487 - RNA, 18 nt, Artificial Sequence
  Description of Artificial Sequence: Synthetic oligonucleotide
gguguuagcggcccuugc

SEQ ID NO: 488 - RNA, 18 nt, Artificial Sequence
  Description of Artificial Sequence: Synthetic oligonucleotide
ggguguuagcggcccuug

SEQ ID NO: 489 - RNA, 18 nt, Artificial Sequence
  Description of Artificial Sequence: Synthetic oligonucleotide
cggccaaccugcugaggg

SEQ ID NO: 490 - RNA, 18 nt, Artificial Sequence
  Description of Artificial Sequence: Synthetic oligonucleotide
caccacggccaaccugcu

SEQ ID NO: 491 - RNA, 18 nt, Artificial Sequence
  Description of Artificial Sequence: Synthetic oligonucleotide
caggccaccacggccaac

SEQ ID NO: 492 - RNA, 18 nt, Artificial Sequence
  Description of Artificial Sequence: Synthetic oligonucleotide
ggacccaggccaccacgg

SEQ ID NO: 493 - RNA, 18 nt, Artificial Sequence
  Description of Artificial Sequence: Synthetic oligonucleotide
agcccggacccaggccac

SEQ ID NO: 494 - RNA, 18 nt, Artificial Sequence
  Description of Artificial Sequence: Synthetic oligonucleotide
cacgcagcccggacccag

SEQ ID NO: 495 - RNA, 18 nt, Artificial Sequence
  Description of Artificial Sequence: Synthetic oligonucleotide
uggcacacgcagcccgga

SEQ ID NO: 496 - RNA, 18 nt, Artificial Sequence
  Description of Artificial Sequence: Synthetic oligonucleotide
gcccguggcacacgcagc

SEQ ID NO: 497 - RNA, 18 nt, Artificial Sequence
  Description of Artificial Sequence: Synthetic oligonucleotide
uaggugcccguggcacac

SEQ ID NO: 498 - RNA, 18 nt, Artificial Sequence
  Description of Artificial Sequence: Synthetic oligonucleotide
acaaguaggugcccgugg

SEQ ID NO: 499 - RNA, 18 nt, Artificial Sequence
  Description of Artificial Sequence: Synthetic oligonucleotide
auuccacaaguaggugcc

SEQ ID NO: 500 - RNA, 18 nt, Artificial Sequence
  Description of Artificial Sequence: Synthetic oligonucleotide
ccccaauuccacaaguag

SEQ ID NO: 501 - RNA, 18 nt, Artificial Sequence
  Description of Artificial Sequence: Synthetic oligonucleotide
ccaacccccaauuccaca

SEQ ID NO: 502 - RNA, 18 nt, Artificial Sequence
  Description of Artificial Sequence: Synthetic oligonucleotide
gcaccccaacccccaauu

SEQ ID NO: 503 - RNA, 18 nt, Artificial Sequence
  Description of Artificial Sequence: Synthetic oligonucleotide
agcuugcaccccaacccc

SEQ ID NO: 504 - RNA, 18 nt, Artificial Sequence
  Description of Artificial Sequence: Synthetic oligonucleotide
ccuaaagcuugcacccca

SEQ ID NO: 505 - RNA, 18 nt, Artificial Sequence
  Description of Artificial Sequence: Synthetic oligonucleotide
aggcgccuaaagcuugca

SEQ ID NO: 506 - RNA, 18 nt, Artificial Sequence
  Description of Artificial Sequence: Synthetic oligonucleotide
ggcucaggcgccuaaagc

SEQ ID NO: 507 - RNA, 18 nt, Artificial Sequence
  Description of Artificial Sequence: Synthetic oligonucleotide
gggcucaggcgccuaaag

SEQ ID NO: 508 - RNA, 18 nt, Artificial Sequence
  Description of Artificial Sequence: Synthetic oligonucleotide
ggccggcuccuucgaggg

SEQ ID NO: 509 - RNA, 18 nt, Artificial Sequence
  Description of Artificial Sequence: Synthetic oligonucleotide
gacaaggccggcuccuuc

SEQ ID NO: 510 - RNA, 18 nt, Artificial Sequence
  Description of Artificial Sequence: Synthetic oligonucleotide
ccccagacaaggccggcu

SEQ ID NO: 511 - RNA, 18 nt, Artificial Sequence
  Description of Artificial Sequence: Synthetic oligonucleotide
ggcagccccagacaaggc

SEQ ID NO: 512 - RNA, 18 nt, Artificial Sequence
  Description of Artificial Sequence: Synthetic oligonucleotide
gggcagccccagacaagg

SEQ ID NO: 513 - RNA, 18 nt, Artificial Sequence
  Description of Artificial Sequence: Synthetic oligonucleotide
ggcuagcagcaggcuggg

SEQ ID NO: 514 - RNA, 18 nt, Artificial Sequence
  Description of Artificial Sequence: Synthetic oligonucleotide
uccccggcuagcagcagg

SEQ ID NO: 515 - RNA, 18 nt, Artificial Sequence
  Description of Artificial Sequence: Synthetic oligonucleotide
cagaguccccggcuagca

SEQ ID NO: 516 - RNA, 18 nt, Artificial Sequence
  Description of Artificial Sequence: Synthetic oligonucleotide
ugaagcagaguccccggc

SEQ ID NO: 517 - RNA, 18 nt, Artificial Sequence
  Description of Artificial Sequence: Synthetic oligonucleotide
ggugaugaagcagagucc

SEQ ID NO: 518 - RNA, 18 nt, Artificial Sequence
  Description of Artificial Sequence: Synthetic oligonucleotide
gcggcggugaugaagcag

SEQ ID NO: 519 - RNA, 18 nt, Artificial Sequence
  Description of Artificial Sequence: Synthetic oligonucleotide
gcaaggcggcggugauga

SEQ ID NO: 520 - RNA, 18 nt, Artificial Sequence
  Description of Artificial Sequence: Synthetic oligonucleotide
guccggcaaggcggcggu

SEQ ID NO: 521 - RNA, 18 nt, Artificial Sequence
  Description of Artificial Sequence: Synthetic oligonucleotide
uugcgguccggcaaggcg

SEQ ID NO: 522 - RNA, 18 nt, Artificial Sequence
  Description of Artificial Sequence: Synthetic oligonucleotide
gcucuuugcgguccggca

SEQ ID NO: 523 - RNA, 18 nt, Artificial Sequence
  Description of Artificial Sequence: Synthetic oligonucleotide
gcucagcucuuugcgguc

SEQ ID NO: 524 - RNA, 18 nt, Artificial Sequence
  Description of Artificial Sequence: Synthetic oligonucleotide
ggcuggcucagcucuuug

SEQ ID NO: 525 - RNA, 18 nt, Artificial Sequence
  Description of Artificial Sequence: Synthetic oligonucleotide
acagaggcuggcucagcu

SEQ ID NO: 526 - RNA, 18 nt, Artificial Sequence
  Description of Artificial Sequence: Synthetic oligonucleotide
agaacacagaggcuggcu

SEQ ID NO: 527 - RNA, 18 nt, Artificial Sequence
  Description of Artificial Sequence: Synthetic oligonucleotide
aaacaagaacacagaggc

SEQ ID NO: 528 - RNA, 18 nt, Artificial Sequence
  Description of Artificial Sequence: Synthetic oligonucleotide
aaugcaaacaagaacaca

SEQ ID NO: 529 - RNA, 18 nt, Artificial Sequence
  Description of Artificial Sequence: Synthetic oligonucleotide
aaugaaaugcaaacaaga

SEQ ID NO: 530 - RNA, 18 nt, Artificial Sequence
  Description of Artificial Sequence: Synthetic oligonucleotide
guucaaaugaaaugcaaa

SEQ ID NO: 531 - RNA, 18 nt, Artificial Sequence
  Description of Artificial Sequence: Synthetic oligonucleotide
aagccguucaaaugaaau

SEQ ID NO: 532 - RNA, 18 nt, Artificial Sequence
  Description of Artificial Sequence: Synthetic oligonucleotide
ggagaaagccguucaaau

SEQ ID NO: 533 - RNA, 18 nt, Artificial Sequence
  Description of Artificial Sequence: Synthetic oligonucleotide
caggaggagaaagccguu

SEQ ID NO: 534 - RNA, 18 nt, Artificial Sequence
  Description of Artificial Sequence: Synthetic oligonucleotide
gggacaggaggagaaagc

SEQ ID NO: 535 - RNA, 18 nt, Artificial Sequence
  Description of Artificial Sequence: Synthetic oligonucleotide
cucgggcaggaagguggg

SEQ ID NO: 536 - RNA, 18 nt, Artificial Sequence
  Description of Artificial Sequence: Synthetic oligonucleotide
aauagcucgggcaggaag

SEQ ID NO: 537 - RNA, 18 nt, Artificial Sequence
  Description of Artificial Sequence: Synthetic oligonucleotide
gccaaaauagcucgggca

SEQ ID NO: 538 - RNA, 18 nt, Artificial Sequence
  Description of Artificial Sequence: Synthetic oligonucleotide
ggaaagccaaaauagcuc

SEQ ID NO: 539 - RNA, 18 nt, Artificial Sequence
  Description of Artificial Sequence: Synthetic oligonucleotide
ucuagggaaagccaaaau

SEQ ID NO: 540 - RNA, 18 nt, Artificial Sequence
  Description of Artificial Sequence: Synthetic oligonucleotide
ucccaucuagggaaagcc

SEQ ID NO: 541 - RNA, 18 nt, Artificial Sequence
  Description of Artificial Sequence: Synthetic oligonucleotide
cguauucccaucuaggga

SEQ ID NO: 542 - RNA, 18 nt, Artificial Sequence
  Description of Artificial Sequence: Synthetic oligonucleotide
aaugccguauucccaucu

SEQ ID NO: 543 - RNA, 18 nt, Artificial Sequence
  Description of Artificial Sequence: Synthetic oligonucleotide
uggaaaaugccguauucc

SEQ ID NO: 544 - RNA, 18 nt, Artificial Sequence
  Description of Artificial Sequence: Synthetic oligonucleotide
cacgcuggaaaaugccgu

SEQ ID NO: 545 - RNA, 18 nt, Artificial Sequence
  Description of Artificial Sequence: Synthetic oligonucleotide
gaggucacgcuggaaaau

SEQ ID NO: 546 - RNA, 18 nt, Artificial Sequence
  Description of Artificial Sequence: Synthetic oligonucleotide
gaguugaggucacgcugg

SEQ ID NO: 547 - RNA, 18 nt, Artificial Sequence
  Description of Artificial Sequence: Synthetic oligonucleotide
cuuccgaguugaggucac

SEQ ID NO: 548 - RNA, 18 nt, Artificial Sequence
  Description of Artificial Sequence: Synthetic oligonucleotide
auacaaauuucauagccc

SEQ ID NO: 549 - RNA, 18 nt, Artificial Sequence
  Description of Artificial Sequence: Synthetic oligonucleotide
uucugauacaaauuucau

SEQ ID NO: 550 - RNA, 18 nt, Artificial Sequence
  Description of Artificial Sequence: Synthetic oligonucleotide
guucauucugauacaaau

SEQ ID NO: 551 - RNA, 18 nt, Artificial Sequence
  Description of Artificial Sequence: Synthetic oligonucleotide
ugggaguucauucugaua

SEQ ID NO: 552 - RNA, 18 nt, Artificial Sequence
  Description of Artificial Sequence: Synthetic oligonucleotide
gcuuaugggaguucauuc

SEQ ID NO: 553 - RNA, 18 nt, Artificial Sequence
  Description of Artificial Sequence: Synthetic oligonucleotide
aagaggcuuaugggaguu

SEQ ID NO: 554 - RNA, 18 nt, Artificial Sequence
  Description of Artificial Sequence: Synthetic oligonucleotide
cagggaagaggcuuaugg

SEQ ID NO: 555 - RNA, 18 nt, Artificial Sequence
  Description of Artificial Sequence: Synthetic oligonucleotide
agugacagggaagaggcu

SEQ ID NO: 556 - RNA, 18 nt, Artificial Sequence
  Description of Artificial Sequence: Synthetic oligonucleotide
cacccagugacagggaag

SEQ ID NO: 557 - RNA, 18 nt, Artificial Sequence
  Description of Artificial Sequence: Synthetic oligonucleotide
cuccacacccagugacag

SEQ ID NO: 558 - RNA, 18 nt, Artificial Sequence
  Description of Artificial Sequence: Synthetic oligonucleotide
cugagcuccacacccagu

SEQ ID NO: 559 - RNA, 18 nt, Artificial Sequence
  Description of Artificial Sequence: Synthetic oligonucleotide
gcugccugagcuccacac

SEQ ID NO: 560 - RNA, 18 nt, Artificial Sequence
  Description of Artificial Sequence: Synthetic oligonucleotide
gagcggcugccugagcuc

SEQ ID NO: 561 - RNA, 18 nt, Artificial Sequence
  Description of Artificial Sequence: Synthetic oligonucleotide
caggcgagcggcugccug

SEQ ID NO: 562 - RNA, 18 nt, Artificial Sequence
  Description of Artificial Sequence: Synthetic oligonucleotide
ucaggcaggcgagcggcu

SEQ ID NO: 563 - RNA, 18 nt, Artificial Sequence
  Description of Artificial Sequence: Synthetic oligonucleotide
cacccucaggcaggcgag

SEQ ID NO: 564 - RNA, 18 nt, Artificial Sequence
  Description of Artificial Sequence: Synthetic oligonucleotide
accgucacccucaggcag

SEQ ID NO: 565 - RNA, 18 nt, Artificial Sequence
  Description of Artificial Sequence: Synthetic oligonucleotide
cuuccaccgucacccuca

SEQ ID NO: 566 - RNA, 18 nt, Artificial Sequence
  Description of Artificial Sequence: Synthetic oligonucleotide
guggccuuccaccgucac

SEQ ID NO: 567 - RNA, 18 nt, Artificial Sequence
  Description of Artificial Sequence: Synthetic oligonucleotide
cccauguggccuuccacc

SEQ ID NO: 568 - RNA, 18 nt, Artificial Sequence
  Description of Artificial Sequence: Synthetic oligonucleotide
ggauccccauguggccuu

SEQ ID NO: 569 - RNA, 18 nt, Artificial Sequence
  Description of Artificial Sequence: Synthetic oligonucleotide
gucugggauccccaugug

SEQ ID NO: 570 - RNA, 18 nt, Artificial Sequence
  Description of Artificial Sequence: Synthetic oligonucleotide
cagaggucugggaucccc

SEQ ID NO: 571 - RNA, 18 nt, Artificial Sequence
  Description of Artificial Sequence: Synthetic oligonucleotide
gcacacagaggucuggga

SEQ ID NO: 572 - RNA, 18 nt, Artificial Sequence
  Description of Artificial Sequence: Synthetic oligonucleotide
ggcaagcacacagagguc

SEQ ID NO: 573 - RNA, 18 nt, Artificial Sequence
  Description of Artificial Sequence: Synthetic oligonucleotide
ccuccggcaagcacacag

SEQ ID NO: 574 - RNA, 18 nt, Artificial Sequence
  Description of Artificial Sequence: Synthetic oligonucleotide
ggcugccuccggcaagca

SEQ ID NO: 575 - RNA, 18 nt, Artificial Sequence
  Description of Artificial Sequence: Synthetic oligonucleotide
ccgcaggcugccuccggc

SEQ ID NO: 576 - RNA, 18 nt, Artificial Sequence
  Description of Artificial Sequence: Synthetic oligonucleotide
ucugcccgcaggcugccu

SEQ ID NO: 577 - RNA, 18 nt, Artificial Sequence
  Description of Artificial Sequence: Synthetic oligonucleotide
ugcauucugcccgcaggc

SEQ ID NO: 578 - RNA, 18 nt, Artificial Sequence
  Description of Artificial Sequence: Synthetic oligonucleotide
cagauugcauucugcccg

SEQ ID NO: 579 - RNA, 18 nt, Artificial Sequence
  Description of Artificial Sequence: Synthetic oligonucleotide
aggcccagauugcauucu

SEQ ID NO: 580 - RNA, 18 nt, Artificial Sequence
  Description of Artificial Sequence: Synthetic oligonucleotide
cagacaggcccagauugc

SEQ ID NO: 581 - RNA, 18 nt, Artificial Sequence
  Description of Artificial Sequence: Synthetic oligonucleotide
ccacacagacaggcccag

SEQ ID NO: 582 - RNA, 18 nt, Artificial Sequence
  Description of Artificial Sequence: Synthetic oligonucleotide
ggaggccacacagacagg

SEQ ID NO: 583 - RNA, 18 nt, Artificial Sequence
  Description of Artificial Sequence: Synthetic oligonucleotide
gaggcggaggccacacag

SEQ ID NO: 584 - RNA, 18 nt, Artificial Sequence
  Description of Artificial Sequence: Synthetic oligonucleotide
gcagagaggcggaggcca

SEQ ID NO: 585 - RNA, 18 nt, Artificial Sequence
  Description of Artificial Sequence: Synthetic oligonucleotide
gucaugcagagaggcgga

SEQ ID NO: 586 - RNA, 18 nt, Artificial Sequence
  Description of Artificial Sequence: Synthetic oligonucleotide
guguagucaugcagagag

SEQ ID NO: 587 - RNA, 18 nt, Artificial Sequence
  Description of Artificial Sequence: Synthetic oligonucleotide
aaacgguguagucaugca

SEQ ID NO: 588 - RNA, 18 nt, Artificial Sequence
  Description of Artificial Sequence: Synthetic oligonucleotide
uggcgaaacgguguaguc

SEQ ID NO: 589 - RNA, 18 nt, Artificial Sequence
  Description of Artificial Sequence: Synthetic oligonucleotide
ccuccuggcgaaacggug

SEQ ID NO: 590 - RNA, 18 nt, Artificial Sequence
  Description of Artificial Sequence: Synthetic oligonucleotide
uacggccuccuggcgaaa

SEQ ID NO: 591 - RNA, 18 nt, Artificial Sequence
  Description of Artificial Sequence: Synthetic oligonucleotide
uagguuacggccuccugg

SEQ ID NO: 592 - RNA, 18 nt, Artificial Sequence
  Description of Artificial Sequence: Synthetic oligonucleotide
agcacuagguuacggccu

SEQ ID NO: 593 - RNA, 18 nt, Artificial Sequence
  Description of Artificial Sequence: Synthetic oligonucleotide
acgggagcacuagguuac

SEQ ID NO: 594 - RNA, 18 nt, Artificial Sequence
  Description of Artificial Sequence: Synthetic oligonucleotide
agcccacgggagcacuag

SEQ ID NO: 595 - RNA, 18 nt, Artificial Sequence
  Description of Artificial Sequence: Synthetic oligonucleotide
accgaagcccacgggagc

SEQ ID NO: 596 - RNA, 18 nt, Artificial Sequence
  Description of Artificial Sequence: Synthetic oligonucleotide
cccucaccgaagcccacg

SEQ ID NO: 597 - RNA, 18 nt, Artificial Sequence
  Description of Artificial Sequence: Synthetic oligonucleotide
caucccccucaccgaagc

SEQ ID NO: 598 - RNA, 18 nt, Artificial Sequence
  Description of Artificial Sequence: Synthetic oligonucleotide
accgacaucccccucacc

SEQ ID NO: 599 - RNA, 18 nt, Artificial Sequence
  Description of Artificial Sequence: Synthetic oligonucleotide
uagagaccgacauccccc

SEQ ID NO: 600 - RNA, 18 nt, Artificial Sequence
  Description of Artificial Sequence: Synthetic oligonucleotide
gaggcuagagaccgacau

SEQ ID NO: 601 - RNA, 18 nt, Artificial Sequence
  Description of Artificial Sequence: Synthetic oligonucleotide
cucaggaggcuagagacc

SEQ ID NO: 602 - RNA, 18 nt, Artificial Sequence
  Description of Artificial Sequence: Synthetic oligonucleotide
gcagacucaggaggcuag

SEQ ID NO: 603 - RNA, 18 nt, Artificial Sequence
  Description of Artificial Sequence: Synthetic oligonucleotide
ucggagcagacucaggag

SEQ ID NO: 604 - RNA, 18 nt, Artificial Sequence
  Description of Artificial Sequence: Synthetic oligonucleotide
acuggucggagcagacuc

SEQ ID NO: 605 - RNA, 18 nt, Artificial Sequence
  Description of Artificial Sequence: Synthetic oligonucleotide
ggccuacuggucggagca

SEQ ID NO: 606 - RNA, 18 nt, Artificial Sequence
  Description of Artificial Sequence: Synthetic oligonucleotide
gaccaggccuacuggucg

SEQ ID NO: 607 - RNA, 18 nt, Artificial Sequence
  Description of Artificial Sequence: Synthetic oligonucleotide
gggaagaccaggccuacu

SEQ ID NO: 608 - RNA, 18 nt, Artificial Sequence
  Description of Artificial Sequence: Synthetic oligonucleotide
auugucccagagaacggg

SEQ ID NO: 609 - RNA, 18 nt, Artificial Sequence
  Description of Artificial Sequence: Synthetic oligonucleotide
ccacauugucccagagaa

SEQ ID NO: 610 - RNA, 18 nt, Artificial Sequence
  Description of Artificial Sequence: Synthetic oligonucleotide
guggaccacauuguccca

SEQ ID NO: 611 - RNA, 18 nt, Artificial Sequence
  Description of Artificial Sequence: Synthetic oligonucleotide
aucacguggaccacauug

SEQ ID NO: 612 - RNA, 18 nt, Artificial Sequence
  Description of Artificial Sequence: Synthetic oligonucleotide
ugagaaucacguggacca

SEQ ID NO: 613 - RNA, 18 nt, Artificial Sequence
  Description of Artificial Sequence: Synthetic oligonucleotide
cagcuugagaaucacgug

SEQ ID NO: 614 - RNA, 18 nt, Artificial Sequence
  Description of Artificial Sequence: Synthetic oligonucleotide
agccucagcuugagaauc

SEQ ID NO: 615 - RNA, 18 nt, Artificial Sequence
  Description of Artificial Sequence: Synthetic oligonucleotide
cagcgagccucagcuuga

SEQ ID NO: 616 - RNA, 18 nt, Artificial Sequence
  Description of Artificial Sequence: Synthetic oligonucleotide
cggcccagcgagccucag

SEQ ID NO: 617 - RNA, 18 nt, Artificial Sequence
  Description of Artificial Sequence: Synthetic oligonucleotide
gugggcggcccagcgagc

SEQ ID NO: 618 - RNA, 18 nt, Artificial Sequence
  Description of Artificial Sequence: Synthetic oligonucleotide
agggcgugggcggcccag

SEQ ID NO: 619 - RNA, 18 nt, Artificial Sequence
  Description of Artificial Sequence: Synthetic oligonucleotide
ccaacagggcgugggcgg

SEQ ID NO: 620 - RNA, 18 nt, Artificial Sequence
  Description of Artificial Sequence: Synthetic oligonucleotide
agaccccaacagggcgug

SEQ ID NO: 621 - RNA, 18 nt, Artificial Sequence
  Description of Artificial Sequence: Synthetic oligonucleotide
cggaaagaccccaacagg

SEQ ID NO: 622 - RNA, 18 nt, Artificial Sequence
  Description of Artificial Sequence: Synthetic oligonucleotide
ucgcucggaaagacccca

SEQ ID NO: 623 - RNA, 18 nt, Artificial Sequence
  Description of Artificial Sequence: Synthetic oligonucleotide
ggaccucgcucggaaaga

SEQ ID NO: 624 - RNA, 18 nt, Artificial Sequence
  Description of Artificial Sequence: Synthetic oligonucleotide
gcugaggaccucgcucgg

SEQ ID NO: 625 - RNA, 18 nt, Artificial Sequence
  Description of Artificial Sequence: Synthetic oligonucleotide
gcacggcugaggaccucg

SEQ ID NO: 626 - RNA, 18 nt, Artificial Sequence
  Description of Artificial Sequence: Synthetic oligonucleotide
cgcaugcacggcugagga

SEQ ID NO: 627 - RNA, 18 nt, Artificial Sequence
  Description of Artificial Sequence: Synthetic oligonucleotide
cucaacgcaugcacggcu

SEQ ID NO: 628 - RNA, 18 nt, Artificial Sequence
  Description of Artificial Sequence: Synthetic oligonucleotide
caaagcucaacgcaugca

SEQ ID NO: 629 - RNA, 18 nt, Artificial Sequence
  Description of Artificial Sequence: Synthetic oligonucleotide
agggccaaagcucaacgc

SEQ ID NO: 630 - RNA, 18 nt, Artificial Sequence
  Description of Artificial Sequence: Synthetic oligonucleotide
caccaagggccaaagcuc

SEQ ID NO: 631 - RNA, 18 nt, Artificial Sequence
  Description of Artificial Sequence: Synthetic oligonucleotide
ccuaucaccaagggccaa

SEQ ID NO: 632 - RNA, 18 nt, Artificial Sequence
  Description of Artificial Sequence: Synthetic oligonucleotide
agccaccuaucaccaagg

SEQ ID NO: 633 - RNA, 18 nt, Artificial Sequence
  Description of Artificial Sequence: Synthetic oligonucleotide
ggccgagccaccuaucac

SEQ ID NO: 634 - RNA, 18 nt, Artificial Sequence
  Description of Artificial Sequence: Synthetic oligonucleotide
gggcgggccgagccaccu

SEQ ID NO: 635 - RNA, 18 nt, Artificial Sequence
  Description of Artificial Sequence: Synthetic oligonucleotide
agguagggcgggccgagc

SEQ ID NO: 636 - RNA, 18 nt, Artificial Sequence
  Description of Artificial Sequence: Synthetic oligonucleotide
gugccagguagggcgggc

SEQ ID NO: 637 - RNA, 18 nt, Artificial Sequence
  Description of Artificial Sequence: Synthetic oligonucleotide
ucagggugccagguaggg

SEQ ID NO: 638 - RNA, 18 nt, Artificial Sequence
  Description of Artificial Sequence: Synthetic oligonucleotide
cagggucagggugccagg

SEQ ID NO: 639 - RNA, 18 nt, Artificial Sequence
  Description of Artificial Sequence: Synthetic oligonucleotide
gugaccagggucagggug

SEQ ID NO: 640 - RNA, 18 nt, Artificial Sequence
  Description of Artificial Sequence: Synthetic oligonucleotide
gagggacgucuguauccu

SEQ ID NO: 641 - RNA, 18 nt, Artificial Sequence
  Description of Artificial Sequence: Synthetic oligonucleotide
cuggugagggacgucugu

SEQ ID NO: 642 - RNA, 18 nt, Artificial Sequence
  Description of Artificial Sequence: Synthetic oligonucleotide
uggcacuggugagggacg

SEQ ID NO: 643 - RNA, 18 nt, Artificial Sequence
  Description of Artificial Sequence: Synthetic oligonucleotide
caagcuggcacuggugag

SEQ ID NO: 644 - RNA, 18 nt, Artificial Sequence
  Description of Artificial Sequence: Synthetic oligonucleotide
gaccccaagcuggcacug

SEQ ID NO: 645 - RNA, 18 nt, Artificial Sequence
  Description of Artificial Sequence: Synthetic oligonucleotide
cugcagaccccaagcugg

SEQ ID NO: 646 - RNA, 18 nt, Artificial Sequence
  Description of Artificial Sequence: Synthetic oligonucleotide
cucaucugcagaccccaa

SEQ ID NO: 647 - RNA, 18 nt, Artificial Sequence
  Description of Artificial Sequence: Synthetic oligonucleotide
gaguucucaucugcagac

SEQ ID NO: 648 - RNA, 18 nt, Artificial Sequence
  Description of Artificial Sequence: Synthetic oligonucleotide
ccacggaguucucaucug

SEQ ID NO: 649 - RNA, 18 nt, Artificial Sequence
  Description of Artificial Sequence: Synthetic oligonucleotide
cugggccacggaguucuc

SEQ ID NO: 650 - RNA, 18 nt, Artificial Sequence
  Description of Artificial Sequence: Synthetic oligonucleotide
ucagccugggccacggag

SEQ ID NO: 651 - RNA, 18 nt, Artificial Sequence
  Description of Artificial Sequence: Synthetic oligonucleotide
uaucgucagccugggcca

SEQ ID NO: 652 - RNA, 18 nt, Artificial Sequence
  Description of Artificial Sequence: Synthetic oligonucleotide
caggcuaucgucagccug

SEQ ID NO: 653 - RNA, 18 nt, Artificial Sequence
  Description of Artificial Sequence: Synthetic oligonucleotide
uuuuucaggcuaucguca

SEQ ID NO: 654 - RNA, 18 nt, Artificial Sequence
  Description of Artificial Sequence: Synthetic oligonucleotide
ggagguuuuucaggcuau

SEQ ID NO: 655 - RNA, 18 nt, Artificial Sequence
  Description of Artificial Sequence: Synthetic oligonucleotide
cagguggagguuuuucag

SEQ ID NO: 656 - RNA, 18 nt, Artificial Sequence
  Description of Artificial Sequence: Synthetic oligonucleotide
agcuccagguggagguuu

SEQ ID NO: 657 - RNA, 18 nt, Artificial Sequence
  Description of Artificial Sequence: Synthetic oligonucleotide
ccgugagcuccaggugga

SEQ ID NO: 658 - RNA, 18 nt, Artificial Sequence
  Description of Artificial Sequence: Synthetic oligonucleotide
gguuuccgugagcuccag

SEQ ID NO: 659 - RNA, 18 nt, Artificial Sequence
  Description of Artificial Sequence: Synthetic oligonucleotide
agacagguuuccgugagc

SEQ ID NO: 660 - RNA, 18 nt, Artificial Sequence
  Description of Artificial Sequence: Synthetic oligonucleotide
uguccagacagguuuccg

SEQ ID NO: 661 - RNA, 18 nt, Artificial Sequence
  Description of Artificial Sequence: Synthetic oligonucleotide
caucauguccagacaggu

SEQ ID NO: 662 - RNA, 18 nt, Artificial Sequence
  Description of Artificial Sequence: Synthetic oligonucleotide
cgagccaucauguccaga

SEQ ID NO: 663 - RNA, 18 nt, Artificial Sequence
  Description of Artificial Sequence: Synthetic oligonucleotide
cguaucgagccaucaugu

SEQ ID NO: 664 - RNA, 18 nt, Artificial Sequence
  Description of Artificial Sequence: Synthetic oligonucleotide
gaagacguaucgagccau

SEQ ID NO: 665 - RNA, 18 nt, Artificial Sequence
  Description of Artificial Sequence: Synthetic oligonucleotide
uuggagaagacguaucga

SEQ ID NO: 666 - RNA, 18 nt, Artificial Sequence
  Description of Artificial Sequence: Synthetic oligonucleotide
ugaaguuggagaagacgu

SEQ ID NO: 667 - RNA, 18 nt, Artificial Sequence
  Description of Artificial Sequence: Synthetic oligonucleotide
agccgugaaguuggagaa

SEQ ID NO: 668 - RNA, 18 nt, Artificial Sequence
  Description of Artificial Sequence: Synthetic oligonucleotide
gggacagccgugaaguug

SEQ ID NO: 669 - RNA, 18 nt, Artificial Sequence
  Description of Artificial Sequence: Synthetic oligonucleotide
ucuucgggacagccguga

SEQ ID NO: 670 - RNA, 18 nt, Artificial Sequence
  Description of Artificial Sequence: Synthetic oligonucleotide
gagugcuuccacugcgug

SEQ ID NO: 671 - RNA, 18 nt, Artificial Sequence
  Description of Artificial Sequence: Synthetic oligonucleotide
uuccagagugcuuccacu

SEQ ID NO: 672 - RNA, 18 nt, Artificial Sequence
  Description of Artificial Sequence: Synthetic oligonucleotide
ccgccuuccagagugcuu

SEQ ID NO: 673 - RNA, 18 nt, Artificial Sequence
  Description of Artificial Sequence: Synthetic oligonucleotide
cgcgaccgccuuccagag

SEQ ID NO: 674 - RNA, 18 nt, Artificial Sequence
  Description of Artificial Sequence: Synthetic oligonucleotide
agauccgcgaccgccuuc

SEQ ID NO: 675 - RNA, 18 nt, Artificial Sequence
  Description of Artificial Sequence: Synthetic oligonucleotide
gcaacagauccgcgaccg

SEQ ID NO: 676 - RNA, 18 nt, Artificial Sequence
  Description of Artificial Sequence: Synthetic oligonucleotide
cggcugcaacagauccgc

SEQ ID NO: 677 - RNA, 18 nt, Artificial Sequence
  Description of Artificial Sequence: Synthetic oligonucleotide
cgcuccggcugcaacaga

SEQ ID NO: 678 - RNA, 18 nt, Artificial Sequence
  Description of Artificial Sequence: Synthetic oligonucleotide
gcggccgcuccggcugca

SEQ ID NO: 679 - RNA, 18 nt, Artificial Sequence
  Description of Artificial Sequence: Synthetic oligonucleotide
cuccagcggccgcuccgg

SEQ ID NO: 680 - RNA, 18 nt, Artificial Sequence
  Description of Artificial Sequence: Synthetic oligonucleotide
cgggccuccagcggccgc

SEQ ID NO: 681 - RNA, 18 nt, Artificial Sequence
  Description of Artificial Sequence: Synthetic oligonucleotide
cgugccgggccuccagcg

SEQ ID NO: 682 - RNA, 18 nt, Artificial Sequence
  Description of Artificial Sequence: Synthetic oligonucleotide
caccgcgugccgggccuc

SEQ ID NO: 683 - RNA, 18 nt, Artificial Sequence
  Description of Artificial Sequence: Synthetic oligonucleotide
gccagcaccgcgugccgg

SEQ ID NO: 684 - RNA, 18 nt, Artificial Sequence
  Description of Artificial Sequence: Synthetic oligonucleotide
gcagagccagcaccgcgu

SEQ ID NO: 685 - RNA, 18 nt, Artificial Sequence
  Description of Artificial Sequence: Synthetic oligonucleotide
cuucagcagagccagcac

SEQ ID NO: 686 - RNA, 18 nt, Artificial Sequence
  Description of Artificial Sequence: Synthetic oligonucleotide
auggccuucagcagagcc

SEQ ID NO: 687 - RNA, 18 nt, Artificial Sequence
  Description of Artificial Sequence: Synthetic oligonucleotide
gcacgauggccuucagca

SEQ ID NO: 688 - RNA, 18 nt, Artificial Sequence
  Description of Artificial Sequence: Synthetic oligonucleotide
ccccugcacgauggccuu

SEQ ID NO: 689 - RNA, 18 nt, Artificial Sequence
  Description of Artificial Sequence: Synthetic oligonucleotide
cccagcgucgcccugggc

SEQ ID NO: 690 - RNA, 18 nt, Artificial Sequence
  Description of Artificial Sequence: Synthetic oligonucleotide
cccaucccagcgucgccc

SEQ ID NO: 691 - RNA, 18 nt, Artificial Sequence
  Description of Artificial Sequence: Synthetic oligonucleotide
cgucacccaucccagcgu

SEQ ID NO: 692 - RNA, 18 nt, Artificial Sequence
  Description of Artificial Sequence: Synthetic oligonucleotide
ccugacgucacccauccc

SEQ ID NO: 693 - RNA, 18 nt, Artificial Sequence
  Description of Artificial Sequence: Synthetic oligonucleotide
ggcagccugacgucaccc

SEQ ID NO: 694 - RNA, 18 nt, Artificial Sequence
  Description of Artificial Sequence: Synthetic oligonucleotide
cagugggcagccugacgu

SEQ ID NO: 695 - RNA, 18 nt, Artificial Sequence
  Description of Artificial Sequence: Synthetic oligonucleotide
acagucagugggcagccu

SEQ ID NO: 696 - RNA, 18 nt, Artificial Sequence
  Description of Artificial Sequence: Synthetic oligonucleotide
acaggacagucagugggc

SEQ ID NO: 697 - RNA, 18 nt, Artificial Sequence
  Description of Artificial Sequence: Synthetic oligonucleotide
cagggacaggacagucag

SEQ ID NO: 698 - RNA, 18 nt, Artificial Sequence
  Description of Artificial Sequence: Synthetic oligonucleotide
cccagcagggacaggaca

SEQ ID NO: 699 - RNA, 18 nt, Artificial Sequence
  Description of Artificial Sequence: Synthetic oligonucleotide
cacggcccagcagggaca

SEQ ID NO: 700 - RNA, 18 nt, Artificial Sequence
  Description of Artificial Sequence: Synthetic oligonucleotide
ccaaacacggcccagcag

SEQ ID NO: 701 - RNA, 18 nt, Artificial Sequence
  Description of Artificial Sequence: Synthetic oligonucleotide
ggaguccaaacacggccc

SEQ ID NO: 702 - RNA, 18 nt, Artificial Sequence
  Description of Artificial Sequence: Synthetic oligonucleotide
aggcaggaguccaaacac

SEQ ID NO: 703 - RNA, 18 nt, Artificial Sequence
  Description of Artificial Sequence: Synthetic oligonucleotide
caccgaggcaggagucca

SEQ ID NO: 704 - RNA, 18 nt, Artificial Sequence
  Description of Artificial Sequence: Synthetic oligonucleotide
caacucaccgaggcagga

SEQ ID NO: 705 - RNA, 18 nt, Artificial Sequence
  Description of Artificial Sequence: Synthetic oligonucleotide
cccagcaacucaccgagg

SEQ ID NO: 706 - RNA, 18 nt, Artificial Sequence
  Description of Artificial Sequence: Synthetic oligonucleotide
cugugcccagcaacucac

SEQ ID NO: 707 - RNA, 18 nt, Artificial Sequence
  Description of Artificial Sequence: Synthetic oligonucleotide
agacccugugcccagcaa

SEQ ID NO: 708 - RNA, 18 nt, Artificial Sequence
  Description of Artificial Sequence: Synthetic oligonucleotide
ccccuagacccugugccc

SEQ ID NO: 709 - RNA, 18 nt, Artificial Sequence
  Description of Artificial Sequence: Synthetic oligonucleotide
aucagccccuagacccug

SEQ ID NO: 710 - RNA, 18 nt, Artificial Sequence
  Description of Artificial Sequence: Synthetic oligonucleotide
agcccaucagccccuaga

SEQ ID NO: 711 - RNA, 18 nt, Artificial Sequence
  Description of Artificial Sequence: Synthetic oligonucleotide
uccagagcccaucagccc

SEQ ID NO: 712 - RNA, 18 nt, Artificial Sequence
  Description of Artificial Sequence: Synthetic oligonucleotide
ccagcuccagagcccauc

SEQ ID NO: 713 - RNA, 18 nt, Artificial Sequence
  Description of Artificial Sequence: Synthetic oligonucleotide
gccauccagcuccagagc

SEQ ID NO: 714 - RNA, 18 nt, Artificial Sequence
  Description of Artificial Sequence: Synthetic oligonucleotide
cacaggccauccagcucc

SEQ ID NO: 715 - RNA, 18 nt, Artificial Sequence
  Description of Artificial Sequence: Synthetic oligonucleotide
gaccccacaggccaucca

SEQ ID NO: 716 - RNA, 18 nt, Artificial Sequence
  Description of Artificial Sequence: Synthetic oligonucleotide
caggagaccccacaggcc

SEQ ID NO: 717 - RNA, 18 nt, Artificial Sequence
  Description of Artificial Sequence: Synthetic oligonucleotide
gacaccaggagaccccac

SEQ ID NO: 718 - RNA, 18 nt, Artificial Sequence
  Description of Artificial Sequence: Synthetic oligonucleotide
cucaugacaccaggagac

SEQ ID NO: 719 - RNA, 18 nt, Artificial Sequence
  Description of Artificial Sequence: Synthetic oligonucleotide
cagaccucaugacaccag

SEQ ID NO: 720 - RNA, 18 nt, Artificial Sequence
  Description of Artificial Sequence: Synthetic oligonucleotide
ucacacagaccucaugac

SEQ ID NO: 721 - RNA, 18 nt, Artificial Sequence
  Description of Artificial Sequence: Synthetic oligonucleotide
uacggucacacagaccuc

SEQ ID NO: 722 - RNA, 18 nt, Artificial Sequence
  Description of Artificial Sequence: Synthetic oligonucleotide
gugccuacggucacacag

SEQ ID NO: 723 - RNA, 18 nt, Artificial Sequence
  Description of Artificial Sequence: Synthetic oligonucleotide
aggcagugccuacgguca

SEQ ID NO: 724 - RNA, 18 nt, Artificial Sequence
  Description of Artificial Sequence: Synthetic oligonucleotide
cgaggaggcagugccuac

SEQ ID NO: 725 - RNA, 18 nt, Artificial Sequence
  Description of Artificial Sequence: Synthetic oligonucleotide
acaggcgaggaggcagug

SEQ ID NO: 726 - RNA, 18 nt, Artificial Sequence
  Description of Artificial Sequence: Synthetic oligonucleotide
uguuuacaggcgaggagg

SEQ ID NO: 727 - RNA, 18 nt, Artificial Sequence
  Description of Artificial Sequence: Synthetic oligonucleotide
ccaucuguuuacaggcga

SEQ ID NO: 728 - RNA, 18 nt, Artificial Sequence
  Description of Artificial Sequence: Synthetic oligonucleotide
agugaccaucuguuuaca

SEQ ID NO: 729 - RNA, 18 nt, Artificial Sequence
  Description of Artificial Sequence: Synthetic oligonucleotide
ggugcagugaccaucugu

SEQ ID NO: 730 - RNA, 18 nt, Artificial Sequence
  Description of Artificial Sequence: Synthetic oligonucleotide
aggaaggugcagugacca

SEQ ID NO: 731 - RNA, 18 nt, Artificial Sequence
  Description of Artificial Sequence: Synthetic oligonucleotide
auaagaggaaggugcagu

SEQ ID NO: 732 - RNA, 18 nt, Artificial Sequence
  Description of Artificial Sequence: Synthetic oligonucleotide
aucccauaagaggaaggu

SEQ ID NO: 733 - RNA, 18 nt, Artificial Sequence
  Description of Artificial Sequence: Synthetic oligonucleotide
agaacaucccauaagagg

SEQ ID NO: 734 - RNA, 18 nt, Artificial Sequence
  Description of Artificial Sequence: Synthetic oligonucleotide
uccccagaacaucccaua

SEQ ID NO: 735 - RNA, 18 nt, Artificial Sequence
  Description of Artificial Sequence: Synthetic oligonucleotide
uaugauccccagaacauc

SEQ ID NO: 736 - RNA, 18 nt, Artificial Sequence
  Description of Artificial Sequence: Synthetic oligonucleotide
ccucauaugauccccaga

SEQ ID NO: 737 - RNA, 18 nt, Artificial Sequence
  Description of Artificial Sequence: Synthetic oligonucleotide
aacugccucauaugaucc

SEQ ID NO: 738 - RNA, 18 nt, Artificial Sequence
  Description of Artificial Sequence: Synthetic oligonucleotide
gcgagaacugccucauau

SEQ ID NO: 739 - RNA, 18 nt, Artificial Sequence
  Description of Artificial Sequence: Synthetic oligonucleotide
acucugcgagaacugccu

SEQ ID NO: 740 - RNA, 18 nt, Artificial Sequence
  Description of Artificial Sequence: Synthetic oligonucleotide
ucagcacucugcgagaac

SEQ ID NO: 741 - RNA, 18 nt, Artificial Sequence
  Description of Artificial Sequence: Synthetic oligonucleotide
cgaucucagcacucugcg

SEQ ID NO: 742 - RNA, 18 nt, Artificial Sequence
  Description of Artificial Sequence: Synthetic oligonucleotide
agguacgaucucagcacu

SEQ ID NO: 743 - RNA, 18 nt, Artificial Sequence
  Description of Artificial Sequence: Synthetic oligonucleotide
cugccagguacgaucuca

SEQ ID NO: 744 - RNA, 18 nt, Artificial Sequence
  Description of Artificial Sequence: Synthetic oligonucleotide
accagcugccagguacga

SEQ ID NO: 745 - RNA, 18 nt, Artificial Sequence
  Description of Artificial Sequence: Synthetic oligonucleotide
cccacaccagcugccagg

SEQ ID NO: 746 - RNA, 18 nt, Artificial Sequence
  Description of Artificial Sequence: Synthetic oligonucleotide
guagccccacaccagcug

SEQ ID NO: 747 - RNA, 18 nt, Artificial Sequence
  Description of Artificial Sequence: Synthetic oligonucleotide
acaccguagccccacacc

SEQ ID NO: 748 - RNA, 18 nt, Artificial Sequence
  Description of Artificial Sequence: Synthetic oligonucleotide
aaacaacaccguagcccc

SEQ ID NO: 749 - RNA, 18 nt, Artificial Sequence
  Description of Artificial Sequence: Synthetic oligonucleotide
gggcaaaacaacaccgua

SEQ ID NO: 750 - RNA, 18 nt, Artificial Sequence
  Description of Artificial Sequence: Synthetic oligonucleotide
ugcaagggcaaaacaaca

SEQ ID NO: 751 - RNA, 18 nt, Artificial Sequence
  Description of Artificial Sequence: Synthetic oligonucleotide
aagggugcaagggcaaaa

SEQ ID NO: 752 - RNA, 18 nt, Artificial Sequence
  Description of Artificial Sequence: Synthetic oligonucleotide
cccgaaagggugcaaggg

SEQ ID NO: 753 - RNA, 18 nt, Artificial Sequence
  Description of Artificial Sequence: Synthetic oligonucleotide
guggccccgaaagggugc

SEQ ID NO: 754 - RNA, 18 nt, Artificial Sequence
  Description of Artificial Sequence: Synthetic oligonucleotide
gggaguggccccgaaagg

SEQ ID NO: 755 - RNA, 18 nt, Artificial Sequence
  Description of Artificial Sequence: Synthetic oligonucleotide
ggaaugcagugagcaggg

SEQ ID NO: 756 - RNA, 18 nt, Artificial Sequence
  Description of Artificial Sequence: Synthetic oligonucleotide
cagauggaaugcagugag

SEQ ID NO: 757 - RNA, 18 nt, Artificial Sequence
  Description of Artificial Sequence: Synthetic oligonucleotide
cagcacagauggaaugca

SEQ ID NO: 758 - RNA, 18 nt, Artificial Sequence
  Description of Artificial Sequence: Synthetic oligonucleotide
aagaccagcacagaugga

SEQ ID NO: 759 - RNA, 18 nt, Artificial Sequence
  Description of Artificial Sequence: Synthetic oligonucleotide
cagccaagaccagcacag

SEQ ID NO: 760 - RNA, 18 nt, Artificial Sequence
  Description of Artificial Sequence: Synthetic oligonucleotide
agggucagccaagaccag

SEQ ID NO: 761 - RNA, 18 nt, Artificial Sequence
  Description of Artificial Sequence: Synthetic oligonucleotide
uguucagggucagccaag

SEQ ID NO: 762 - RNA, 18 nt, Artificial Sequence
  Description of Artificial Sequence: Synthetic oligonucleotide
cuggguguucagggucag

SEQ ID NO: 763 - RNA, 18 nt, Artificial Sequence
  Description of Artificial Sequence: Synthetic oligonucleotide
gaggccuggguguucagg

SEQ ID NO: 764 - RNA, 18 nt, Artificial Sequence
  Description of Artificial Sequence: Synthetic oligonucleotide
accaagaggccugggugu

SEQ ID NO: 765 - RNA, 18 nt, Artificial Sequence
  Description of Artificial Sequence: Synthetic oligonucleotide
ggaacaccaagaggccug

SEQ ID NO: 766 - RNA, 18 nt, Artificial Sequence
  Description of Artificial Sequence: Synthetic oligonucleotide
aggcaggaacaccaagag

SEQ ID NO: 767 - RNA, 18 nt, Artificial Sequence
  Description of Artificial Sequence: Synthetic oligonucleotide
gggaggcaggaacaccaa

SEQ ID NO: 768 - RNA, 18 nt, Artificial Sequence
  Description of Artificial Sequence: Synthetic oligonucleotide
agaaguggccgaccaggg

SEQ ID NO: 769 - RNA, 18 nt, Artificial Sequence
  Description of Artificial Sequence: Synthetic oligonucleotide
ggaguagaaguggccgac

SEQ ID NO: 770 - RNA, 18 nt, Artificial Sequence
  Description of Artificial Sequence: Synthetic oligonucleotide
augaaggaguagaagugg

SEQ ID NO: 771 - RNA, 18 nt, Artificial Sequence
  Description of Artificial Sequence: Synthetic oligonucleotide
gggacaugaaggaguaga

SEQ ID NO: 772 - RNA, 18 nt, Artificial Sequence
  Description of Artificial Sequence: Synthetic oligonucleotide
gaacaccaagaggccugg

SEQ ID NO: 773 - RNA, 18 nt, Artificial Sequence
  Description of Artificial Sequence: Synthetic oligonucleotide
ggcaggaacaccaagagg

SEQ ID NO: 774 - RNA, 18 nt, Artificial Sequence
  Description of Artificial Sequence: Synthetic oligonucleotide
agaaguggccgaccaggg

SEQ ID NO: 775 - RNA, 18 nt, Artificial Sequence
  Description of Artificial Sequence: Synthetic oligonucleotide
ggaguagaaguggccgac

SEQ ID NO: 776 - RNA, 18 nt, Artificial Sequence
  Description of Artificial Sequence: Synthetic oligonucleotide
augaaggaguagaagugg

SEQ ID NO: 777 - RNA, 18 nt, Artificial Sequence
  Description of Artificial Sequence: Synthetic oligonucleotide
gggacaugaaggaguaga

SEQ ID NO: 778 - RNA, 18 nt, Artificial Sequence
  Description of Artificial Sequence: Synthetic oligonucleotide
cagcugggacaugaagga

SEQ ID NO: 779 - RNA, 18 nt, Artificial Sequence
  Description of Artificial Sequence: Synthetic oligonucleotide
cugagcagcugggacaug

SEQ ID NO: 780 - RNA, 18 nt, Artificial Sequence
  Description of Artificial Sequence: Synthetic oligonucleotide
cccuucugagcagcuggg

SEQ ID NO: 781 - RNA, 18 nt, Artificial Sequence
  Description of Artificial Sequence: Synthetic oligonucleotide
gacggcccuucugagcag

SEQ ID NO: 782 - RNA, 18 nt, Artificial Sequence
  Description of Artificial Sequence: Synthetic oligonucleotide
gaguggacggcccuucug

SEQ ID NO: 783 - RNA, 18 nt, Artificial Sequence
  Description of Artificial Sequence: Synthetic oligonucleotide
ugugagaguggacggccc

SEQ ID NO: 784 - RNA, 18 nt, Artificial Sequence
  Description of Artificial Sequence: Synthetic oligonucleotide
gagccugugagaguggac

SEQ ID NO: 785 - RNA, 18 nt, Artificial Sequence
  Description of Artificial Sequence: Synthetic oligonucleotide
caggagagccugugagag

SEQ ID NO: 786 - RNA, 18 nt, Artificial Sequence
  Description of Artificial Sequence: Synthetic oligonucleotide
aaacccaggagagccugu

SEQ ID NO: 787 - RNA, 18 nt, Artificial Sequence
  Description of Artificial Sequence: Synthetic oligonucleotide
ggacaaggccugaguggg

SEQ ID NO: 788 - RNA, 18 nt, Artificial Sequence
  Description of Artificial Sequence: Synthetic oligonucleotide
acugaggacaaggccuga

SEQ ID NO: 789 - RNA, 18 nt, Artificial Sequence
  Description of Artificial Sequence: Synthetic oligonucleotide
cagagacugaggacaagg

SEQ ID NO: 790 - RNA, 18 nt, Artificial Sequence
  Description of Artificial Sequence: Synthetic oligonucleotide
gugcucagagacugagga

SEQ ID NO: 791 - RNA, 18 nt, Artificial Sequence
  Description of Artificial Sequence: Synthetic oligonucleotide
gccuugugcucagagacu

SEQ ID NO: 792 - RNA, 18 nt, Artificial Sequence
  Description of Artificial Sequence: Synthetic oligonucleotide
agacagccuugugcucag

SEQ ID NO: 793 - RNA, 18 nt, Artificial Sequence
  Description of Artificial Sequence: Synthetic oligonucleotide
agggcagacagccuugug

SEQ ID NO: 794 - RNA, 18 nt, Artificial Sequence
  Description of Artificial Sequence: Synthetic oligonucleotide
ggugcagggcagacagcc

SEQ ID NO: 795 - RNA, 18 nt, Artificial Sequence
  Description of Artificial Sequence: Synthetic oligonucleotide
cacucggugcagggcaga

SEQ ID NO: 796 - RNA, 18 nt, Artificial Sequence
  Description of Artificial Sequence: Synthetic oligonucleotide
cccugcacucggugcagg

SEQ ID NO: 797 - RNA, 18 nt, Artificial Sequence
  Description of Artificial Sequence: Synthetic oligonucleotide
ccgaccccugcacucggu

SEQ ID NO: 798 - RNA, 18 nt, Artificial Sequence
  Description of Artificial Sequence: Synthetic oligonucleotide
ccugcccgaccccugcac

SEQ ID NO: 799 - RNA, 18 nt, Artificial Sequence
  Description of Artificial Sequence: Synthetic oligonucleotide
cagcuccugcccgacccc

SEQ ID NO: 800 - RNA, 18 nt, Artificial Sequence
  Description of Artificial Sequence: Synthetic oligonucleotide
ugacacagcuccugcccg

SEQ ID NO: 801 - RNA, 18 nt, Artificial Sequence
  Description of Artificial Sequence: Synthetic oligonucleotide
ggguggcgcagagcaggg

SEQ ID NO: 802 - RNA, 18 nt, Artificial Sequence
  Description of Artificial Sequence: Synthetic oligonucleotide
acagcggguggcgcagag

SEQ ID NO: 803 - RNA, 18 nt, Artificial Sequence
  Description of Artificial Sequence: Synthetic oligonucleotide
cuggcacagcggguggcg

SEQ ID NO: 804 - RNA, 18 nt, Artificial Sequence
  Description of Artificial Sequence: Synthetic oligonucleotide
gggaccuggcacagcggg

SEQ ID NO: 805 - RNA, 18 nt, Artificial Sequence
  Description of Artificial Sequence: Synthetic oligonucleotide
gugucgggaccuggcaca

SEQ ID NO: 806 - RNA, 18 nt, Artificial Sequence
  Description of Artificial Sequence: Synthetic oligonucleotide
gcugugugucgggaccug

SEQ ID NO: 807 - RNA, 18 nt, Artificial Sequence
  Description of Artificial Sequence: Synthetic oligonucleotide
caacugcugugugucggg

SEQ ID NO: 808 - RNA, 18 nt, Artificial Sequence
  Description of Artificial Sequence: Synthetic oligonucleotide
gggagcaacugcugugug

SEQ ID NO: 809 - RNA, 18 nt, Artificial Sequence
  Description of Artificial Sequence: Synthetic oligonucleotide
cgcagagcggcguauggg

SEQ ID NO: 810 - RNA, 18 nt, Artificial Sequence
  Description of Artificial Sequence: Synthetic oligonucleotide
gaccgcagagcggcguau

SEQ ID NO: 811 - RNA, 18 nt, Artificial Sequence
  Description of Artificial Sequence: Synthetic oligonucleotide
cggccgaccgcagagcgg

SEQ ID NO: 812 - RNA, 18 nt, Artificial Sequence
  Description of Artificial Sequence: Synthetic oligonucleotide
ugcaccggccgaccgcag

SEQ ID NO: 813 - RNA, 18 nt, Artificial Sequence
  Description of Artificial Sequence: Synthetic oligonucleotide
ccggaugcaccggccgac

SEQ ID NO: 814 - RNA, 18 nt, Artificial Sequence
  Description of Artificial Sequence: Synthetic oligonucleotide
gcauuguacagggcaggg

SEQ ID NO: 815 - RNA, 18 nt, Artificial Sequence
  Description of Artificial Sequence: Synthetic oligonucleotide
caucagcauuguacaggg

SEQ ID NO: 816 - RNA, 18 nt, Artificial Sequence
  Description of Artificial Sequence: Synthetic oligonucleotide
ugcagcaucagcauugua

SEQ ID NO: 817 - RNA, 18 nt, Artificial Sequence
  Description of Artificial Sequence: Synthetic oligonucleotide
aggucugcagcaucagca

SEQ ID NO: 818 - RNA, 18 nt, Artificial Sequence
  Description of Artificial Sequence: Synthetic oligonucleotide
gagacaggucugcagcau

SEQ ID NO: 819 - RNA, 18 nt, Artificial Sequence
  Description of Artificial Sequence: Synthetic oligonucleotide
ugcaagagacaggucugc

SEQ ID NO: 820 - RNA, 18 nt, Artificial Sequence
  Description of Artificial Sequence: Synthetic oligonucleotide
cgcccugcaagagacagg

SEQ ID NO: 821 - RNA, 18 nt, Artificial Sequence
  Description of Artificial Sequence: Synthetic oligonucleotide
agaggcgcccugcaagag

SEQ ID NO: 822 - RNA, 18 nt, Artificial Sequence
  Description of Artificial Sequence: Synthetic oligonucleotide
cccacagaggcgcccugc

SEQ ID NO: 823 - RNA, 18 nt, Artificial Sequence
  Description of Artificial Sequence: Synthetic oligonucleotide
uccuucccacagaggcgc

SEQ ID NO: 824 - RNA, 18 nt, Artificial Sequence
  Description of Artificial Sequence: Synthetic oligonucleotide
cccucuccuucccacaga

SEQ ID NO: 825 - RNA, 18 nt, Artificial Sequence
  Description of Artificial Sequence: Synthetic oligonucleotide
uggaccccucuccuuccc

SEQ ID NO: 826 - RNA, 18 nt, Artificial Sequence
  Description of Artificial Sequence: Synthetic oligonucleotide
agcccuggaccccucucc

SEQ ID NO: 827 - RNA, 18 nt, Artificial Sequence
  Description of Artificial Sequence: Synthetic oligonucleotide
acuccagcccuggacccc

SEQ ID NO: 828 - RNA, 18 nt, Artificial Sequence
  Description of Artificial Sequence: Synthetic oligonucleotide
cccggacuccagcccugg

SEQ ID NO: 829 - RNA, 18 nt, Artificial Sequence
  Description of Artificial Sequence: Synthetic oligonucleotide
gggcacccggacuccagc

SEQ ID NO: 830 - RNA, 18 nt, Artificial Sequence
  Description of Artificial Sequence: Synthetic oligonucleotide
agucccugaagugcaggg

SEQ ID NO: 831 - RNA, 18 nt, Artificial Sequence
  Description of Artificial Sequence: Synthetic oligonucleotide
aagucccugaagugcagg

SEQ ID NO: 832 - RNA, 18 nt, Artificial Sequence
  Description of Artificial Sequence: Synthetic oligonucleotide
ccaagaagucccugaagu

SEQ ID NO: 833 - RNA, 18 nt, Artificial Sequence
  Description of Artificial Sequence: Synthetic oligonucleotide
ggcugccaagaagucccu

SEQ ID NO: 834 - RNA, 18 nt, Artificial Sequence
  Description of Artificial Sequence: Synthetic oligonucleotide
cacacggcugccaagaag

SEQ ID NO: 835 - RNA, 18 nt, Artificial Sequence
  Description of Artificial Sequence: Synthetic oligonucleotide
ucgcccacacggcugcca

SEQ ID NO: 836 - RNA, 18 nt, Artificial Sequence
  Description of Artificial Sequence: Synthetic oligonucleotide
cagcgucgcccacacggc

SEQ ID NO: 837 - RNA, 18 nt, Artificial Sequence
  Description of Artificial Sequence: Synthetic oligonucleotide
ccugccagcgucgcccac

SEQ ID NO: 838 - RNA, 18 nt, Artificial Sequence
  Description of Artificial Sequence: Synthetic oligonucleotide
cagagccugccagcgucg

SEQ ID NO: 839 - RNA, 18 nt, Artificial Sequence
  Description of Artificial Sequence: Synthetic oligonucleotide
aucagcagagccugccag

SEQ ID NO: 840 - RNA, 18 nt, Artificial Sequence
  Description of Artificial Sequence: Synthetic oligonucleotide
acaggaucagcagagccu

SEQ ID NO: 841 - RNA, 18 nt, Artificial Sequence
  Description of Artificial Sequence: Synthetic oligonucleotide
ggacccccaaacgcucgc

SEQ ID NO: 842 - RNA, 18 nt, Artificial Sequence
  Description of Artificial Sequence: Synthetic oligonucleotide
ucugaggacccccaaacg

SEQ ID NO: 843 - RNA, 18 nt, Artificial Sequence
  Description of Artificial Sequence: Synthetic oligonucleotide
agggcucugaggaccccc

SEQ ID NO: 844 - RNA, 18 nt, Artificial Sequence
  Description of Artificial Sequence: Synthetic oligonucleotide
agaagagggcucugagga

SEQ ID NO: 845 - RNA, 18 nt, Artificial Sequence
  Description of Artificial Sequence: Synthetic oligonucleotide
cuuaaagaagagggcucu

SEQ ID NO: 846 - RNA, 18 nt, Artificial Sequence
  Description of Artificial Sequence: Synthetic oligonucleotide
augaccuuaaagaagagg

SEQ ID NO: 847 - RNA, 18 nt, Artificial Sequence
  Description of Artificial Sequence: Synthetic oligonucleotide
ccuugaugaccuuaaaga

SEQ ID NO: 848 - RNA, 18 nt, Artificial Sequence
  Description of Artificial Sequence: Synthetic oligonucleotide
guaauccuugaugaccuu

SEQ ID NO: 849 - RNA, 18 nt, Artificial Sequence
  Description of Artificial Sequence: Synthetic oligonucleotide
gaaggguaauccuugaug

SEQ ID NO: 850 - RNA, 18 nt, Artificial Sequence
  Description of Artificial Sequence: Synthetic oligonucleotide
cguuggaaggguaauccu

SEQ ID NO: 851 - RNA, 18 nt, Artificial Sequence
  Description of Artificial Sequence: Synthetic oligonucleotide
gucuucguuggaagggua

SEQ ID NO: 852 - RNA, 18 nt, Artificial Sequence
  Description of Artificial Sequence: Synthetic oligonucleotide
ugaaggucuucguuggaa

SEQ ID NO: 853 - RNA, 18 nt, Artificial Sequence
  Description of Artificial Sequence: Synthetic oligonucleotide
uuucgugaaggucuucgu

SEQ ID NO: 854 - RNA, 18 nt, Artificial Sequence
  Description of Artificial Sequence: Synthetic oligonucleotide
cagccuuucgugaagguc

SEQ ID NO: 855 - RNA, 18 nt, Artificial Sequence
  Description of Artificial Sequence: Synthetic oligonucleotide
accuccagccuuucguga

SEQ ID NO: 856 - RNA, 18 nt, Artificial Sequence
  Description of Artificial Sequence: Synthetic oligonucleotide
ugaaaaccuccagccuuu

SEQ ID NO: 857 - RNA, 18 nt, Artificial Sequence
  Description of Artificial Sequence: Synthetic oligonucleotide
ggccuugaaaaccuccag

SEQ ID NO: 858 - RNA, 18 nt, Artificial Sequence
  Description of Artificial Sequence: Synthetic oligonucleotide
gugagggccuugaaaacc

SEQ ID NO: 859 - RNA, 18 nt, Artificial Sequence
  Description of Artificial Sequence: Synthetic oligonucleotide
ugucugugagggccuuga

SEQ ID NO: 860 - RNA, 18 nt, Artificial Sequence
  Description of Artificial Sequence: Synthetic oligonucleotide
cccauugucugugagggc

SEQ ID NO: 861 - RNA, 18 nt, Artificial Sequence
  Description of Artificial Sequence: Synthetic oligonucleotide
ugucucccauugucugug

SEQ ID NO: 862 - RNA, 18 nt, Artificial Sequence
  Description of Artificial Sequence: Synthetic oligonucleotide
ugaugugucucccauugu

SEQ ID NO: 863 - RNA, 18 nt, Artificial Sequence
  Description of Artificial Sequence: Synthetic oligonucleotide
guaggugaugugucuccc

SEQ ID NO: 864 - RNA, 18 nt, Artificial Sequence
  Description of Artificial Sequence: Synthetic oligonucleotide
uccaaguaggugaugugu

SEQ ID NO: 865 - RNA, 18 nt, Artificial Sequence
  Description of Artificial Sequence: Synthetic oligonucleotide
cuuccuccaaguagguga

SEQ ID NO: 866 - RNA, 18 nt, Artificial Sequence
  Description of Artificial Sequence: Synthetic oligonucleotide
cagcucuuccuccaagua

SEQ ID NO: 867 - RNA, 18 nt, Artificial Sequence
  Description of Artificial Sequence: Synthetic oligonucleotide
ucaucagccagcuggugu

SEQ ID NO: 868 - RNA, 18 nt, Artificial Sequence
  Description of Artificial Sequence: Synthetic oligonucleotide
caggcucaucagccagcu

SEQ ID NO: 869 - RNA, 18 nt, Artificial Sequence
  Description of Artificial Sequence: Synthetic oligonucleotide
uucuccaggcucaucagc

SEQ ID NO: 870 - RNA, 18 nt, Artificial Sequence
  Description of Artificial Sequence: Synthetic oligonucleotide
gcggguucuccaggcuca

SEQ ID NO: 871 - RNA, 18 nt, Artificial Sequence
  Description of Artificial Sequence: Synthetic oligonucleotide
gcugagcggguucuccag

SEQ ID NO: 872 - RNA, 18 nt, Artificial Sequence
  Description of Artificial Sequence: Synthetic oligonucleotide
aaagggcugagcggguuc

SEQ ID NO: 873 - RNA, 18 nt, Artificial Sequence
  Description of Artificial Sequence: Synthetic oligonucleotide
aggagaaagggcugagcg

SEQ ID NO: 874 - RNA, 18 nt, Artificial Sequence
  Description of Artificial Sequence: Synthetic oligonucleotide
guccgaggagaaagggcu

SEQ ID NO: 875 - RNA, 18 nt, Artificial Sequence
  Description of Artificial Sequence: Synthetic oligonucleotide
uugauguccgaggagaaa

SEQ ID NO: 876 - RNA, 18 nt, Artificial Sequence
  Description of Artificial Sequence: Synthetic oligonucleotide
uguuguugauguccgagg

SEQ ID NO: 877 - RNA, 18 nt, Artificial Sequence
  Description of Artificial Sequence: Synthetic oligonucleotide
gggcauguuguugauguc

SEQ ID NO: 878 - RNA, 18 nt, Artificial Sequence
  Description of Artificial Sequence: Synthetic oligonucleotide
uagacagcuccugcaggg

SEQ ID NO: 879 - RNA, 18 nt, Artificial Sequence
  Description of Artificial Sequence: Synthetic oligonucleotide
gcguuagacagcuccugc

SEQ ID NO: 880 - RNA, 18 nt, Artificial Sequence
  Description of Artificial Sequence: Synthetic oligonucleotide
ugagggcguuagacagcu

SEQ ID NO: 881 - RNA, 18 nt, Artificial Sequence
  Description of Artificial Sequence: Synthetic oligonucleotide
cgccaugagggcguuaga

SEQ ID NO: 882 - RNA, 18 nt, Artificial Sequence
  Description of Artificial Sequence: Synthetic oligonucleotide
ucagccgccaugagggcg

SEQ ID NO: 883 - RNA, 18 nt, Artificial Sequence
  Description of Artificial Sequence: Synthetic oligonucleotide
agcgcucagccgccauga

SEQ ID NO: 884 - RNA, 18 nt, Artificial Sequence
  Description of Artificial Sequence: Synthetic oligonucleotide
cuugaagcgcucagccgc

SEQ ID NO: 885 - RNA, 18 nt, Artificial Sequence
  Description of Artificial Sequence: Synthetic oligonucleotide
ugcuccuugaagcgcuca

SEQ ID NO: 886 - RNA, 18 nt, Artificial Sequence
  Description of Artificial Sequence: Synthetic oligonucleotide
cccggugcuccuugaagc

SEQ ID NO: 887 - RNA, 18 nt, Artificial Sequence
  Description of Artificial Sequence: Synthetic oligonucleotide
ugugucccggugcuccuu

SEQ ID NO: 888 - RNA, 18 nt, Artificial Sequence
  Description of Artificial Sequence: Synthetic oligonucleotide
agggcugugucccggugc

SEQ ID NO: 889 - RNA, 18 nt, Artificial Sequence
  Description of Artificial Sequence: Synthetic oligonucleotide
uguacagggcuguguccc

SEQ ID NO: 890 - RNA, 18 nt, Artificial Sequence
  Description of Artificial Sequence: Synthetic oligonucleotide
ugacuuguacagggcugu

SEQ ID NO: 891 - RNA, 18 nt, Artificial Sequence
  Description of Artificial Sequence: Synthetic oligonucleotide
gacagugacuuguacagg

SEQ ID NO: 892 - RNA, 18 nt, Artificial Sequence
  Description of Artificial Sequence: Synthetic oligonucleotide
gcaccgacagugacuugu

SEQ ID NO: 893 - RNA, 18 nt, Artificial Sequence
  Description of Artificial Sequence: Synthetic oligonucleotide
ugccggcaccgacaguga

SEQ ID NO: 894 - RNA, 18 nt, Artificial Sequence
  Description of Artificial Sequence: Synthetic oligonucleotide
cuggcugccggcaccgac

SEQ ID NO: 895 - RNA, 18 nt, Artificial Sequence
  Description of Artificial Sequence: Synthetic oligonucleotide
ccgugcuggcugccggca

SEQ ID NO: 896 - RNA, 18 nt, Artificial Sequence
  Description of Artificial Sequence: Synthetic oligonucleotide
uuuggccgugcuggcugc

SEQ ID NO: 897 - RNA, 18 nt, Artificial Sequence
  Description of Artificial Sequence: Synthetic oligonucleotide
gagcgaggcagaggaggg

SEQ ID NO: 898 - RNA, 18 nt, Artificial Sequence
  Description of Artificial Sequence: Synthetic oligonucleotide
uguuggagcgaggcagag

SEQ ID NO: 899 - RNA, 18 nt, Artificial Sequence
  Description of Artificial Sequence: Synthetic oligonucleotide
ccaaggcccgccaugcca

SEQ ID NO: 900 - RNA, 18 nt, Artificial Sequence
  Description of Artificial Sequence: Synthetic oligonucleotide
ccgugccaaggcccgcca

SEQ ID NO: 901 - RNA, 18 nt, Artificial Sequence
  Description of Artificial Sequence: Synthetic oligonucleotide
agagcccgugccaaggcc

SEQ ID NO: 902 - RNA, 18 nt, Artificial Sequence
  Description of Artificial Sequence: Synthetic oligonucleotide
ggagcagagcccgugcca

SEQ ID NO: 903 - RNA, 18 nt, Artificial Sequence
  Description of Artificial Sequence: Synthetic oligonucleotide
cagugggagcagagcccg

SEQ ID NO: 904 - RNA, 18 nt, Artificial Sequence
  Description of Artificial Sequence: Synthetic oligonucleotide
caggccagugggagcaga

SEQ ID NO: 905 - RNA, 18 nt, Artificial Sequence
  Description of Artificial Sequence: Synthetic oligonucleotide
agcaccaggccaguggga

SEQ ID NO: 906 - RNA, 18 nt, Artificial Sequence
  Description of Artificial Sequence: Synthetic oligonucleotide
ccgggagcaccaggccag

SEQ ID NO: 907 - RNA, 18 nt, Artificial Sequence
  Description of Artificial Sequence: Synthetic oligonucleotide
cgucaccgggagcaccag

SEQ ID NO: 908 - RNA, 18 nt, Artificial Sequence
  Description of Artificial Sequence: Synthetic oligonucleotide
auugccgucaccgggagc

SEQ ID NO: 909 - RNA, 18 nt, Artificial Sequence
  Description of Artificial Sequence: Synthetic oligonucleotide
gccacauugccgucaccg

SEQ ID NO: 910 - RNA, 18 nt, Artificial Sequence
  Description of Artificial Sequence: Synthetic oligonucleotide
gaggagccacauugccgu

SEQ ID NO: 911 - RNA, 18 nt, Artificial Sequence
  Description of Artificial Sequence: Synthetic oligonucleotide
gcagagaggagccacauu

SEQ ID NO: 912 - RNA, 18 nt, Artificial Sequence
  Description of Artificial Sequence: Synthetic oligonucleotide
ccucagcagagaggagcc

SEQ ID NO: 913 - RNA, 18 nt, Artificial Sequence
  Description of Artificial Sequence: Synthetic oligonucleotide
ggcgcccucagcagagag

SEQ ID NO: 914 - RNA, 18 nt, Artificial Sequence
  Description of Artificial Sequence: Synthetic oligonucleotide
gugugggcgcccucagca

SEQ ID NO: 915 - RNA, 18 nt, Artificial Sequence
  Description of Artificial Sequence: Synthetic oligonucleotide
cagccgugugggcgcccu

SEQ ID NO: 916 - RNA, 18 nt, Artificial Sequence
  Description of Artificial Sequence: Synthetic oligonucleotide
acucccagccgugugggc

SEQ ID NO: 917 - RNA, 18 nt, Artificial Sequence
  Description of Artificial Sequence: Synthetic oligonucleotide
ggaccacucccagccgug

SEQ ID NO: 918 - RNA, 18 nt, Artificial Sequence
  Description of Artificial Sequence: Synthetic oligonucleotide
gccagggaccacucccag

SEQ ID NO: 919 - RNA, 18 nt, Artificial Sequence
  Description of Artificial Sequence: Synthetic oligonucleotide
ggcaggccagggaccacu

SEQ ID NO: 920 - RNA, 18 nt, Artificial Sequence
  Description of Artificial Sequence: Synthetic oligonucleotide
gcugaggcaggccaggga

SEQ ID NO: 921 - RNA, 18 nt, Artificial Sequence
  Description of Artificial Sequence: Synthetic oligonucleotide
auggugcugaggcaggcc

SEQ ID NO: 922 - RNA, 18 nt, Artificial Sequence
  Description of Artificial Sequence: Synthetic oligonucleotide
gaacaauggugcugaggc

SEQ ID NO: 923 - RNA, 18 nt, Artificial Sequence
  Description of Artificial Sequence: Synthetic oligonucleotide
ccggagaacaauggugcu

SEQ ID NO: 924 - RNA, 18 nt, Artificial Sequence
  Description of Artificial Sequence: Synthetic oligonucleotide
aaacaccggagaacaaug

SEQ ID NO: 925 - RNA, 18 nt, Artificial Sequence
  Description of Artificial Sequence: Synthetic oligonucleotide
cucccaaacaccggagaa

SEQ ID NO: 926 - RNA, 18 nt, Artificial Sequence
  Description of Artificial Sequence: Synthetic oligonucleotide
gccuccucccaaacaccg

SEQ ID NO: 927 - RNA, 18 nt, Artificial Sequence
  Description of Artificial Sequence: Synthetic oligonucleotide
ggucagccuccucccaaa

SEQ ID NO: 928 - RNA, 18 nt, Artificial Sequence
  Description of Artificial Sequence: Synthetic oligonucleotide
ccacgggucagccuccuc

SEQ ID NO: 929 - RNA, 18 nt, Artificial Sequence
  Description of Artificial Sequence: Synthetic oligonucleotide
accucccacgggucagcc

SEQ ID NO: 930 - RNA, 18 nt, Artificial Sequence
  Description of Artificial Sequence: Synthetic oligonucleotide
cagacaccucccacgggu

SEQ ID NO: 931 - RNA, 18 nt, Artificial Sequence
  Description of Artificial Sequence: Synthetic oligonucleotide
cagggcagacaccuccca

SEQ ID NO: 932 - RNA, 18 nt, Artificial Sequence
  Description of Artificial Sequence: Synthetic oligonucleotide
cugagcagggcagacacc

SEQ ID NO: 933 - RNA, 18 nt, Artificial Sequence
  Description of Artificial Sequence: Synthetic oligonucleotide
gcuuccugagcagggcag

SEQ ID NO: 934 - RNA, 18 nt, Artificial Sequence
  Description of Artificial Sequence: Synthetic oligonucleotide
ccccagcuuccugagcag

SEQ ID NO: 935 - RNA, 18 nt, Artificial Sequence
  Description of Artificial Sequence: Synthetic oligonucleotide
gccagccccagcuuccug

SEQ ID NO: 936 - RNA, 18 nt, Artificial Sequence
  Description of Artificial Sequence: Synthetic oligonucleotide
aagcugccagccccagcu

SEQ ID NO: 937 - RNA, 18 nt, Artificial Sequence
  Description of Artificial Sequence: Synthetic oligonucleotide
uucugaagcugccagccc

SEQ ID NO: 938 - RNA, 18 nt, Artificial Sequence
  Description of Artificial Sequence: Synthetic oligonucleotide
acugcuucugaagcugcc

SEQ ID NO: 939 - RNA, 18 nt, Artificial Sequence
  Description of Artificial Sequence: Synthetic oligonucleotide
ccccuacugcuucugaag

SEQ ID NO: 940 - RNA, 18 nt, Artificial Sequence
  Description of Artificial Sequence: Synthetic oligonucleotide
cagggccccuacugcuuc

SEQ ID NO: 941 - RNA, 18 nt, Artificial Sequence
  Description of Artificial Sequence: Synthetic oligonucleotide
cuccacagggccccuacu

SEQ ID NO: 942 - RNA, 18 nt, Artificial Sequence
  Description of Artificial Sequence: Synthetic oligonucleotide
agaggcuccacagggccc

SEQ ID NO: 943 - RNA, 18 nt, Artificial Sequence
  Description of Artificial Sequence: Synthetic oligonucleotide
ugggcagaggcuccacag

SEQ ID NO: 944 - RNA, 18 nt, Artificial Sequence
  Description of Artificial Sequence: Synthetic oligonucleotide
gaugcugggcagaggcuc

SEQ ID NO: 945 - RNA, 18 nt, Artificial Sequence
  Description of Artificial Sequence: Synthetic oligonucleotide
cggaggaugcugggcaga

SEQ ID NO: 946 - RNA, 18 nt, Artificial Sequence
  Description of Artificial Sequence: Synthetic oligonucleotide
ccccacggaggaugcugg

SEQ ID NO: 947 - RNA, 18 nt, Artificial Sequence
  Description of Artificial Sequence: Synthetic oligonucleotide
ggacuccccacggaggau

SEQ ID NO: 948 - RNA, 18 nt, Artificial Sequence
  Description of Artificial Sequence: Synthetic oligonucleotide
gugcuggacuccccacgg

SEQ ID NO: 949 - RNA, 18 nt, Artificial Sequence
  Description of Artificial Sequence: Synthetic oligonucleotide
ccgcagugcuggacuccc

SEQ ID NO: 950 - RNA, 18 nt, Artificial Sequence
  Description of Artificial Sequence: Synthetic oligonucleotide
ggagcccgcagugcugga

SEQ ID NO: 951 - RNA, 18 nt, Artificial Sequence
  Description of Artificial Sequence: Synthetic oligonucleotide
cuccuggagcccgcagug

SEQ ID NO: 952 - RNA, 18 nt, Artificial Sequence
  Description of Artificial Sequence: Synthetic oligonucleotide
agagccuccuggagcccg

SEQ ID NO: 953 - RNA, 18 nt, Artificial Sequence
  Description of Artificial Sequence: Synthetic oligonucleotide
gccgcagagccuccugga

SEQ ID NO: 954 - RNA, 18 nt, Artificial Sequence
  Description of Artificial Sequence: Synthetic oligonucleotide
aggcugccgcagagccuc

SEQ ID NO: 955 - RNA, 18 nt, Artificial Sequence
  Description of Artificial Sequence: Synthetic oligonucleotide
gagggaggcugccgcaga

SEQ ID NO: 956 - RNA, 18 nt, Artificial Sequence
  Description of Artificial Sequence: Synthetic oligonucleotide
gcagggagggaggcugcc

SEQ ID NO: 957 - RNA, 18 nt, Artificial Sequence
  Description of Artificial Sequence: Synthetic oligonucleotide
cccaggcagggagggagg

SEQ ID NO: 958 - RNA, 18 nt, Artificial Sequence
  Description of Artificial Sequence: Synthetic oligonucleotide
cugggcccaggcagggag

SEQ ID NO: 959 - RNA, 18 nt, Artificial Sequence
  Description of Artificial Sequence: Synthetic oligonucleotide
caaaccugggcccaggca

SEQ ID NO: 960 - RNA, 18 nt, Artificial Sequence
  Description of Artificial Sequence: Synthetic oligonucleotide
guguccaaaccugggccc

SEQ ID NO: 961 - RNA, 18 nt, Artificial Sequence
  Description of Artificial Sequence: Synthetic oligonucleotide
cucagguguccaaaccug

SEQ ID NO: 962 - RNA, 18 nt, Artificial Sequence
  Description of Artificial Sequence: Synthetic oligonucleotide
gcgggcucagguguccaa

SEQ ID NO: 963 - RNA, 18 nt, Artificial Sequence
  Description of Artificial Sequence: Synthetic oligonucleotide
cgcaggcgggcucaggug

SEQ ID NO: 964 - RNA, 18 nt, Artificial Sequence
  Description of Artificial Sequence: Synthetic oligonucleotide
gagugcgcaggcgggcuc

SEQ ID NO: 965 - RNA, 18 nt, Artificial Sequence
  Description of Artificial Sequence: Synthetic oligonucleotide
gcccagagugcgcaggcg

SEQ ID NO: 966 - RNA, 18 nt, Artificial Sequence
  Description of Artificial Sequence: Synthetic oligonucleotide
gggcccagagugcgcagg

SEQ ID NO: 967 - RNA, 18 nt, Artificial Sequence
  Description of Artificial Sequence: Synthetic oligonucleotide
agcacggugccgaguggg

SEQ ID NO: 968 - RNA, 18 nt, Artificial Sequence
  Description of Artificial Sequence: Synthetic oligonucleotide
cgagaagcacggugccga

SEQ ID NO: 969 - RNA, 18 nt, Artificial Sequence
  Description of Artificial Sequence: Synthetic oligonucleotide
ccuggcgagaagcacggu

SEQ ID NO: 970 - RNA, 18 nt, Artificial Sequence
  Description of Artificial Sequence: Synthetic oligonucleotide
gagggccuggcgagaagc

SEQ ID NO: 971 - RNA, 18 nt, Artificial Sequence
  Description of Artificial Sequence: Synthetic oligonucleotide
agccagagggccuggcga

SEQ ID NO: 972 - RNA, 18 nt, Artificial Sequence
  Description of Artificial Sequence: Synthetic oligonucleotide
ggaagagccagagggccu

SEQ ID NO: 973 - RNA, 18 nt, Artificial Sequence
  Description of Artificial Sequence: Synthetic oligonucleotide
cacagggaagagccagag

SEQ ID NO: 974 - RNA, 18 nt, Artificial Sequence
  Description of Artificial Sequence: Synthetic oligonucleotide
gcagccacagggaagagc

SEQ ID NO: 975 - RNA, 18 nt, Artificial Sequence
  Description of Artificial Sequence: Synthetic oligonucleotide
caucugcagccacaggga

SEQ ID NO: 976 - RNA, 18 nt, Artificial Sequence
  Description of Artificial Sequence: Synthetic oligonucleotide
agugccaucugcagccac

SEQ ID NO: 977 - RNA, 18 nt, Artificial Sequence
  Description of Artificial Sequence: Synthetic oligonucleotide
cgcuaagugccaucugca

SEQ ID NO: 978 - RNA, 18 nt, Artificial Sequence
  Description of Artificial Sequence: Synthetic oligonucleotide
uaggccgcuaagugccau

SEQ ID NO: 979 - RNA, 18 nt, Artificial Sequence
  Description of Artificial Sequence: Synthetic oligonucleotide
cguccuaggccgcuaagu

SEQ ID NO: 980 - RNA, 18 nt, Artificial Sequence
  Description of Artificial Sequence: Synthetic oligonucleotide
auagacguccuaggccgc

SEQ ID NO: 981 - RNA, 18 nt, Artificial Sequence
  Description of Artificial Sequence: Synthetic oligonucleotide
cgugaauagacguccuag

SEQ ID NO: 982 - RNA, 18 nt, Artificial Sequence
  Description of Artificial Sequence: Synthetic oligonucleotide
ccucccgugaauagacgu

SEQ ID NO: 983 - RNA, 18 nt, Artificial Sequence
  Description of Artificial Sequence: Synthetic oligonucleotide
ucccuccucccgugaaua

SEQ ID NO: 984 - RNA, 18 nt, Artificial Sequence
  Description of Artificial Sequence: Synthetic oligonucleotide
gugccucccuccucccgu

SEQ ID NO: 985 - RNA, 18 nt, Artificial Sequence
  Description of Artificial Sequence: Synthetic oligonucleotide
gggcagugccucccuccu

SEQ ID NO: 986 - RNA, 18 nt, Artificial Sequence
  Description of Artificial Sequence: Synthetic oligonucleotide
gaggagggcagugccucc

SEQ ID NO: 987 - RNA, 18 nt, Artificial Sequence
  Description of Artificial Sequence: Synthetic oligonucleotide
gaccugaggagggcagug

SEQ ID NO: 988 - RNA, 18 nt, Artificial Sequence
  Description of Artificial Sequence: Synthetic oligonucleotide
gggcagaccugaggaggg

SEQ ID NO: 989 - RNA, 18 nt, Artificial Sequence
  Description of Artificial Sequence: Synthetic oligonucleotide
ugcuugggcagaccugag

SEQ ID NO: 990 - RNA, 18 nt, Artificial Sequence
  Description of Artificial Sequence: Synthetic oligonucleotide
caagcugcuugggcagac

SEQ ID NO: 991 - RNA, 18 nt, Artificial Sequence
  Description of Artificial Sequence: Synthetic oligonucleotide
agcuacaagcugcuuggg

SEQ ID NO: 992 - RNA, 18 nt, Artificial Sequence
  Description of Artificial Sequence: Synthetic oligonucleotide
gugcuagcuacaagcugc

SEQ ID NO: 993 - RNA, 18 nt, Artificial Sequence
  Description of Artificial Sequence: Synthetic oligonucleotide
gcccagugcuagcuacaa

SEQ ID NO: 994 - RNA, 18 nt, Artificial Sequence
  Description of Artificial Sequence: Synthetic oligonucleotide
gggcccagugcuagcuac

SEQ ID NO: 995 - RNA, 18 nt, Artificial Sequence
  Description of Artificial Sequence: Synthetic oligonucleotide
caaagcagcauuuccugu

SEQ ID NO: 996 - RNA, 18 nt, Artificial Sequence
  Description of Artificial Sequence: Synthetic oligonucleotide
ggucccaaagcagcauuu

SEQ ID NO: 997 - RNA, 18 nt, Artificial Sequence
  Description of Artificial Sequence: Synthetic oligonucleotide
ugggaggucccaaagcag

SEQ ID NO: 998 - RNA, 18 nt, Artificial Sequence
  Description of Artificial Sequence: Synthetic oligonucleotide
gagggugggaggucccaa

SEQ ID NO: 999 - RNA, 18 nt, Artificial Sequence
  Description of Artificial Sequence: Synthetic oligonucleotide
ggagagagggugggaggu

SEQ ID NO: 1000 - RNA, 18 nt, Artificial Sequence
  Description of Artificial Sequence: Synthetic oligonucleotide
gcuaaggagagagggugg

SEQ ID NO: 1001 - RNA, 18 nt, Artificial Sequence
  Description of Artificial Sequence: Synthetic oligonucleotide
gggacgcuaaggagagag

SEQ ID NO: 1002 - RNA, 18 nt, Artificial Sequence
  Description of Artificial Sequence: Synthetic oligonucleotide
gccagacccacagcuggg

SEQ ID NO: 1003 - RNA, 18 nt, Artificial Sequence
  Description of Artificial Sequence: Synthetic oligonucleotide
agccagacccacagcugg

SEQ ID NO: 1004 - RNA, 18 nt, Artificial Sequence
  Description of Artificial Sequence: Synthetic oligonucleotide
cuccaagccagacccaca

SEQ ID NO: 1005 - RNA, 18 nt, Artificial Sequence
  Description of Artificial Sequence: Synthetic oligonucleotide
uccaacuccaagccagac

SEQ ID NO: 1006 - RNA, 18 nt, Artificial Sequence
  Description of Artificial Sequence: Synthetic oligonucleotide
cacccuccaacuccaagc

SEQ ID NO: 1007 - RNA, 18 nt, Artificial Sequence
  Description of Artificial Sequence: Synthetic oligonucleotide
aggcucacccuccaacuc

SEQ ID NO: 1008 - RNA, 18 nt, Artificial Sequence
  Description of Artificial Sequence: Synthetic oligonucleotide
agcagaggcucacccucc

SEQ ID NO: 1009 - RNA, 18 nt, Artificial Sequence
  Description of Artificial Sequence: Synthetic oligonucleotide
ccaagagcagaggcucac

SEQ ID NO: 1010 - RNA, 18 nt, Artificial Sequence
  Description of Artificial Sequence: Synthetic oligonucleotide
ugcucccaagagcagagg

SEQ ID NO: 1011 - RNA, 18 nt, Artificial Sequence
  Description of Artificial Sequence: Synthetic oligonucleotide
cagacugcucccaagagc

SEQ ID NO: 1012 - RNA, 18 nt, Artificial Sequence
  Description of Artificial Sequence: Synthetic oligonucleotide
gcaaacagacugcuccca

SEQ ID NO: 1013 - RNA, 18 nt, Artificial Sequence
  Description of Artificial Sequence: Synthetic oligonucleotide
uguuugcaaacagacugc

SEQ ID NO: 1014 - RNA, 18 nt, Artificial Sequence
  Description of Artificial Sequence: Synthetic oligonucleotide
gucccuguuugcaaacag

SEQ ID NO: 1015 - RNA, 18 nt, Artificial Sequence
  Description of Artificial Sequence: Synthetic oligonucleotide
gggaagucccuguuugca

SEQ ID NO: 1016 - RNA, 18 nt, Artificial Sequence
  Description of Artificial Sequence: Synthetic oligonucleotide
gagacuccgugacguggg

SEQ ID NO: 1017 - RNA, 18 nt, Artificial Sequence
  Description of Artificial Sequence: Synthetic oligonucleotide
ugcggagacuccgugacg

SEQ ID NO: 1018 - RNA, 18 nt, Artificial Sequence
  Description of Artificial Sequence: Synthetic oligonucleotide
agagcugcggagacuccg

SEQ ID NO: 1019 - RNA, 18 nt, Artificial Sequence
  Description of Artificial Sequence: Synthetic oligonucleotide
cgaggagagcugcggaga

SEQ ID NO: 1020 - RNA, 18 nt, Artificial Sequence
  Description of Artificial Sequence: Synthetic oligonucleotide
guaaccgaggagagcugc

SEQ ID NO: 1021 - RNA, 18 nt, Artificial Sequence
  Description of Artificial Sequence: Synthetic oligonucleotide
cccucguaaccgaggaga

SEQ ID NO: 1022 - RNA, 18 nt, Artificial Sequence
  Description of Artificial Sequence: Synthetic oligonucleotide
accagcccucguaaccga

SEQ ID NO: 1023 - RNA, 18 nt, Artificial Sequence
  Description of Artificial Sequence: Synthetic oligonucleotide
cugaaaccagcccucgua

SEQ ID NO: 1024 - RNA, 18 nt, Artificial Sequence
  Description of Artificial Sequence: Synthetic oligonucleotide
ggagccugaaaccagccc

SEQ ID NO: 1025 - RNA, 18 nt, Artificial Sequence
  Description of Artificial Sequence: Synthetic oligonucleotide
gagcgggagccugaaacc

SEQ ID NO: 1026 - RNA, 18 nt, Artificial Sequence
  Description of Artificial Sequence: Synthetic oligonucleotide
uaaaagagcgggagccug

SEQ ID NO: 1027 - RNA, 18 nt, Artificial Sequence
  Description of Artificial Sequence: Synthetic oligonucleotide
agcucuaaaagagcggga

SEQ ID NO: 1028 - RNA, 18 nt, Artificial Sequence
  Description of Artificial Sequence: Synthetic oligonucleotide
gccucagcucuaaaagag

SEQ ID NO: 1029 - RNA, 18 nt, Artificial Sequence
  Description of Artificial Sequence: Synthetic oligonucleotide
gacgggccucagcucuaa

SEQ ID NO: 1030 - RNA, 18 nt, Artificial Sequence
  Description of Artificial Sequence: Synthetic oligonucleotide
cgcccgacgggccucagc

SEQ ID NO: 1031 - RNA, 18 nt, Artificial Sequence
  Description of Artificial Sequence: Synthetic oligonucleotide
cucuccgcccgacgggcc

SEQ ID NO: 1032 - RNA, 18 nt, Artificial Sequence
  Description of Artificial Sequence: Synthetic oligonucleotide
agacgcucuccgcccgac

SEQ ID NO: 1033 - RNA, 18 nt, Artificial Sequence
  Description of Artificial Sequence: Synthetic oligonucleotide
gggcaagacgcucuccgc

SEQ ID NO: 1034 - RNA, 18 nt, Artificial Sequence
  Description of Artificial Sequence: Synthetic oligonucleotide
gccuccagguaggcaggg

SEQ ID NO: 1035 - RNA, 18 nt, Artificial Sequence
  Description of Artificial Sequence: Synthetic oligonucleotide
gugccuccagguaggcag

SEQ ID NO: 1036 - RNA, 18 nt, Artificial Sequence
  Description of Artificial Sequence: Synthetic oligonucleotide
ccccugugccuccaggua

SEQ ID NO: 1037 - RNA, 18 nt, Artificial Sequence
  Description of Artificial Sequence: Synthetic oligonucleotide
agccaccccugugccucc

SEQ ID NO: 1038 - RNA, 18 nt, Artificial Sequence
  Description of Artificial Sequence: Synthetic oligonucleotide
ccagcagccaccccugug

SEQ ID NO: 1039 - RNA, 18 nt, Artificial Sequence
  Description of Artificial Sequence: Synthetic oligonucleotide
guccaccagcagccaccc

SEQ ID NO: 1040 - RNA, 18 nt, Artificial Sequence
  Description of Artificial Sequence: Synthetic oligonucleotide
cuaguguccaccagcagc

SEQ ID NO: 1041 - RNA, 18 nt, Artificial Sequence
  Description of Artificial Sequence: Synthetic oligonucleotide
ccacccuaguguccacca

SEQ ID NO: 1042 - RNA, 18 nt, Artificial Sequence
  Description of Artificial Sequence: Synthetic oligonucleotide
ucugcccacccuaguguc

SEQ ID NO: 1043 - RNA, 18 nt, Artificial Sequence
  Description of Artificial Sequence: Synthetic oligonucleotide
ucggcucugcccacccua

SEQ ID NO: 1044 - RNA, 18 nt, Artificial Sequence
  Description of Artificial Sequence: Synthetic oligonucleotide
ggcaaucggcucugccca

SEQ ID NO: 1045 - RNA, 18 nt, Artificial Sequence
  Description of Artificial Sequence: Synthetic oligonucleotide
gggcaggcaaucggcucu

SEQ ID NO: 1046 - RNA, 18 nt, Artificial Sequence
  Description of Artificial Sequence: Synthetic oligonucleotide
ggguugggcaggcaaucg

SEQ ID NO: 1047 - RNA, 18 nt, Artificial Sequence
  Description of Artificial Sequence: Synthetic oligonucleotide
ccugcaugagugcccggg

SEQ ID NO: 1048 - RNA, 18 nt, Artificial Sequence
  Description of Artificial Sequence: Synthetic oligonucleotide
uccugcaugagugcccgg

SEQ ID NO: 1049 - RNA, 18 nt, Artificial Sequence
  Description of Artificial Sequence: Synthetic oligonucleotide
gccucuccugcaugagug

SEQ ID NO: 1050 - RNA, 18 nt, Artificial Sequence
  Description of Artificial Sequence: Synthetic oligonucleotide
cacaggccucuccugcau

SEQ ID NO: 1051 - RNA, 18 nt, Artificial Sequence
  Description of Artificial Sequence: Synthetic oligonucleotide
cccgacacaggccucucc

SEQ ID NO: 1052 - RNA, 18 nt, Artificial Sequence
  Description of Artificial Sequence: Synthetic oligonucleotide
gugaccccgacacaggcc

SEQ ID NO: 1053 - RNA, 18 nt, Artificial Sequence
  Description of Artificial Sequence: Synthetic oligonucleotide
ugcacgugaccccgacac

SEQ ID NO: 1054 - RNA, 18 nt, Artificial Sequence
  Description of Artificial Sequence: Synthetic oligonucleotide
aggccugcacgugacccc

SEQ ID NO: 1055 - RNA, 18 nt, Artificial Sequence
  Description of Artificial Sequence: Synthetic oligonucleotide
ugggaaggccugcacgug

SEQ ID NO: 1056 - RNA, 18 nt, Artificial Sequence
  Description of Artificial Sequence: Synthetic oligonucleotide
gacgcugggaaggccugc

SEQ ID NO: 1057 - RNA, 18 nt, Artificial Sequence
  Description of Artificial Sequence: Synthetic oligonucleotide
gggaggacgcugggaagg

SEQ ID NO: 1058 - RNA, 18 nt, Artificial Sequence
  Description of Artificial Sequence: Synthetic oligonucleotide
gggcagggaggacgcugg

SEQ ID NO: 1059 - RNA, 18 nt, Artificial Sequence
  Description of Artificial Sequence: Synthetic oligonucleotide
cgagcgggcagggaggac

SEQ ID NO: 1060 - RNA, 18 nt, Artificial Sequence
  Description of Artificial Sequence: Synthetic oligonucleotide
uccaccgagcgggcaggg

SEQ ID NO: 1061 - RNA, 18 nt, Artificial Sequence
  Description of Artificial Sequence: Synthetic oligonucleotide
ugccauccaccgagcggg

SEQ ID NO: 1062 - RNA, 18 nt, Artificial Sequence
  Description of Artificial Sequence: Synthetic oligonucleotide
acugcugccauccaccga

SEQ ID NO: 1063 - RNA, 18 nt, Artificial Sequence
  Description of Artificial Sequence: Synthetic oligonucleotide
ugcuuacugcugccaucc

SEQ ID NO: 1064 - RNA, 18 nt, Artificial Sequence
  Description of Artificial Sequence: Synthetic oligonucleotide
ggcucugcuuacugcugc

SEQ ID NO: 1065 - RNA, 18 nt, Artificial Sequence
  Description of Artificial Sequence: Synthetic oligonucleotide
cccagggcucugcuuacu

SEQ ID NO: 1066 - RNA, 18 nt, Artificial Sequence
  Description of Artificial Sequence: Synthetic oligonucleotide
gccuccccagggcucugc

SEQ ID NO: 1067 - RNA, 18 nt, Artificial Sequence
  Description of Artificial Sequence: Synthetic oligonucleotide
ugcgagccuccccagggc

SEQ ID NO: 1068 - RNA, 18 nt, Artificial Sequence
  Description of Artificial Sequence: Synthetic oligonucleotide
agcccugcgagccucccc

SEQ ID NO: 1069 - RNA, 18 nt, Artificial Sequence
  Description of Artificial Sequence: Synthetic oligonucleotide
acagcagcccugcgagcc

SEQ ID NO: 1070 - RNA, 18 nt, Artificial Sequence
  Description of Artificial Sequence: Synthetic oligonucleotide
gagggacagcagcccugc

SEQ ID NO: 1071 - RNA, 18 nt, Artificial Sequence
  Description of Artificial Sequence: Synthetic oligonucleotide
gaccagagggacagcagc

SEQ ID NO: 1072 - RNA, 18 nt, Artificial Sequence
  Description of Artificial Sequence: Synthetic oligonucleotide
cuccugaccagagggaca

SEQ ID NO: 1073 - RNA, 18 nt, Artificial Sequence
  Description of Artificial Sequence: Synthetic oligonucleotide
gccuucuccugaccagag

SEQ ID NO: 1074 - RNA, 18 nt, Artificial Sequence
  Description of Artificial Sequence: Synthetic oligonucleotide
aaccagccuucuccugac

SEQ ID NO: 1075 - RNA, 18 nt, Artificial Sequence
  Description of Artificial Sequence: Synthetic oligonucleotide
ccgagaaccagccuucuc

SEQ ID NO: 1076 - RNA, 18 nt, Artificial Sequence
  Description of Artificial Sequence: Synthetic oligonucleotide
ggccuccgagaaccagcc

SEQ ID NO: 1077 - RNA, 18 nt, Artificial Sequence
  Description of Artificial Sequence: Synthetic oligonucleotide
gacguggccuccgagaac

SEQ ID NO: 1078 - RNA, 18 nt, Artificial Sequence
  Description of Artificial Sequence: Synthetic oligonucleotide
gcccugacguggccuccg

SEQ ID NO: 1079 - RNA, 18 nt, Artificial Sequence
  Description of Artificial Sequence: Synthetic oligonucleotide
cccuggcccugacguggc

SEQ ID NO: 1080 - RNA, 18 nt, Artificial Sequence
  Description of Artificial Sequence: Synthetic oligonucleotide
ccaggcccuggcccugac

SEQ ID NO: 1081 - RNA, 18 nt, Artificial Sequence
  Description of Artificial Sequence: Synthetic oligonucleotide
cugggccaggcccuggcc

SEQ ID NO: 1082 - RNA, 18 nt, Artificial Sequence
  Description of Artificial Sequence: Synthetic oligonucleotide
uccaugaccacggcggag

SEQ ID NO: 1083 - RNA, 18 nt, Artificial Sequence
  Description of Artificial Sequence: Synthetic oligonucleotide
ccuccuccaugaccacgg

SEQ ID NO: 1084 - RNA, 18 nt, Artificial Sequence
  Description of Artificial Sequence: Synthetic oligonucleotide
acuucccuccuccaugac

SEQ ID NO: 1085 - RNA, 18 nt, Artificial Sequence
  Description of Artificial Sequence: Synthetic oligonucleotide
cccggacuucccuccucc

SEQ ID NO: 1086 - RNA, 18 nt, Artificial Sequence
  Description of Artificial Sequence: Synthetic oligonucleotide
ccucgcccggacuucccu

SEQ ID NO: 1087 - RNA, 18 nt, Artificial Sequence
  Description of Artificial Sequence: Synthetic oligonucleotide
aggaaccucgcccggacu

SEQ ID NO: 1088 - RNA, 18 nt, Artificial Sequence
  Description of Artificial Sequence: Synthetic oligonucleotide
agcacaggaaccucgccc

SEQ ID NO: 1089 - RNA, 18 nt, Artificial Sequence
  Description of Artificial Sequence: Synthetic oligonucleotide
ccaccagcacaggaaccu

SEQ ID NO: 1090 - RNA, 18 nt, Artificial Sequence
  Description of Artificial Sequence: Synthetic oligonucleotide
gggcuccaccagcacagg

SEQ ID NO: 1091 - RNA, 18 nt, Artificial Sequence
  Description of Artificial Sequence: Synthetic oligonucleotide
ucaacguccuccaacccu

SEQ ID NO: 1092 - RNA, 18 nt, Artificial Sequence
  Description of Artificial Sequence: Synthetic oligonucleotide
cugccucaacguccucca

SEQ ID NO: 1093 - RNA, 18 nt, Artificial Sequence
  Description of Artificial Sequence: Synthetic oligonucleotide
uagcgcugccucaacguc

SEQ ID NO: 1094 - RNA, 18 nt, Artificial Sequence
  Description of Artificial Sequence: Synthetic oligonucleotide
augccuagcgcugccuca

SEQ ID NO: 1095 - RNA, 18 nt, Artificial Sequence
  Description of Artificial Sequence: Synthetic oligonucleotide
uguccaugccuagcgcug

SEQ ID NO: 1096 - RNA, 18 nt, Artificial Sequence
  Description of Artificial Sequence: Synthetic oligonucleotide
gcgccuguccaugccuag

SEQ ID NO: 1097 - RNA, 18 nt, Artificial Sequence
  Description of Artificial Sequence: Synthetic oligonucleotide
uccgugcgccuguccaug

SEQ ID NO: 1098 - RNA, 18 nt, Artificial Sequence
  Description of Artificial Sequence: Synthetic oligonucleotide
aggcauccgugcgccugu

SEQ ID NO: 1099 - RNA, 18 nt, Artificial Sequence
  Description of Artificial Sequence: Synthetic oligonucleotide
gcuguaggcauccgugcg

SEQ ID NO: 1100 - RNA, 18 nt, Artificial Sequence
  Description of Artificial Sequence: Synthetic oligonucleotide
acagggaggagaaagagg

SEQ ID NO: 1101 - RNA, 18 nt, Artificial Sequence
  Description of Artificial Sequence: Synthetic oligonucleotide
cugguacagggaggagaa

SEQ ID NO: 1102 - RNA, 18 nt, Artificial Sequence
  Description of Artificial Sequence: Synthetic oligonucleotide
cuggacugguacagggag

SEQ ID NO: 1103 - RNA, 18 nt, Artificial Sequence
  Description of Artificial Sequence: Synthetic oligonucleotide
ggcagcuggacugguaca

SEQ ID NO: 1104 - RNA, 18 nt, Artificial Sequence
  Description of Artificial Sequence: Synthetic oligonucleotide
uccuuggcagcuggacug

SEQ ID NO: 1105 - RNA, 18 nt, Artificial Sequence
  Description of Artificial Sequence: Synthetic oligonucleotide
agcuguccuuggcagcug

SEQ ID NO: 1106 - RNA, 18 nt, Artificial Sequence
  Description of Artificial Sequence: Synthetic oligonucleotide
ugugcagcuguccuuggc

SEQ ID NO: 1107 - RNA, 18 nt, Artificial Sequence
  Description of Artificial Sequence: Synthetic oligonucleotide
gcuccugugcagcugucc

SEQ ID NO: 1108 - RNA, 18 nt, Artificial Sequence
  Description of Artificial Sequence: Synthetic oligonucleotide
gaaacgcuccugugcagc

SEQ ID NO: 1109 - RNA, 18 nt, Artificial Sequence
  Description of Artificial Sequence: Synthetic oligonucleotide
cccaggaaacgcuccugu

SEQ ID NO: 1110 - RNA, 18 nt, Artificial Sequence
  Description of Artificial Sequence: Synthetic oligonucleotide
cgcuucccucugagaggc

SEQ ID NO: 1111 - RNA, 18 nt, Artificial Sequence
  Description of Artificial Sequence: Synthetic oligonucleotide
ccaaccgcuucccucuga

SEQ ID NO: 1112 - RNA, 18 nt, Artificial Sequence
  Description of Artificial Sequence: Synthetic oligonucleotide
ugcagccaaccgcuuccc

SEQ ID NO: 1113 - RNA, 18 nt, Artificial Sequence
  Description of Artificial Sequence: Synthetic oligonucleotide
cgcucugcagccaaccgc

SEQ ID NO: 1114 - RNA, 18 nt, Artificial Sequence
  Description of Artificial Sequence: Synthetic oligonucleotide
aguggcgcucugcagcca

SEQ ID NO: 1115 - RNA, 18 nt, Artificial Sequence
  Description of Artificial Sequence: Synthetic oligonucleotide
ggcagaguggcgcucugc

SEQ ID NO: 1116 - RNA, 18 nt, Artificial Sequence
  Description of Artificial Sequence: Synthetic oligonucleotide
uaugaggcagaguggcgc

SEQ ID NO: 1117 - RNA, 18 nt, Artificial Sequence
  Description of Artificial Sequence: Synthetic oligonucleotide
gcaccuaugaggcagagu

SEQ ID NO: 1118 - RNA, 18 nt, Artificial Sequence
  Description of Artificial Sequence: Synthetic oligonucleotide
gcacagcaccuaugaggc

SEQ ID NO: 1119 - RNA, 18 nt, Artificial Sequence
  Description of Artificial Sequence: Synthetic oligonucleotide
gacgagcacagcaccuau

SEQ ID NO: 1120 - RNA, 18 nt, Artificial Sequence
  Description of Artificial Sequence: Synthetic oligonucleotide
gaggcgacgagcacagca

SEQ ID NO: 1121 - RNA, 18 nt, Artificial Sequence
  Description of Artificial Sequence: Synthetic oligonucleotide
cggaugaggcgacgagca

SEQ ID NO: 1122 - RNA, 18 nt, Artificial Sequence
  Description of Artificial Sequence: Synthetic oligonucleotide
gugggcggaugaggcgac

SEQ ID NO: 1123 - RNA, 18 nt, Artificial Sequence
  Description of Artificial Sequence: Synthetic oligonucleotide
gggugggcggaugaggcg

SEQ ID NO: 1124 - RNA, 18 nt, Artificial Sequence
  Description of Artificial Sequence: Synthetic oligonucleotide
aggcagacggaccauggg

SEQ ID NO: 1125 - RNA, 18 nt, Artificial Sequence
  Description of Artificial Sequence: Synthetic oligonucleotide
aauggaggcagacggacc

SEQ ID NO: 1126 - RNA, 18 nt, Artificial Sequence
  Description of Artificial Sequence: Synthetic oligonucleotide
agggcaauggaggcagac

SEQ ID NO: 1127 - RNA, 18 nt, Artificial Sequence
  Description of Artificial Sequence: Synthetic oligonucleotide
uccccagggcaauggagg

SEQ ID NO: 1128 - RNA, 18 nt, Artificial Sequence
  Description of Artificial Sequence: Synthetic oligonucleotide
ccugcuccccagggcaau

SEQ ID NO: 1129 - RNA, 18 nt, Artificial Sequence
  Description of Artificial Sequence: Synthetic oligonucleotide
cgggaccugcuccccagg

SEQ ID NO: 1130 - RNA, 18 nt, Artificial Sequence
  Description of Artificial Sequence: Synthetic oligonucleotide
cgagucgggaccugcucc

SEQ ID NO: 1131 - RNA, 18 nt, Artificial Sequence
  Description of Artificial Sequence: Synthetic oligonucleotide
ucaugcgagucgggaccu

SEQ ID NO: 1132 - RNA, 18 nt, Artificial Sequence
  Description of Artificial Sequence: Synthetic oligonucleotide
cguccucaugcgagucgg

SEQ ID NO: 1133 - RNA, 18 nt, Artificial Sequence
  Description of Artificial Sequence: Synthetic oligonucleotide
acagacguccucaugcga

SEQ ID NO: 1134 - RNA, 18 nt, Artificial Sequence
  Description of Artificial Sequence: Synthetic oligonucleotide
ucugcacagacguccuca

SEQ ID NO: 1135 - RNA, 18 nt, Artificial Sequence
  Description of Artificial Sequence: Synthetic oligonucleotide
gacauucugcacagacgu

SEQ ID NO: 1136 - RNA, 18 nt, Artificial Sequence
  Description of Artificial Sequence: Synthetic oligonucleotide
ccaaagacauucugcaca

SEQ ID NO: 1137 - RNA, 18 nt, Artificial Sequence
  Description of Artificial Sequence: Synthetic oligonucleotide
ccaagccaaagacauucu

SEQ ID NO: 1138 - RNA, 18 nt, Artificial Sequence
  Description of Artificial Sequence: Synthetic oligonucleotide
gcuggccaagccaaagac

SEQ ID NO: 1139 - RNA, 18 nt, Artificial Sequence
  Description of Artificial Sequence: Synthetic oligonucleotide
aucccgcuggccaagcca

SEQ ID NO: 1140 - RNA, 18 nt, Artificial Sequence
  Description of Artificial Sequence: Synthetic oligonucleotide
gggaucccgcuggccaag

SEQ ID NO: 1141 - RNA, 18 nt, Artificial Sequence
  Description of Artificial Sequence: Synthetic oligonucleotide
aagggaccaagucaaggg

SEQ ID NO: 1142 - RNA, 18 nt, Artificial Sequence
  Description of Artificial Sequence: Synthetic oligonucleotide
ccacaaagggaccaaguc

SEQ ID NO: 1143 - RNA, 18 nt, Artificial Sequence
  Description of Artificial Sequence: Synthetic oligonucleotide
cucagccacaaagggacc

SEQ ID NO: 1144 - RNA, 18 nt, Artificial Sequence
  Description of Artificial Sequence: Synthetic oligonucleotide
cagggcucagccacaaag

SEQ ID NO: 1145 - RNA, 18 nt, Artificial Sequence
  Description of Artificial Sequence: Synthetic oligonucleotide
gggaacagggcucagcca

SEQ ID NO: 1146 - RNA, 18 nt, Artificial Sequence
  Description of Artificial Sequence: Synthetic oligonucleotide
agcgugggaacagggcuc

SEQ ID NO: 1147 - RNA, 18 nt, Artificial Sequence
  Description of Artificial Sequence: Synthetic oligonucleotide
cgcacagcgugggaacag

SEQ ID NO: 1148 - RNA, 18 nt, Artificial Sequence
  Description of Artificial Sequence: Synthetic oligonucleotide
gugcucgcacagcguggg

SEQ ID NO: 1149 - RNA, 18 nt, Artificial Sequence
  Description of Artificial Sequence: Synthetic oligonucleotide
cgggagugcucgcacagc

SEQ ID NO: 1150 - RNA, 18 nt, Artificial Sequence
  Description of Artificial Sequence: Synthetic oligonucleotide
ugggccgggagugcucgc

SEQ ID NO: 1151 - RNA, 18 nt, Artificial Sequence
  Description of Artificial Sequence: Synthetic oligonucleotide
gaagcugggccgggagug

SEQ ID NO: 1152 - RNA, 18 nt, Artificial Sequence
  Description of Artificial Sequence: Synthetic oligonucleotide
ggccugaagcugggccgg

SEQ ID NO: 1153 - RNA, 18 nt, Artificial Sequence
  Description of Artificial Sequence: Synthetic oligonucleotide
ccucaggccugaagcugg

SEQ ID NO: 1154 - RNA, 18 nt, Artificial Sequence
  Description of Artificial Sequence: Synthetic oligonucleotide
ccaccccucaggccugaa

SEQ ID NO: 1155 - RNA, 18 nt, Artificial Sequence
  Description of Artificial Sequence: Synthetic oligonucleotide
cacccccaccccucaggc

SEQ ID NO: 1156 - RNA, 18 nt, Artificial Sequence
  Description of Artificial Sequence: Synthetic oligonucleotide
caggccacccccaccccu

SEQ ID NO: 1157 - RNA, 18 nt, Artificial Sequence
  Description of Artificial Sequence: Synthetic oligonucleotide
agacucaggccaccccca

SEQ ID NO: 1158 - RNA, 18 nt, Artificial Sequence
  Description of Artificial Sequence: Synthetic oligonucleotide
cauggagacucaggccac

SEQ ID NO: 1159 - RNA, 18 nt, Artificial Sequence
  Description of Artificial Sequence: Synthetic oligonucleotide
gucaccauggagacucag

SEQ ID NO: 1160 - RNA, 18 nt, Artificial Sequence
  Description of Artificial Sequence: Synthetic oligonucleotide
cugaugucaccauggaga

SEQ ID NO: 1161 - RNA, 18 nt, Artificial Sequence
  Description of Artificial Sequence: Synthetic oligonucleotide
cucagcugaugucaccau

SEQ ID NO: 1162 - RNA, 18 nt, Artificial Sequence
  Description of Artificial Sequence: Synthetic oligonucleotide
ugcagcucagcugauguc

SEQ ID NO: 1163 - RNA, 18 nt, Artificial Sequence
  Description of Artificial Sequence: Synthetic oligonucleotide
gagucugcagcucagcug

SEQ ID NO: 1164 - RNA, 18 nt, Artificial Sequence
  Description of Artificial Sequence: Synthetic oligonucleotide
caucagagucugcagcuc

SEQ ID NO: 1165 - RNA, 18 nt, Artificial Sequence
  Description of Artificial Sequence: Synthetic oligonucleotide
ccacccaucagagucugc

SEQ ID NO: 1166 - RNA, 18 nt, Artificial Sequence
  Description of Artificial Sequence: Synthetic oligonucleotide
agcugccacccaucagag

SEQ ID NO: 1167 - RNA, 18 nt, Artificial Sequence
  Description of Artificial Sequence: Synthetic oligonucleotide
uaaacagcugccacccau

SEQ ID NO: 1168 - RNA, 18 nt, Artificial Sequence
  Description of Artificial Sequence: Synthetic oligonucleotide
cccccuaaacagcugcca

SEQ ID NO: 1169 - RNA, 18 nt, Artificial Sequence
  Description of Artificial Sequence: Synthetic oligonucleotide
ggcuucccccuaaacagc

SEQ ID NO: 1170 - RNA, 18 nt, Artificial Sequence
  Description of Artificial Sequence: Synthetic oligonucleotide
gggugggcuucccccuaa

SEQ ID NO: 1171 - RNA, 18 nt, Artificial Sequence
  Description of Artificial Sequence: Synthetic oligonucleotide
cccgcucggugcaggccc

SEQ ID NO: 1172 - RNA, 18 nt, Artificial Sequence
  Description of Artificial Sequence: Synthetic oligonucleotide
caaggcccgcucggugca

SEQ ID NO: 1173 - RNA, 18 nt, Artificial Sequence
  Description of Artificial Sequence: Synthetic oligonucleotide
cagggcaaggcccgcucg

SEQ ID NO: 1174 - RNA, 18 nt, Artificial Sequence
  Description of Artificial Sequence: Synthetic oligonucleotide
aaggccagggcaaggccc

SEQ ID NO: 1175 - RNA, 18 nt, Artificial Sequence
  Description of Artificial Sequence: Synthetic oligonucleotide
caccaaaggccagggcaa

SEQ ID NO: 1176 - RNA, 18 nt, Artificial Sequence
  Description of Artificial Sequence: Synthetic oligonucleotide
ggagccaccaaaggccag

SEQ ID NO: 1177 - RNA, 18 nt, Artificial Sequence
  Description of Artificial Sequence: Synthetic oligonucleotide
gggagccaccaaaggcca

SEQ ID NO: 1178 - RNA, 18 nt, Artificial Sequence
  Description of Artificial Sequence: Synthetic oligonucleotide
ggguuccagaggccaggg

SEQ ID NO: 1179 - RNA, 18 nt, Artificial Sequence
  Description of Artificial Sequence: Synthetic oligonucleotide
ucuguggguuccagaggc

SEQ ID NO: 1180 - RNA, 18 nt, Artificial Sequence
  Description of Artificial Sequence: Synthetic oligonucleotide
ccccaucuguggguucca

SEQ ID NO: 1181 - RNA, 18 nt, Artificial Sequence
  Description of Artificial Sequence: Synthetic oligonucleotide
ggcagccccaucuguggg

SEQ ID NO: 1182 - RNA, 18 nt, Artificial Sequence
  Description of Artificial Sequence: Synthetic oligonucleotide
cuugaggcagccccaucu

SEQ ID NO: 1183 - RNA, 18 nt, Artificial Sequence
  Description of Artificial Sequence: Synthetic oligonucleotide
ugggacuugaggcagccc

SEQ ID NO: 1184 - RNA, 18 nt, Artificial Sequence
  Description of Artificial Sequence: Synthetic oligonucleotide
caaccugggacuugaggc

SEQ ID NO: 1185 - RNA, 18 nt, Artificial Sequence
  Description of Artificial Sequence: Synthetic oligonucleotide
cuggucaaccugggacuu

SEQ ID NO: 1186 - RNA, 18 nt, Artificial Sequence
  Description of Artificial Sequence: Synthetic oligonucleotide
ggccccuggucaaccugg

SEQ ID NO: 1187 - RNA, 18 nt, Artificial Sequence
  Description of Artificial Sequence: Synthetic oligonucleotide
ugcagggccccuggucaa

SEQ ID NO: 1188 - RNA, 18 nt, Artificial Sequence
  Description of Artificial Sequence: Synthetic oligonucleotide
cggucugcagggccccug

SEQ ID NO: 1189 - RNA, 18 nt, Artificial Sequence
  Description of Artificial Sequence: Synthetic oligonucleotide
gaggucggucugcagggc

SEQ ID NO: 1190 - RNA, 18 nt, Artificial Sequence
  Description of Artificial Sequence: Synthetic oligonucleotide
aggcagaggucggucugc

SEQ ID NO: 1191 - RNA, 18 nt, Artificial Sequence
  Description of Artificial Sequence: Synthetic oligonucleotide
gcaacaggcagaggucgg

SEQ ID NO: 1192 - RNA, 18 nt, Artificial Sequence
  Description of Artificial Sequence: Synthetic oligonucleotide
gggcaacaggcagagguc

SEQ ID NO: 1193 - RNA, 18 nt, Artificial Sequence
  Description of Artificial Sequence: Synthetic oligonucleotide
uccccaccagggcuuggg

SEQ ID NO: 1194 - RNA, 18 nt, Artificial Sequence
  Description of Artificial Sequence: Synthetic oligonucleotide
agcacuccccaccagggc

SEQ ID NO: 1195 - RNA, 18 nt, Artificial Sequence
  Description of Artificial Sequence: Synthetic oligonucleotide
gucacagcacuccccacc

SEQ ID NO: 1196 - RNA, 18 nt, Artificial Sequence
  Description of Artificial Sequence: Synthetic oligonucleotide
ugcaggucacagcacucc

SEQ ID NO: 1197 - RNA, 18 nt, Artificial Sequence
  Description of Artificial Sequence: Synthetic oligonucleotide
caccaugcaggucacagc

SEQ ID NO: 1198 - RNA, 18 nt, Artificial Sequence
  Description of Artificial Sequence: Synthetic oligonucleotide
gggagcaccaugcagguc

SEQ ID NO: 1199 - RNA, 18 nt, Artificial Sequence
  Description of Artificial Sequence: Synthetic oligonucleotide
caaagcagcauuuccugu

SEQ ID NO: 1200 - RNA, 18 nt, Artificial Sequence
  Description of Artificial Sequence: Synthetic oligonucleotide
ggucccaaagcagcauuu

SEQ ID NO: 1201 - RNA, 18 nt, Artificial Sequence
  Description of Artificial Sequence: Synthetic oligonucleotide
ugggaggucccaaagcag

SEQ ID NO: 1202 - RNA, 18 nt, Artificial Sequence
  Description of Artificial Sequence: Synthetic oligonucleotide
gagggugggaggucccaa

SEQ ID NO: 1203 - RNA, 18 nt, Artificial Sequence
  Description of Artificial Sequence: Synthetic oligonucleotide
ggagagagggugggaggu

SEQ ID NO: 1204 - RNA, 18 nt, Artificial Sequence
  Description of Artificial Sequence: Synthetic oligonucleotide
gcuaaggagagagggugg

SEQ ID NO: 1205 - RNA, 18 nt, Artificial Sequence
  Description of Artificial Sequence: Synthetic oligonucleotide
gggacgcuaaggagagag

SEQ ID NO: 1206 - RNA, 18 nt, Artificial Sequence
  Description of Artificial Sequence: Synthetic oligonucleotide
gccagacccacagcuggg

SEQ ID NO: 1207 - RNA, 18 nt, Artificial Sequence
  Description of Artificial Sequence: Synthetic oligonucleotide
agccagacccacagcugg

SEQ ID NO: 1208 - RNA, 18 nt, Artificial Sequence
  Description of Artificial Sequence: Synthetic oligonucleotide
cuccaagccagacccaca

SEQ ID NO: 1209 - RNA, 18 nt, Artificial Sequence
  Description of Artificial Sequence: Synthetic oligonucleotide
uccaacuccaagccagac

SEQ ID NO: 1210 - RNA, 18 nt, Artificial Sequence
  Description of Artificial Sequence: Synthetic oligonucleotide
cacccuccaacuccaagc

SEQ ID NO: 1211 - RNA, 18 nt, Artificial Sequence
  Description of Artificial Sequence: Synthetic oligonucleotide
aggcucacccuccaacuc

SEQ ID NO: 1212 - RNA, 18 nt, Artificial Sequence
  Description of Artificial Sequence: Synthetic oligonucleotide
agcagaggcucacccucc

SEQ ID NO: 1213 - RNA, 18 nt, Artificial Sequence
  Description of Artificial Sequence: Synthetic oligonucleotide
ccaagagcagaggcucac

SEQ ID NO: 1214 - RNA, 18 nt, Artificial Sequence
  Description of Artificial Sequence: Synthetic oligonucleotide
ugcucccaagagcagagg

SEQ ID NO: 1215 - RNA, 18 nt, Artificial Sequence
  Description of Artificial Sequence: Synthetic oligonucleotide
cagacugcucccaagagc

SEQ ID NO: 1216 - RNA, 18 nt, Artificial Sequence
  Description of Artificial Sequence: Synthetic oligonucleotide
gcaaacagacugcuccca

SEQ ID NO: 1217 - RNA, 18 nt, Artificial Sequence
  Description of Artificial Sequence: Synthetic oligonucleotide
uguuugcaaacagacugc

SEQ ID NO: 1218 - RNA, 18 nt, Artificial Sequence
  Description of Artificial Sequence: Synthetic oligonucleotide
gucccuguuugcaaacag

SEQ ID NO: 1219 - RNA, 18 nt, Artificial Sequence
  Description of Artificial Sequence: Synthetic oligonucleotide
gggaagucccuguuugca

SEQ ID NO: 1220 - RNA, 18 nt, Artificial Sequence
  Description of Artificial Sequence: Synthetic oligonucleotide
gagacuccgugacguggg

SEQ ID NO: 1221 - RNA, 18 nt, Artificial Sequence
  Description of Artificial Sequence: Synthetic oligonucleotide
ugcggagacuccgugacg

SEQ ID NO: 1222 - RNA, 18 nt, Artificial Sequence
  Description of Artificial Sequence: Synthetic oligonucleotide
agagcugcggagacuccg

SEQ ID NO: 1223 - RNA, 18 nt, Artificial Sequence
  Description of Artificial Sequence: Synthetic oligonucleotide
cgaggagagcugcggaga

SEQ ID NO: 1224 - RNA, 18 nt, Artificial Sequence
  Description of Artificial Sequence: Synthetic oligonucleotide
guaaccgaggagagcugc

SEQ ID NO: 1225 - RNA, 18 nt, Artificial Sequence
  Description of Artificial Sequence: Synthetic oligonucleotide
cccucguaaccgaggaga

SEQ ID NO: 1226 - RNA, 18 nt, Artificial Sequence
  Description of Artificial Sequence: Synthetic oligonucleotide
accagcccucguaaccga

SEQ ID NO: 1227 - RNA, 18 nt, Artificial Sequence
  Description of Artificial Sequence: Synthetic oligonucleotide
cugaaaccagcccucgua

SEQ ID NO: 1228 - RNA, 18 nt, Artificial Sequence
  Description of Artificial Sequence: Synthetic oligonucleotide
ggagccugaaaccagccc

SEQ ID NO: 1229 - RNA, 18 nt, Artificial Sequence
  Description of Artificial Sequence: Synthetic oligonucleotide
gagcgggagccugaaacc

SEQ ID NO: 1230 - RNA, 18 nt, Artificial Sequence
  Description of Artificial Sequence: Synthetic oligonucleotide
uaaaagagcgggagccug

SEQ ID NO: 1231 - RNA, 18 nt, Artificial Sequence
  Description of Artificial Sequence: Synthetic oligonucleotide
agcucuaaaagagcggga

SEQ ID NO: 1232 - RNA, 18 nt, Artificial Sequence
  Description of Artificial Sequence: Synthetic oligonucleotide
gccucagcucuaaaagag

SEQ ID NO: 1233 - RNA, 18 nt, Artificial Sequence
  Description of Artificial Sequence: Synthetic oligonucleotide
gacgggccucagcucuaa

SEQ ID NO: 1234 - RNA, 18 nt, Artificial Sequence
  Description of Artificial Sequence: Synthetic oligonucleotide
cgcccgacgggccucagc

SEQ ID NO: 1235 - RNA, 18 nt, Artificial Sequence
  Description of Artificial Sequence: Synthetic oligonucleotide
cucuccgcccgacgggcc

SEQ ID NO: 1236 - RNA, 18 nt, Artificial Sequence
  Description of Artificial Sequence: Synthetic oligonucleotide
agacgcucuccgcccgac

SEQ ID NO: 1237 - RNA, 18 nt, Artificial Sequence
  Description of Artificial Sequence: Synthetic oligonucleotide
gggcaagacgcucuccgc

SEQ ID NO: 1238 - RNA, 18 nt, Artificial Sequence
  Description of Artificial Sequence: Synthetic oligonucleotide
gccuccagguaggcaggg

SEQ ID NO: 1239 - RNA, 18 nt, Artificial Sequence
  Description of Artificial Sequence: Synthetic oligonucleotide
gugccuccagguaggcag

SEQ ID NO: 1240 - RNA, 18 nt, Artificial Sequence
  Description of Artificial Sequence: Synthetic oligonucleotide
ccccugugccuccaggua

SEQ ID NO: 1241 - RNA, 18 nt, Artificial Sequence
  Description of Artificial Sequence: Synthetic oligonucleotide
agccaccccugugccucc

SEQ ID NO: 1242 - RNA, 18 nt, Artificial Sequence
  Description of Artificial Sequence: Synthetic oligonucleotide
ccagcagccaccccugug

SEQ ID NO: 1243 - RNA, 18 nt, Artificial Sequence
  Description of Artificial Sequence: Synthetic oligonucleotide
guccaccagcagccaccc

SEQ ID NO: 1244 - RNA, 18 nt, Artificial Sequence
  Description of Artificial Sequence: Synthetic oligonucleotide
cuaguguccaccagcagc

SEQ ID NO: 1245 - RNA, 18 nt, Artificial Sequence
  Description of Artificial Sequence: Synthetic oligonucleotide
ccacccuaguguccacca

SEQ ID NO: 1246 - RNA, 18 nt, Artificial Sequence
  Description of Artificial Sequence: Synthetic oligonucleotide
ucugcccacccuaguguc

SEQ ID NO: 1247 - RNA, 18 nt, Artificial Sequence
  Description of Artificial Sequence: Synthetic oligonucleotide
ucggcucugcccacccua

SEQ ID NO: 1248 - RNA, 18 nt, Artificial Sequence
  Description of Artificial Sequence: Synthetic oligonucleotide
ggcaaucggcucugccca

SEQ ID NO: 1249 - RNA, 18 nt, Artificial Sequence
  Description of Artificial Sequence: Synthetic oligonucleotide
gggcaggcaaucggcucu

SEQ ID NO: 1250 - RNA, 18 nt, Artificial Sequence
  Description of Artificial Sequence: Synthetic oligonucleotide
ggguugggcaggcaaucg

SEQ ID NO: 1251 - RNA, 18 nt, Artificial Sequence
  Description of Artificial Sequence: Synthetic oligonucleotide
ccugcaugagugcccggg

SEQ ID NO: 1252 - RNA, 18 nt, Artificial Sequence
  Description of Artificial Sequence: Synthetic oligonucleotide
uccugcaugagugcccgg

SEQ ID NO: 1253 - RNA, 18 nt, Artificial Sequence
  Description of Artificial Sequence: Synthetic oligonucleotide
gccucuccugcaugagug

SEQ ID NO: 1254 - RNA, 18 nt, Artificial Sequence
  Description of Artificial Sequence: Synthetic oligonucleotide
cacaggccucuccugcau

SEQ ID NO: 1255 - RNA, 18 nt, Artificial Sequence
  Description of Artificial Sequence: Synthetic oligonucleotide
cccgacacaggccucucc

SEQ ID NO: 1256 - RNA, 18 nt, Artificial Sequence
  Description of Artificial Sequence: Synthetic oligonucleotide
gugaccccgacacaggcc

SEQ ID NO: 1257 - RNA, 18 nt, Artificial Sequence
  Description of Artificial Sequence: Synthetic oligonucleotide
ugcacgugaccccgacac

SEQ ID NO: 1258 - RNA, 18 nt, Artificial Sequence
  Description of Artificial Sequence: Synthetic oligonucleotide
aggccugcacgugacccc

SEQ ID NO: 1259 - RNA, 18 nt, Artificial Sequence
  Description of Artificial Sequence: Synthetic oligonucleotide
ugggaaggccugcacgug

SEQ ID NO: 1260 - RNA, 18 nt, Artificial Sequence
  Description of Artificial Sequence: Synthetic oligonucleotide
gacgcugggaaggccugc

SEQ ID NO: 1261 - RNA, 18 nt, Artificial Sequence
  Description of Artificial Sequence: Synthetic oligonucleotide
gggaggacgcugggaagg

SEQ ID NO: 1262 - RNA, 18 nt, Artificial Sequence
  Description of Artificial Sequence: Synthetic oligonucleotide
gggcagggaggacgcugg

SEQ ID NO: 1263 - RNA, 18 nt, Artificial Sequence
  Description of Artificial Sequence: Synthetic oligonucleotide
cgagcgggcagggaggac

SEQ ID NO: 1264 - RNA, 18 nt, Artificial Sequence
  Description of Artificial Sequence: Synthetic oligonucleotide
uccaccgagcgggcaggg

SEQ ID NO: 1265 - RNA, 18 nt, Artificial Sequence
  Description of Artificial Sequence: Synthetic oligonucleotide
ugccauccaccgagcggg

SEQ ID NO: 1266 - RNA, 18 nt, Artificial Sequence
  Description of Artificial Sequence: Synthetic oligonucleotide
acugcugccauccaccga

SEQ ID NO: 1267 - RNA, 18 nt, Artificial Sequence
  Description of Artificial Sequence: Synthetic oligonucleotide
ugcuuacugcugccaucc

SEQ ID NO: 1268 - RNA, 18 nt, Artificial Sequence
  Description of Artificial Sequence: Synthetic oligonucleotide
ggcucugcuuacugcugc

SEQ ID NO: 1269 - RNA, 18 nt, Artificial Sequence
  Description of Artificial Sequence: Synthetic oligonucleotide
cccagggcucugcuuacu

SEQ ID NO: 1270 - RNA, 18 nt, Artificial Sequence
  Description of Artificial Sequence: Synthetic oligonucleotide
gccuccccagggcucugc

SEQ ID NO: 1271 - RNA, 18 nt, Artificial Sequence
  Description of Artificial Sequence: Synthetic oligonucleotide
ugcgagccuccccagggc

SEQ ID NO: 1272 - RNA, 18 nt, Artificial Sequence
  Description of Artificial Sequence: Synthetic oligonucleotide
agcccugcgagccucccc

SEQ ID NO: 1273 - RNA, 18 nt, Artificial Sequence
  Description of Artificial Sequence: Synthetic oligonucleotide
acagcagcccugcgagcc

SEQ ID NO: 1274 - RNA, 18 nt, Artificial Sequence
  Description of Artificial Sequence: Synthetic oligonucleotide
gagggacagcagcccugc

SEQ ID NO: 1275 - RNA, 18 nt, Artificial Sequence
  Description of Artificial Sequence: Synthetic oligonucleotide
gaccagagggacagcagc

SEQ ID NO: 1276 - RNA, 18 nt, Artificial Sequence
  Description of Artificial Sequence: Synthetic oligonucleotide
cuccugaccagagggaca

SEQ ID NO: 1277 - RNA, 18 nt, Artificial Sequence
  Description of Artificial Sequence: Synthetic oligonucleotide
gccuucuccugaccagag

SEQ ID NO: 1278 - RNA, 18 nt, Artificial Sequence
  Description of Artificial Sequence: Synthetic oligonucleotide
aaccagccuucuccugac

SEQ ID NO: 1279 - RNA, 18 nt, Artificial Sequence
  Description of Artificial Sequence: Synthetic oligonucleotide
ccgagaaccagccuucuc

SEQ ID NO: 1280 - RNA, 18 nt, Artificial Sequence
  Description of Artificial Sequence: Synthetic oligonucleotide
ggccuccgagaaccagcc

SEQ ID NO: 1281 - RNA, 18 nt, Artificial Sequence
  Description of Artificial Sequence: Synthetic oligonucleotide
gacguggccuccgagaac

SEQ ID NO: 1282 - RNA, 18 nt, Artificial Sequence
  Description of Artificial Sequence: Synthetic oligonucleotide
gcccugacguggccuccg

SEQ ID NO: 1283 - RNA, 18 nt, Artificial Sequence
  Description of Artificial Sequence: Synthetic oligonucleotide
cccuggcccugacguggc

SEQ ID NO: 1284 - RNA, 18 nt, Artificial Sequence
  Description of Artificial Sequence: Synthetic oligonucleotide
ccaggcccuggcccugac

SEQ ID NO: 1285 - RNA, 18 nt, Artificial Sequence
  Description of Artificial Sequence: Synthetic oligonucleotide
cugggccaggcccuggcc

SEQ ID NO: 1286 - RNA, 18 nt, Artificial Sequence
  Description of Artificial Sequence: Synthetic oligonucleotide
uccaugaccacggcggag

SEQ ID NO: 1287 - RNA, 18 nt, Artificial Sequence
  Description of Artificial Sequence: Synthetic oligonucleotide
ccuccuccaugaccacgg

SEQ ID NO: 1288 - RNA, 18 nt, Artificial Sequence
  Description of Artificial Sequence: Synthetic oligonucleotide
acuucccuccuccaugac

SEQ ID NO: 1289 - RNA, 18 nt, Artificial Sequence
  Description of Artificial Sequence: Synthetic oligonucleotide
cccggacuucccuccucc

SEQ ID NO: 1290 - RNA, 18 nt, Artificial Sequence
  Description of Artificial Sequence: Synthetic oligonucleotide
ccucgcccggacuucccu

SEQ ID NO: 1291 - RNA, 18 nt, Artificial Sequence
  Description of Artificial Sequence: Synthetic oligonucleotide
aggaaccucgcccggacu

SEQ ID NO: 1292 - RNA, 18 nt, Artificial Sequence
  Description of Artificial Sequence: Synthetic oligonucleotide
agcacaggaaccucgccc

SEQ ID NO: 1293 - RNA, 18 nt, Artificial Sequence
  Description of Artificial Sequence: Synthetic oligonucleotide
ccaccagcacaggaaccu

SEQ ID NO: 1294 - RNA, 18 nt, Artificial Sequence
  Description of Artificial Sequence: Synthetic oligonucleotide
gggcuccaccagcacagg

SEQ ID NO: 1295 - RNA, 18 nt, Artificial Sequence
  Description of Artificial Sequence: Synthetic oligonucleotide
ucaacguccuccaacccu

SEQ ID NO: 1296 - RNA, 18 nt, Artificial Sequence
  Description of Artificial Sequence: Synthetic oligonucleotide
cugccucaacguccucca

SEQ ID NO: 1297 - RNA, 18 nt, Artificial Sequence
  Description of Artificial Sequence: Synthetic oligonucleotide
uagcgcugccucaacguc

SEQ ID NO: 1298 - RNA, 18 nt, Artificial Sequence
  Description of Artificial Sequence: Synthetic oligonucleotide
augccuagcgcugccuca

SEQ ID NO: 1299 - RNA, 18 nt, Artificial Sequence
  Description of Artificial Sequence: Synthetic oligonucleotide
uguccaugccuagcgcug

SEQ ID NO: 1300 - RNA, 18 nt, Artificial Sequence
  Description of Artificial Sequence: Synthetic oligonucleotide
gcgccuguccaugccuag

SEQ ID NO: 1301 - RNA, 18 nt, Artificial Sequence
  Description of Artificial Sequence: Synthetic oligonucleotide
uccgugcgccuguccaug

SEQ ID NO: 1302 - RNA, 18 nt, Artificial Sequence
  Description of Artificial Sequence: Synthetic oligonucleotide
aggcauccgugcgccugu

SEQ ID NO: 1303 - RNA, 18 nt, Artificial Sequence
  Description of Artificial Sequence: Synthetic oligonucleotide
gcuguaggcauccgugcg

SEQ ID NO: 1304 - RNA, 18 nt, Artificial Sequence
  Description of Artificial Sequence: Synthetic oligonucleotide
agaggacauuggaccgca

SEQ ID NO: 1305 - RNA, 18 nt, Artificial Sequence
  Description of Artificial Sequence: Synthetic oligonucleotide
agacaagaggacauugga

SEQ ID NO: 1306 - RNA, 18 nt, Artificial Sequence
  Description of Artificial Sequence: Synthetic oligonucleotide
ucaaaagacaagaggaca

SEQ ID NO: 1307 - RNA, 18 nt, Artificial Sequence
  Description of Artificial Sequence: Synthetic oligonucleotide
ugucaucaaaagacaaga

SEQ ID NO: 1308 - RNA, 18 nt, Artificial Sequence
  Description of Artificial Sequence: Synthetic oligonucleotide
gaagcuguccuucucggg

SEQ ID NO: 1309 - RNA, 18 nt, Artificial Sequence
  Description of Artificial Sequence: Synthetic oligonucleotide
gcccugaagcuguccuuc

SEQ ID NO: 1310 - RNA, 18 nt, Artificial Sequence
  Description of Artificial Sequence: Synthetic oligonucleotide
uccgggcccugaagcugu

SEQ ID NO: 1311 - RNA, 18 nt, Artificial Sequence
  Description of Artificial Sequence: Synthetic oligonucleotide
aguacuccgggcccugaa

SEQ ID NO: 1312 - RNA, 18 nt, Artificial Sequence
  Description of Artificial Sequence: Synthetic oligonucleotide
agacuaguacuccgggcc

SEQ ID NO: 1313 - RNA, 18 nt, Artificial Sequence
  Description of Artificial Sequence: Synthetic oligonucleotide
cguugagacuaguacucc

SEQ ID NO: 1314 - RNA, 18 nt, Artificial Sequence
  Description of Artificial Sequence: Synthetic oligonucleotide
ucucucguugagacuagu

SEQ ID NO: 1315 - RNA, 18 nt, Artificial Sequence
  Description of Artificial Sequence: Synthetic oligonucleotide
uugggucucucguugaga

SEQ ID NO: 1316 - RNA, 18 nt, Artificial Sequence
  Description of Artificial Sequence: Synthetic oligonucleotide
aggcacacccccgcaggc

SEQ ID NO: 1317 - RNA, 18 nt, Artificial Sequence
  Description of Artificial Sequence: Synthetic oligonucleotide
acuccaggcacacccccg

SEQ ID NO: 1318 - RNA, 18 nt, Artificial Sequence
  Description of Artificial Sequence: Synthetic oligonucleotide
caccgacuccaggcacac

SEQ ID NO: 1319 - RNA, 18 nt, Artificial Sequence
  Description of Artificial Sequence: Synthetic oligonucleotide
ccccacaccgacuccagg

SEQ ID NO: 1320 - RNA, 18 nt, Artificial Sequence
  Description of Artificial Sequence: Synthetic oligonucleotide
ccccaccccacaccgacu

SEQ ID NO: 1321 - RNA, 18 nt, Artificial Sequence
  Description of Artificial Sequence: Synthetic oligonucleotide
uccuuccccaccccacac

SEQ ID NO: 1322 - RNA, 18 nt, Artificial Sequence
  Description of Artificial Sequence: Synthetic oligonucleotide
ccauguccuuccccaccc

SEQ ID NO: 1323 - RNA, 18 nt, Artificial Sequence
  Description of Artificial Sequence: Synthetic oligonucleotide
cagccccauguccuuccc

SEQ ID NO: 1324 - RNA, 18 nt, Artificial Sequence
  Description of Artificial Sequence: Synthetic oligonucleotide
ggccacagccccaugucc

SEQ ID NO: 1325 - RNA, 18 nt, Artificial Sequence
  Description of Artificial Sequence: Synthetic oligonucleotide
aggcaggccacagcccca

SEQ ID NO: 1326 - RNA, 18 nt, Artificial Sequence
  Description of Artificial Sequence: Synthetic oligonucleotide
ccgucaggcaggccacag

SEQ ID NO: 1327 - RNA, 18 nt, Artificial Sequence
  Description of Artificial Sequence: Synthetic oligonucleotide
aggcaccgucaggcaggc

SEQ ID NO: 1328 - RNA, 18 nt, Artificial Sequence
  Description of Artificial Sequence: Synthetic oligonucleotide
cuuggaggcaccgucagg

SEQ ID NO: 1329 - RNA, 18 nt, Artificial Sequence
  Description of Artificial Sequence: Synthetic oligonucleotide
acugacuuggaggcaccg

SEQ ID NO: 1330 - RNA, 18 nt, Artificial Sequence
  Description of Artificial Sequence: Synthetic oligonucleotide
cacucacugacuuggagg

SEQ ID NO: 1331 - RNA, 18 nt, Artificial Sequence
  Description of Artificial Sequence: Synthetic oligonucleotide
auuuccacucacugacuu

SEQ ID NO: 1332 - RNA, 18 nt, Artificial Sequence
  Description of Artificial Sequence: Synthetic oligonucleotide
gacccauuuccacucacu

SEQ ID NO: 1333 - RNA, 18 nt, Artificial Sequence
  Description of Artificial Sequence: Synthetic oligonucleotide
cacaggacccauuuccac

SEQ ID NO: 1334 - RNA, 18 nt, Artificial Sequence
  Description of Artificial Sequence: Synthetic oligonucleotide
gggcacacaggacccauu

SEQ ID NO: 1335 - RNA, 18 nt, Artificial Sequence
  Description of Artificial Sequence: Synthetic oligonucleotide
cuccagggcacacaggac

SEQ ID NO: 1336 - RNA, 18 nt, Artificial Sequence
  Description of Artificial Sequence: Synthetic oligonucleotide
acauacuccagggcacac

SEQ ID NO: 1337 - RNA, 18 nt, Artificial Sequence
  Description of Artificial Sequence: Synthetic oligonucleotide
gccucacauacuccaggg

SEQ ID NO: 1338 - RNA, 18 nt, Artificial Sequence
  Description of Artificial Sequence: Synthetic oligonucleotide
gcccugccucacauacuc

SEQ ID NO: 1339 - RNA, 18 nt, Artificial Sequence
  Description of Artificial Sequence: Synthetic oligonucleotide
guccugcccugccucaca

SEQ ID NO: 1340 - RNA, 18 nt, Artificial Sequence
  Description of Artificial Sequence: Synthetic oligonucleotide
ugcagguccugcccugcc

SEQ ID NO: 1341 - RNA, 18 nt, Artificial Sequence
  Description of Artificial Sequence: Synthetic oligonucleotide
gcccuugcagguccugcc

SEQ ID NO: 1342 - RNA, 18 nt, Artificial Sequence
  Description of Artificial Sequence: Synthetic oligonucleotide
uagcggcccuugcagguc

SEQ ID NO: 1343 - RNA, 18 nt, Artificial Sequence
  Description of Artificial Sequence: Synthetic oligonucleotide
gguguuagcggcccuugc

SEQ ID NO: 1344 - RNA, 18 nt, Artificial Sequence
  Description of Artificial Sequence: Synthetic oligonucleotide
ggguguuagcggcccuug

SEQ ID NO: 1345 - RNA, 18 nt, Artificial Sequence
  Description of Artificial Sequence: Synthetic oligonucleotide
cggccaaccugcugaggg

SEQ ID NO: 1346 - RNA, 18 nt, Artificial Sequence
  Description of Artificial Sequence: Synthetic oligonucleotide
caccacggccaaccugcu

SEQ ID NO: 1347 - RNA, 18 nt, Artificial Sequence
  Description of Artificial Sequence: Synthetic oligonucleotide
caggccaccacggccaac

SEQ ID NO: 1348 - RNA, 18 nt, Artificial Sequence
  Description of Artificial Sequence: Synthetic oligonucleotide
ggacccaggccaccacgg

SEQ ID NO: 1349 - RNA, 18 nt, Artificial Sequence
  Description of Artificial Sequence: Synthetic oligonucleotide
agcccggacccaggccac

SEQ ID NO: 1350 - RNA, 18 nt, Artificial Sequence
  Description of Artificial Sequence: Synthetic oligonucleotide
cacgcagcccggacccag

SEQ ID NO: 1351 - RNA, 18 nt, Artificial Sequence
  Description of Artificial Sequence: Synthetic oligonucleotide
uggcacacgcagcccgga

SEQ ID NO: 1352 - RNA, 18 nt, Artificial Sequence
  Description of Artificial Sequence: Synthetic oligonucleotide
gcccguggcacacgcagc

SEQ ID NO: 1353 - RNA, 18 nt, Artificial Sequence
  Description of Artificial Sequence: Synthetic oligonucleotide
uaggugcccguggcacac

SEQ ID NO: 1354 - RNA, 18 nt, Artificial Sequence
  Description of Artificial Sequence: Synthetic oligonucleotide
acaaguaggugcccgugg

SEQ ID NO: 1355 - RNA, 18 nt, Artificial Sequence
  Description of Artificial Sequence: Synthetic oligonucleotide
auuccacaaguaggugcc

SEQ ID NO: 1356 - RNA, 18 nt, Artificial Sequence
  Description of Artificial Sequence: Synthetic oligonucleotide
ccccaauuccacaaguag

SEQ ID NO: 1357 - RNA, 18 nt, Artificial Sequence
  Description of Artificial Sequence: Synthetic oligonucleotide
ccaacccccaauuccaca

SEQ ID NO: 1358 - RNA, 18 nt, Artificial Sequence
  Description of Artificial Sequence: Synthetic oligonucleotide
gcaccccaacccccaauu

SEQ ID NO: 1359 - RNA, 18 nt, Artificial Sequence
  Description of Artificial Sequence: Synthetic oligonucleotide
agcuugcaccccaacccc

SEQ ID NO: 1360 - RNA, 18 nt, Artificial Sequence
  Description of Artificial Sequence: Synthetic oligonucleotide
ccuaaagcuugcacccca

SEQ ID NO: 1361 - RNA, 18 nt, Artificial Sequence
  Description of Artificial Sequence: Synthetic oligonucleotide
aggcgccuaaagcuugca

SEQ ID NO: 1362 - RNA, 18 nt, Artificial Sequence
  Description of Artificial Sequence: Synthetic oligonucleotide
ggcucaggcgccuaaagc

SEQ ID NO: 1363 - RNA, 18 nt, Artificial Sequence
  Description of Artificial Sequence: Synthetic oligonucleotide
gggcucaggcgccuaaag

SEQ ID NO: 1364 - RNA, 18 nt, Artificial Sequence
  Description of Artificial Sequence: Synthetic oligonucleotide
ggccggcuccuucgaggg

SEQ ID NO: 1365 - RNA, 18 nt, Artificial Sequence
  Description of Artificial Sequence: Synthetic oligonucleotide
gacaaggccggcuccuuc

SEQ ID NO: 1366 - RNA, 18 nt, Artificial Sequence
  Description of Artificial Sequence: Synthetic oligonucleotide
ccccagacaaggccggcu

SEQ ID NO: 1367 - RNA, 18 nt, Artificial Sequence
  Description of Artificial Sequence: Synthetic oligonucleotide
ggcagccccagacaaggc

SEQ ID NO: 1368 - RNA, 18 nt, Artificial Sequence
  Description of Artificial Sequence: Synthetic oligonucleotide
gggcagccccagacaagg

SEQ ID NO: 1369 - RNA, 18 nt, Artificial Sequence
  Description of Artificial Sequence: Synthetic oligonucleotide
ggcuagcagcaggcuggg

SEQ ID NO: 1370 - RNA, 18 nt, Artificial Sequence
  Description of Artificial Sequence: Synthetic oligonucleotide
uccccggcuagcagcagg

SEQ ID NO: 1371 - RNA, 18 nt, Artificial Sequence
  Description of Artificial Sequence: Synthetic oligonucleotide
cagaguccccggcuagca

SEQ ID NO: 1372 - RNA, 18 nt, Artificial Sequence
  Description of Artificial Sequence: Synthetic oligonucleotide
ugaagcagaguccccggc

SEQ ID NO: 1373 - RNA, 18 nt, Artificial Sequence
  Description of Artificial Sequence: Synthetic oligonucleotide
ggugaugaagcagagucc

SEQ ID NO: 1374 - RNA, 18 nt, Artificial Sequence
  Description of Artificial Sequence: Synthetic oligonucleotide
gcggcggugaugaagcag

SEQ ID NO: 1375 - RNA, 18 nt, Artificial Sequence
  Description of Artificial Sequence: Synthetic oligonucleotide
gcaaggcggcggugauga

SEQ ID NO: 1376 - RNA, 18 nt, Artificial Sequence
  Description of Artificial Sequence: Synthetic oligonucleotide
guccggcaaggcggcggu

SEQ ID NO: 1377 - RNA, 18 nt, Artificial Sequence
  Description of Artificial Sequence: Synthetic oligonucleotide
uugcgguccggcaaggcg

SEQ ID NO: 1378 - RNA, 18 nt, Artificial Sequence
  Description of Artificial Sequence: Synthetic oligonucleotide
gcucuuugcgguccggca

SEQ ID NO: 1379 - RNA, 18 nt, Artificial Sequence
  Description of Artificial Sequence: Synthetic oligonucleotide
gcucagcucuuugcgguc

SEQ ID NO: 1380 - RNA, 18 nt, Artificial Sequence
  Description of Artificial Sequence: Synthetic oligonucleotide
ggcuggcucagcucuuug

SEQ ID NO: 1381 - RNA, 18 nt, Artificial Sequence
  Description of Artificial Sequence: Synthetic oligonucleotide
acagaggcuggcucagcu

SEQ ID NO: 1382 - RNA, 18 nt, Artificial Sequence
  Description of Artificial Sequence: Synthetic oligonucleotide
agaacacagaggcuggcu

SEQ ID NO: 1383 - RNA, 18 nt, Artificial Sequence
  Description of Artificial Sequence: Synthetic oligonucleotide
aaacaagaacacagaggc

SEQ ID NO: 1384 - RNA, 18 nt, Artificial Sequence
  Description of Artificial Sequence: Synthetic oligonucleotide
aaugcaaacaagaacaca

SEQ ID NO: 1385 - RNA, 18 nt, Artificial Sequence
  Description of Artificial Sequence: Synthetic oligonucleotide
aaugaaaugcaaacaaga

SEQ ID NO: 1386 - RNA, 18 nt, Artificial Sequence
  Description of Artificial Sequence: Synthetic oligonucleotide
guucaaaugaaaugcaaa

SEQ ID NO: 1387 - RNA, 18 nt, Artificial Sequence
  Description of Artificial Sequence: Synthetic oligonucleotide
aagccguucaaaugaaau

SEQ ID NO: 1388 - RNA, 18 nt, Artificial Sequence
  Description of Artificial Sequence: Synthetic oligonucleotide
ggagaaagccguucaaau

SEQ ID NO: 1389 - RNA, 18 nt, Artificial Sequence
  Description of Artificial Sequence: Synthetic oligonucleotide
caggaggagaaagccguu

SEQ ID NO: 1390 - RNA, 18 nt, Artificial Sequence
  Description of Artificial Sequence: Synthetic oligonucleotide
gggacaggaggagaaagc

SEQ ID NO: 1391 - RNA, 18 nt, Artificial Sequence
  Description of Artificial Sequence: Synthetic oligonucleotide
cucgggcaggaagguggg

SEQ ID NO: 1392 - RNA, 18 nt, Artificial Sequence
  Description of Artificial Sequence: Synthetic oligonucleotide
aauagcucgggcaggaag

SEQ ID NO: 1393 - RNA, 18 nt, Artificial Sequence
  Description of Artificial Sequence: Synthetic oligonucleotide
gccaaaauagcucgggca

SEQ ID NO: 1394 - RNA, 18 nt, Artificial Sequence
  Description of Artificial Sequence: Synthetic oligonucleotide
ggaaagccaaaauagcuc

SEQ ID NO: 1395 - RNA, 18 nt, Artificial Sequence
  Description of Artificial Sequence: Synthetic oligonucleotide
ucuagggaaagccaaaau

SEQ ID NO: 1396 - RNA, 18 nt, Artificial Sequence
  Description of Artificial Sequence: Synthetic oligonucleotide
ucccaucuagggaaagcc

SEQ ID NO: 1397 - RNA, 18 nt, Artificial Sequence
  Description of Artificial Sequence: Synthetic oligonucleotide
cguauucccaucuaggga

SEQ ID NO: 1398 - RNA, 18 nt, Artificial Sequence
  Description of Artificial Sequence: Synthetic oligonucleotide
aaugccguauucccaucu

SEQ ID NO: 1399 - RNA, 18 nt, Artificial Sequence
  Description of Artificial Sequence: Synthetic oligonucleotide
uggaaaaugccguauucc

SEQ ID NO: 1400 - RNA, 18 nt, Artificial Sequence
  Description of Artificial Sequence: Synthetic oligonucleotide
cacgcuggaaaaugccgu

SEQ ID NO: 1401 - RNA, 18 nt, Artificial Sequence
  Description of Artificial Sequence: Synthetic oligonucleotide
gaggucacgcuggaaaau

SEQ ID NO: 1402 - RNA, 18 nt, Artificial Sequence
  Description of Artificial Sequence: Synthetic oligonucleotide
gaguugaggucacgcugg

SEQ ID NO: 1403 - RNA, 18 nt, Artificial Sequence
  Description of Artificial Sequence: Synthetic oligonucleotide
cuuccgaguugaggucac

SEQ ID NO: 1404 - RNA, 18 nt, Artificial Sequence
  Description of Artificial Sequence: Synthetic oligonucleotide
gcuuccgaguugagguca

SEQ ID NO: 1405 - RNA, 18 nt, Artificial Sequence
  Description of Artificial Sequence: Synthetic oligonucleotide
caacagcuuccgaguuga

SEQ ID NO: 1406 - RNA, 18 nt, Artificial Sequence
  Description of Artificial Sequence: Synthetic oligonucleotide
ggagacaacagcuuccga

SEQ ID NO: 1407 - RNA, 18 nt, Artificial Sequence
  Description of Artificial Sequence: Synthetic oligonucleotide
gggcuggagacaacagcu

SEQ ID NO: 1408 - RNA, 18 nt, Artificial Sequence
  Description of Artificial Sequence: Synthetic oligonucleotide
ggcccccggcccccaggg

SEQ ID NO: 1409 - RNA, 18 nt, Artificial Sequence
  Description of Artificial Sequence: Synthetic oligonucleotide
gcuuggcccccggccccc

SEQ ID NO: 1410 - RNA, 18 nt, Artificial Sequence
  Description of Artificial Sequence: Synthetic oligonucleotide
gccgagcuuggcccccgg

SEQ ID NO: 1411 - RNA, 18 nt, Artificial Sequence
  Description of Artificial Sequence: Synthetic oligonucleotide
uaauggccgagcuuggcc

SEQ ID NO: 1412 - RNA, 18 nt, Artificial Sequence
  Description of Artificial Sequence: Synthetic oligonucleotide
ggccguaauggccgagcu

SEQ ID NO: 1413 - RNA, 18 nt, Artificial Sequence
  Description of Artificial Sequence: Synthetic oligonucleotide
ucucuggccguaauggcc

SEQ ID NO: 1414 - RNA, 18 nt, Artificial Sequence
  Description of Artificial Sequence: Synthetic oligonucleotide
aguagucucuggccguaa

SEQ ID NO: 1415 - RNA, 18 nt, Artificial Sequence
  Description of Artificial Sequence: Synthetic oligonucleotide
cagaaaguagucucuggc

SEQ ID NO: 1416 - RNA, 18 nt, Artificial Sequence
  Description of Artificial Sequence: Synthetic oligonucleotide
gaccccagaaaguagucu

SEQ ID NO: 1417 - RNA, 18 nt, Artificial Sequence
  Description of Artificial Sequence: Synthetic oligonucleotide
accaagaccccagaaagu

SEQ ID NO: 1418 - RNA, 18 nt, Artificial Sequence
  Description of Artificial Sequence: Synthetic oligonucleotide
aagagaccaagaccccag

SEQ ID NO: 1419 - RNA, 18 nt, Artificial Sequence
  Description of Artificial Sequence: Synthetic oligonucleotide
aggaaaagagaccaagac

SEQ ID NO: 1420 - RNA, 18 nt, Artificial Sequence
  Description of Artificial Sequence: Synthetic oligonucleotide
ucacuaggaaaagagacc

SEQ ID NO: 1421 - RNA, 18 nt, Artificial Sequence
  Description of Artificial Sequence: Synthetic oligonucleotide
gaaggucacuaggaaaag

SEQ ID NO: 1422 - RNA, 18 nt, Artificial Sequence
  Description of Artificial Sequence: Synthetic oligonucleotide
gcccugaaggucacuagg

SEQ ID NO: 1423 - RNA, 18 nt, Artificial Sequence
  Description of Artificial Sequence: Synthetic oligonucleotide
gccaggcccugaagguca

SEQ ID NO: 1424 - RNA, 18 nt, Artificial Sequence
  Description of Artificial Sequence: Synthetic oligonucleotide
caguggccaggcccugaa

SEQ ID NO: 1425 - RNA, 18 nt, Artificial Sequence
  Description of Artificial Sequence: Synthetic oligonucleotide
ggccucaguggccaggcc

SEQ ID NO: 1426 - RNA, 18 nt, Artificial Sequence
  Description of Artificial Sequence: Synthetic oligonucleotide
acugaggccucaguggcc

SEQ ID NO: 1427 - RNA, 18 nt, Artificial Sequence
  Description of Artificial Sequence: Synthetic oligonucleotide
gcggcacugaggccucag

SEQ ID NO: 1428 - RNA, 18 nt, Artificial Sequence
  Description of Artificial Sequence: Synthetic oligonucleotide
ccgaggcggcacugaggc

SEQ ID NO: 1429 - RNA, 18 nt, Artificial Sequence
  Description of Artificial Sequence: Synthetic oligonucleotide
ucugaccgaggcggcacu

SEQ ID NO: 1430 - RNA, 18 nt, Artificial Sequence
  Description of Artificial Sequence: Synthetic oligonucleotide
ccagcucugaccgaggcg

SEQ ID NO: 1431 - RNA, 18 nt, Artificial Sequence
  Description of Artificial Sequence: Synthetic oligonucleotide
accgcccagcucugaccg

SEQ ID NO: 1432 - RNA, 18 nt, Artificial Sequence
  Description of Artificial Sequence: Synthetic oligonucleotide
caggcaccgcccagcucu

SEQ ID NO: 1433 - RNA, 18 nt, Artificial Sequence
  Description of Artificial Sequence: Synthetic oligonucleotide
gaaggcaggcaccgccca

SEQ ID NO: 1434 - RNA, 18 nt, Artificial Sequence
  Description of Artificial Sequence: Synthetic oligonucleotide
ccgcggaaggcaggcacc

SEQ ID NO: 1435 - RNA, 18 nt, Artificial Sequence
  Description of Artificial Sequence: Synthetic oligonucleotide
cccacccgcggaaggcag

SEQ ID NO: 1436 - RNA, 18 nt, Artificial Sequence
  Description of Artificial Sequence: Synthetic oligonucleotide
ucccacccacccgcggaa

SEQ ID NO: 1437 - RNA, 18 nt, Artificial Sequence
  Description of Artificial Sequence: Synthetic oligonucleotide
ggcaaucccacccacccg

SEQ ID NO: 1438 - RNA, 18 nt, Artificial Sequence
  Description of Artificial Sequence: Synthetic oligonucleotide
ggccaggcaaucccaccc

SEQ ID NO: 1439 - RNA, 18 nt, Artificial Sequence
  Description of Artificial Sequence: Synthetic oligonucleotide
gugcuggccaggcaaucc

SEQ ID NO: 1440 - RNA, 18 nt, Artificial Sequence
  Description of Artificial Sequence: Synthetic oligonucleotide
aggcugugcuggccaggc

SEQ ID NO: 1441 - RNA, 18 nt, Artificial Sequence
  Description of Artificial Sequence: Synthetic oligonucleotide
auuccaggcugugcuggc

SEQ ID NO: 1442 - RNA, 18 nt, Artificial Sequence
  Description of Artificial Sequence: Synthetic oligonucleotide
ggcagauuccaggcugug

SEQ ID NO: 1443 - RNA, 18 nt, Artificial Sequence
  Description of Artificial Sequence: Synthetic oligonucleotide
cccacggcagauuccagg

SEQ ID NO: 1444 - RNA, 18 nt, Artificial Sequence
  Description of Artificial Sequence: Synthetic oligonucleotide
ucacccccacggcagauu

SEQ ID NO: 1445 - RNA, 18 nt, Artificial Sequence
  Description of Artificial Sequence: Synthetic oligonucleotide
gugggucacccccacggc

SEQ ID NO: 1446 - RNA, 18 nt, Artificial Sequence
  Description of Artificial Sequence: Synthetic oligonucleotide
cgugugugggucaccccc

SEQ ID NO: 1447 - RNA, 18 nt, Artificial Sequence
  Description of Artificial Sequence: Synthetic oligonucleotide
uuaaacguguguggguca

SEQ ID NO: 1448 - RNA, 18 nt, Artificial Sequence
  Description of Artificial Sequence: Synthetic oligonucleotide
gcaaauuaaacgugugug

SEQ ID NO: 1449 - RNA, 18 nt, Artificial Sequence
  Description of Artificial Sequence: Synthetic oligonucleotide
ucagugcaaauuaaacgu

SEQ ID NO: 1450 - RNA, 18 nt, Artificial Sequence
  Description of Artificial Sequence: Synthetic oligonucleotide
caacgucagugcaaauua

SEQ ID NO: 1451 - RNA, 18 nt, Artificial Sequence
  Description of Artificial Sequence: Synthetic oligonucleotide
acaaacaacgucagugca

SEQ ID NO: 1452 - RNA, 18 nt, Artificial Sequence
  Description of Artificial Sequence: Synthetic oligonucleotide
ccaaaacaaacaacguca

SEQ ID NO: 1453 - RNA, 18 nt, Artificial Sequence
  Description of Artificial Sequence: Synthetic oligonucleotide
ugacaccaaaacaaacaa

SEQ ID NO: 1454 - RNA, 18 nt, Artificial Sequence
  Description of Artificial Sequence: Synthetic oligonucleotide
acgcaugacaccaaaaca

SEQ ID NO: 1455 - RNA, 18 nt, Artificial Sequence
  Description of Artificial Sequence: Synthetic oligonucleotide
gcuucacgcaugacacca

SEQ ID NO: 1456 - RNA, 18 nt, Artificial Sequence
  Description of Artificial Sequence: Synthetic oligonucleotide
guaaggcuucacgcauga

SEQ ID NO: 1457 - RNA, 18 nt, Artificial Sequence
  Description of Artificial Sequence: Synthetic oligonucleotide
aacaaguaaggcuucacg

SEQ ID NO: 1458 - RNA, 18 nt, Artificial Sequence
  Description of Artificial Sequence: Synthetic oligonucleotide
cugagaacaaguaaggcu

SEQ ID NO: 1459 - RNA, 18 nt, Artificial Sequence
  Description of Artificial Sequence: Synthetic oligonucleotide
caugacugagaacaagua

SEQ ID NO: 1460 - RNA, 18 nt, Artificial Sequence
  Description of Artificial Sequence: Synthetic oligonucleotide
guaaacaugacugagaac

SEQ ID NO: 1461 - RNA, 18 nt, Artificial Sequence
  Description of Artificial Sequence: Synthetic oligonucleotide
gucugguaaacaugacug

SEQ ID NO: 1462 - RNA, 18 nt, Artificial Sequence
  Description of Artificial Sequence: Synthetic oligonucleotide
aauacgucugguaaacau

SEQ ID NO: 1463 - RNA, 18 nt, Artificial Sequence
  Description of Artificial Sequence: Synthetic oligonucleotide
augauaauacgucuggua

SEQ ID NO: 1464 - RNA, 18 nt, Artificial Sequence
  Description of Artificial Sequence: Synthetic oligonucleotide
aaugcaugauaauacguc

SEQ ID NO: 1465 - RNA, 18 nt, Artificial Sequence
  Description of Artificial Sequence: Synthetic oligonucleotide
acaaaaaugcaugauaau

SEQ ID NO: 1466 - RNA, 18 nt, Artificial Sequence
  Description of Artificial Sequence: Synthetic oligonucleotide
agaaaacaaaaaugcaug

SEQ ID NO: 1467 - RNA, 18 nt, Artificial Sequence
  Description of Artificial Sequence: Synthetic oligonucleotide
gagacagaaaacaaaaau

SEQ ID NO: 1468 - RNA, 18 nt, Artificial Sequence
  Description of Artificial Sequence: Synthetic oligonucleotide
gggaagagacagaaaaca

SEQ ID NO: 1469 - RNA, 18 nt, Artificial Sequence
  Description of Artificial Sequence: Synthetic oligonucleotide
caaagggcaguuagcggg

SEQ ID NO: 1470 - RNA, 18 nt, Artificial Sequence
  Description of Artificial Sequence: Synthetic oligonucleotide
ugccaaagggcaguuagc

SEQ ID NO: 1471 - RNA, 18 nt, Artificial Sequence
  Description of Artificial Sequence: Synthetic oligonucleotide
agccaugccaaagggcag

SEQ ID NO: 1472 - RNA, 18 nt, Artificial Sequence
  Description of Artificial Sequence: Synthetic oligonucleotide
aaaagagccaugccaaag

SEQ ID NO: 1473 - RNA, 18 nt, Artificial Sequence
  Description of Artificial Sequence: Synthetic oligonucleotide
gagcaaaaagagccaugc

SEQ ID NO: 1474 - RNA, 18 nt, Artificial Sequence
  Description of Artificial Sequence: Synthetic oligonucleotide
gagaugagcaaaaagagc

SEQ ID NO: 1475 - RNA, 18 nt, Artificial Sequence
  Description of Artificial Sequence: Synthetic oligonucleotide
cgggugagaugagcaaaa

SEQ ID NO: 1476 - RNA, 18 nt, Artificial Sequence
  Description of Artificial Sequence: Synthetic oligonucleotide
ucccgcgggugagaugag

SEQ ID NO: 1477 - RNA, 18 nt, Artificial Sequence
  Description of Artificial Sequence: Synthetic oligonucleotide
agagaucccgcgggugag

SEQ ID NO: 1478 - RNA, 18 nt, Artificial Sequence
  Description of Artificial Sequence: Synthetic oligonucleotide
gauggagagaucccgcgg

SEQ ID NO: 1479 - RNA, 18 nt, Artificial Sequence
  Description of Artificial Sequence: Synthetic oligonucleotide
gucaggauggagagaucc

SEQ ID NO: 1480 - RNA, 18 nt, Artificial Sequence
  Description of Artificial Sequence: Synthetic oligonucleotide
acagggucaggauggaga

SEQ ID NO: 1481 - RNA, 18 nt, Artificial Sequence
  Description of Artificial Sequence: Synthetic oligonucleotide
aggccacagggucaggau

SEQ ID NO: 1482 - RNA, 18 nt, Artificial Sequence
  Description of Artificial Sequence: Synthetic oligonucleotide
gucccaggccacaggguc

SEQ ID NO: 1483 - RNA, 18 nt, Artificial Sequence
  Description of Artificial Sequence: Synthetic oligonucleotide
gaaaggucccaggccaca

SEQ ID NO: 1484 - RNA, 18 nt, Artificial Sequence
  Description of Artificial Sequence: Synthetic oligonucleotide
aggaggaaaggucccagg

SEQ ID NO: 1485 - RNA, 18 nt, Artificial Sequence
  Description of Artificial Sequence: Synthetic oligonucleotide
gggugaggaggaaagguc

SEQ ID NO: 1486 - RNA, 18 nt, Artificial Sequence
  Description of Artificial Sequence: Synthetic oligonucleotide
gaacaagccaguggaggg

SEQ ID NO: 1487 - RNA, 18 nt, Artificial Sequence
  Description of Artificial Sequence: Synthetic oligonucleotide
gggagaacaagccagugg

SEQ ID NO: 1488 - RNA, 18 nt, Artificial Sequence
  Description of Artificial Sequence: Synthetic oligonucleotide
cccagcucccgggaaggg

SEQ ID NO: 1489 - RNA, 18 nt, Artificial Sequence
  Description of Artificial Sequence: Synthetic oligonucleotide
agcccagcucccgggaag

SEQ ID NO: 1490 - RNA, 18 nt, Artificial Sequence
  Description of Artificial Sequence: Synthetic oligonucleotide
cagagagcccagcucccg

SEQ ID NO: 1491 - RNA, 18 nt, Artificial Sequence
  Description of Artificial Sequence: Synthetic oligonucleotide
cgccccagagagcccagc

SEQ ID NO: 1492 - RNA, 18 nt, Artificial Sequence
  Description of Artificial Sequence: Synthetic oligonucleotide
cccaacgccccagagagc

SEQ ID NO: 1493 - RNA, 18 nt, Artificial Sequence
  Description of Artificial Sequence: Synthetic oligonucleotide
ggagccccaacgccccag

SEQ ID NO: 1494 - RNA, 18 nt, Artificial Sequence
  Description of Artificial Sequence: Synthetic oligonucleotide
gggucuggcuauccucag

SEQ ID NO: 1495 - RNA, 18 nt, Artificial Sequence
  Description of Artificial Sequence: Synthetic oligonucleotide
uuauucaagccuuguuug

SEQ ID NO: 1496 - RNA, 18 nt, Artificial Sequence
  Description of Artificial Sequence: Synthetic oligonucleotide
gagaguuauucaagccuu

SEQ ID NO: 1497 - RNA, 18 nt, Artificial Sequence
  Description of Artificial Sequence: Synthetic oligonucleotide
ggguggagaguuauucaa

SEQ ID NO: 1498 - RNA, 18 nt, Artificial Sequence
  Description of Artificial Sequence: Synthetic oligonucleotide
uucacggguggagaguua

SEQ ID NO: 1499 - RNA, 18 nt, Artificial Sequence
  Description of Artificial Sequence: Synthetic oligonucleotide
auucuuucacggguggag

SEQ ID NO: 1500 - RNA, 18 nt, Artificial Sequence
  Description of Artificial Sequence: Synthetic oligonucleotide
cuugaauucuuucacggg

SEQ ID NO: 1501 - RNA, 18 nt, Artificial Sequence
  Description of Artificial Sequence: Synthetic oligonucleotide
cucuccuugaauucuuuc

SEQ ID NO: 1502 - RNA, 18 nt, Artificial Sequence
  Description of Artificial Sequence: Synthetic oligonucleotide
cagagcucuccuugaauu

SEQ ID NO: 1503 - RNA, 18 nt, Artificial Sequence
  Description of Artificial Sequence: Synthetic oligonucleotide
ggcugcagagcucuccuu

SEQ ID NO: 1504 - RNA, 18 nt, Artificial Sequence
  Description of Artificial Sequence: Synthetic oligonucleotide
gccucggcugcagagcuc

SEQ ID NO: 1505 - RNA, 18 nt, Artificial Sequence
  Description of Artificial Sequence: Synthetic oligonucleotide
ggaaggccucggcugcag

SEQ ID NO: 1506 - RNA, 18 nt, Artificial Sequence
  Description of Artificial Sequence: Synthetic oligonucleotide
gcaccggaaggccucggc

SEQ ID NO: 1507 - RNA, 18 nt, Artificial Sequence
  Description of Artificial Sequence: Synthetic oligonucleotide
cugcggcaccggaaggcc

SEQ ID NO: 1508 - RNA, 18 nt, Artificial Sequence
  Description of Artificial Sequence: Synthetic oligonucleotide
ugaugcugcggcaccgga

SEQ ID NO: 1509 - RNA, 18 nt, Artificial Sequence
  Description of Artificial Sequence: Synthetic oligonucleotide
cacacugaugcugcggca

SEQ ID NO: 1510 - RNA, 18 nt, Artificial Sequence
  Description of Artificial Sequence: Synthetic oligonucleotide
ucagacacacugaugcug

SEQ ID NO: 1511 - RNA, 18 nt, Artificial Sequence
  Description of Artificial Sequence: Synthetic oligonucleotide
cauguucagacacacuga

SEQ ID NO: 1512 - RNA, 18 nt, Artificial Sequence
  Description of Artificial Sequence: Synthetic oligonucleotide
gaccacauguucagacac

SEQ ID NO: 1513 - RNA, 18 nt, Artificial Sequence
  Description of Artificial Sequence: Synthetic oligonucleotide
cugcggaccacauguuca

SEQ ID NO: 1514 - RNA, 18 nt, Artificial Sequence
  Description of Artificial Sequence: Synthetic oligonucleotide
gggucuggcuauccucag

SEQ ID NO: 1515 - RNA, 18 nt, Artificial Sequence
  Description of Artificial Sequence: Synthetic oligonucleotide
auucaagccuuguuuggg

SEQ ID NO: 1516 - RNA, 18 nt, Artificial Sequence
  Description of Artificial Sequence: Synthetic oligonucleotide
aguuauucaagccuuguu

SEQ ID NO: 1517 - RNA, 18 nt, Artificial Sequence
  Description of Artificial Sequence: Synthetic oligonucleotide
uggagaguuauucaagcc

SEQ ID NO: 1518 - RNA, 18 nt, Artificial Sequence
  Description of Artificial Sequence: Synthetic oligonucleotide
acggguggagaguuauuc

SEQ ID NO: 1519 - RNA, 18 nt, Artificial Sequence
  Description of Artificial Sequence: Synthetic oligonucleotide
cuuucacggguggagagu

SEQ ID NO: 1520 - RNA, 18 nt, Artificial Sequence
  Description of Artificial Sequence: Synthetic oligonucleotide
gaauucuuucacgggugg

SEQ ID NO: 1521 - RNA, 18 nt, Artificial Sequence
  Description of Artificial Sequence: Synthetic oligonucleotide
uccuugaauucuuucacg

SEQ ID NO: 1522 - RNA, 18 nt, Artificial Sequence
  Description of Artificial Sequence: Synthetic oligonucleotide
agcucuccuugaauucuu

SEQ ID NO: 1523 - RNA, 18 nt, Artificial Sequence
  Description of Artificial Sequence: Synthetic oligonucleotide
ugcagagcucuccuugaa

SEQ ID NO: 1524 - RNA, 18 nt, Artificial Sequence
  Description of Artificial Sequence: Synthetic oligonucleotide
ucggcugcagagcucucc

SEQ ID NO: 1525 - RNA, 18 nt, Artificial Sequence
  Description of Artificial Sequence: Synthetic oligonucleotide
aggccucggcugcagagc

SEQ ID NO: 1526 - RNA, 18 nt, Artificial Sequence
  Description of Artificial Sequence: Synthetic oligonucleotide
ccggaaggccucggcugc

SEQ ID NO: 1527 - RNA, 18 nt, Artificial Sequence
  Description of Artificial Sequence: Synthetic oligonucleotide
cggcaccggaaggccucg

SEQ ID NO: 1528 - RNA, 18 nt, Artificial Sequence
  Description of Artificial Sequence: Synthetic oligonucleotide
ugcugcggcaccggaagg

SEQ ID NO: 1529 - RNA, 18 nt, Artificial Sequence
  Description of Artificial Sequence: Synthetic oligonucleotide
acugaugcugcggcaccg

SEQ ID NO: 1530 - RNA, 18 nt, Artificial Sequence
  Description of Artificial Sequence: Synthetic oligonucleotide
gacacacugaugcugcgg

SEQ ID NO: 1531 - RNA, 18 nt, Artificial Sequence
  Description of Artificial Sequence: Synthetic oligonucleotide
guucagacacacugaugc

SEQ ID NO: 1532 - RNA, 18 nt, Artificial Sequence
  Description of Artificial Sequence: Synthetic oligonucleotide
cacauguucagacacacu

SEQ ID NO: 1533 - RNA, 18 nt, Artificial Sequence
  Description of Artificial Sequence: Synthetic oligonucleotide
cggaccacauguucagac

SEQ ID NO: 1534 - RNA, 18 nt, Artificial Sequence
  Description of Artificial Sequence: Synthetic oligonucleotide
cccccacccgacaguccc

SEQ ID NO: 1535 - RNA, 18 nt, Artificial Sequence
  Description of Artificial Sequence: Synthetic oligonucleotide
cgugccccccacccgaca

SEQ ID NO: 1536 - RNA, 18 nt, Artificial Sequence
  Description of Artificial Sequence: Synthetic oligonucleotide
ggguccgugccccccacc

SEQ ID NO: 1537 - RNA, 18 nt, Artificial Sequence
  Description of Artificial Sequence: Synthetic oligonucleotide
cuccaggguccgugcccc

SEQ ID NO: 1538 - RNA, 18 nt, Artificial Sequence
  Description of Artificial Sequence: Synthetic oligonucleotide
ccaagcuccaggguccgu

SEQ ID NO: 1539 - RNA, 18 nt, Artificial Sequence
  Description of Artificial Sequence: Synthetic oligonucleotide
gggccaagcuccaggguc

SEQ ID NO: 1540 - RNA, 18 nt, Artificial Sequence
  Description of Artificial Sequence: Synthetic oligonucleotide
cacccaggugcucacggg

SEQ ID NO: 1541 - RNA, 18 nt, Artificial Sequence
  Description of Artificial Sequence: Synthetic oligonucleotide
acugccacccaggugcuc

SEQ ID NO: 1542 - RNA, 18 nt, Artificial Sequence
  Description of Artificial Sequence: Synthetic oligonucleotide
caugcacugccacccagg

SEQ ID NO: 1543 - RNA, 18 nt, Artificial Sequence
  Description of Artificial Sequence: Synthetic oligonucleotide
agccccaugcacugccac

SEQ ID NO: 1544 - RNA, 18 nt, Artificial Sequence
  Description of Artificial Sequence: Synthetic oligonucleotide
caagcagccccaugcacu

SEQ ID NO: 1545 - RNA, 18 nt, Artificial Sequence
  Description of Artificial Sequence: Synthetic oligonucleotide
ucaugcaagcagccccau

SEQ ID NO: 1546 - RNA, 18 nt, Artificial Sequence
  Description of Artificial Sequence: Synthetic oligonucleotide
ugaggucaugcaagcagc

SEQ ID NO: 1547 - RNA, 18 nt, Artificial Sequence
  Description of Artificial Sequence: Synthetic oligonucleotide
gacgaugaggucaugcaa

SEQ ID NO: 1548 - RNA, 18 nt, Artificial Sequence
  Description of Artificial Sequence: Synthetic oligonucleotide
gggcagacgaugagguca

SEQ ID NO: 1549 - RNA, 18 nt, Artificial Sequence
  Description of Artificial Sequence: Synthetic oligonucleotide
gacacgggcagacgauga

SEQ ID NO: 1550 - RNA, 18 nt, Artificial Sequence
  Description of Artificial Sequence: Synthetic oligonucleotide
gggaggacacgggcagac

SEQ ID NO: 1551 - RNA, 18 nt, Artificial Sequence
  Description of Artificial Sequence: Synthetic oligonucleotide
ggccagggaggacacggg

SEQ ID NO: 1552 - RNA, 18 nt, Artificial Sequence
  Description of Artificial Sequence: Synthetic oligonucleotide
gggcuggccagggaggac

SEQ ID NO: 1553 - RNA, 18 nt, Artificial Sequence
  Description of Artificial Sequence: Synthetic oligonucleotide
ccccugggcuggccaggg

SEQ ID NO: 1554 - RNA, 18 nt, Artificial Sequence
  Description of Artificial Sequence: Synthetic oligonucleotide
ggcucccccugggcuggc

SEQ ID NO: 1555 - RNA, 18 nt, Artificial Sequence
  Description of Artificial Sequence: Synthetic oligonucleotide
ucaccggcucccccuggg

SEQ ID NO: 1556 - RNA, 18 nt, Artificial Sequence
  Description of Artificial Sequence: Synthetic oligonucleotide
ccucgucaccggcucccc

SEQ ID NO: 1557 - RNA, 18 nt, Artificial Sequence
  Description of Artificial Sequence: Synthetic oligonucleotide
ccaccccucgucaccggc

SEQ ID NO: 1558 - RNA, 18 nt, Artificial Sequence
  Description of Artificial Sequence: Synthetic oligonucleotide
ccuuuccaccccucguca

SEQ ID NO: 1559 - RNA, 18 nt, Artificial Sequence
  Description of Artificial Sequence: Synthetic oligonucleotide
ugcaaccuuuccaccccu

SEQ ID NO: 1560 - RNA, 18 nt, Artificial Sequence
  Description of Artificial Sequence: Synthetic oligonucleotide
cagaaugcaaccuuucca

SEQ ID NO: 1561 - RNA, 18 nt, Artificial Sequence
  Description of Artificial Sequence: Synthetic oligonucleotide
gggacagaaugcaaccuu

SEQ ID NO: 1562 - RNA, 18 nt, Artificial Sequence
  Description of Artificial Sequence: Synthetic oligonucleotide
agcccgugcucauacggg

SEQ ID NO: 1563 - RNA, 18 nt, Artificial Sequence
  Description of Artificial Sequence: Synthetic oligonucleotide
caaccagcccgugcucau

SEQ ID NO: 1564 - RNA, 18 nt, Artificial Sequence
  Description of Artificial Sequence: Synthetic oligonucleotide
gcgugcaaccagcccgug

SEQ ID NO: 1565 - RNA, 18 nt, Artificial Sequence
  Description of Artificial Sequence: Synthetic oligonucleotide
gggaugcgugcaaccagc

SEQ ID NO: 1566 - RNA, 18 nt, Artificial Sequence
  Description of Artificial Sequence: Synthetic oligonucleotide
cggagcggcaccccgagg

SEQ ID NO: 1567 - RNA, 18 nt, Artificial Sequence
  Description of Artificial Sequence: Synthetic oligonucleotide
ucucucggagcggcaccc

SEQ ID NO: 1568 - RNA, 18 nt, Artificial Sequence
  Description of Artificial Sequence: Synthetic oligonucleotide
cuggcucucucggagcgg

SEQ ID NO: 1569 - RNA, 18 nt, Artificial Sequence
  Description of Artificial Sequence: Synthetic oligonucleotide
cacgccuggcucucucgg

SEQ ID NO: 1570 - RNA, 18 nt, Artificial Sequence
  Description of Artificial Sequence: Synthetic oligonucleotide
cccggcacgccuggcucu

SEQ ID NO: 1571 - RNA, 18 nt, Artificial Sequence
  Description of Artificial Sequence: Synthetic oligonucleotide
ugcugcccggcacgccug

SEQ ID NO: 1572 - RNA, 18 nt, Artificial Sequence
  Description of Artificial Sequence: Synthetic oligonucleotide
gaggcugcugcccggcac

SEQ ID NO: 1573 - RNA, 18 nt, Artificial Sequence
  Description of Artificial Sequence: Synthetic oligonucleotide
gggaggcugcugcccggc

SEQ ID NO: 1574 - RNA, 18 nt, Artificial Sequence
  Description of Artificial Sequence: Synthetic oligonucleotide
cacacugcggcccuuggg

SEQ ID NO: 1575 - RNA, 18 nt, Artificial Sequence
  Description of Artificial Sequence: Synthetic oligonucleotide
caacccacacugcggccc

SEQ ID NO: 1576 - RNA, 18 nt, Artificial Sequence
  Description of Artificial Sequence: Synthetic oligonucleotide
ucccccaacccacacugc

SEQ ID NO: 1577 - RNA, 18 nt, Artificial Sequence
  Description of Artificial Sequence: Synthetic oligonucleotide
gugucucccccaacccac

SEQ ID NO: 1578 - RNA, 18 nt, Artificial Sequence
  Description of Artificial Sequence: Synthetic oligonucleotide
gaguggugucucccccaa

SEQ ID NO: 1579 - RNA, 18 nt, Artificial Sequence
  Description of Artificial Sequence: Synthetic oligonucleotide
accaggaguggugucucc

SEQ ID NO: 1580 - RNA, 18 nt, Artificial Sequence
  Description of Artificial Sequence: Synthetic oligonucleotide
ccaaaaccaggaguggug

SEQ ID NO: 1581 - RNA, 18 nt, Artificial Sequence
  Description of Artificial Sequence: Synthetic oligonucleotide
aaaggccaaaaccaggag

SEQ ID NO: 1582 - RNA, 18 nt, Artificial Sequence
  Description of Artificial Sequence: Synthetic oligonucleotide
uacgaaaaggccaaaacc

SEQ ID NO: 1583 - RNA, 18 nt, Artificial Sequence
  Description of Artificial Sequence: Synthetic oligonucleotide
gagaauacgaaaaggcca

SEQ ID NO: 1584 - RNA, 18 nt, Artificial Sequence
  Description of Artificial Sequence: Synthetic oligonucleotide
uucuagagaauacgaaaa

SEQ ID NO: 1585 - RNA, 18 nt, Artificial Sequence
  Description of Artificial Sequence: Synthetic oligonucleotide
guccauucuagagaauac

SEQ ID NO: 1586 - RNA, 18 nt, Artificial Sequence
  Description of Artificial Sequence: Synthetic oligonucleotide
aaaacguccauucuagag

SEQ ID NO: 1587 - RNA, 18 nt, Artificial Sequence
  Description of Artificial Sequence: Synthetic oligonucleotide
gaagaaaaacguccauuc

SEQ ID NO: 1588 - RNA, 18 nt, Artificial Sequence
  Description of Artificial Sequence: Synthetic oligonucleotide
agcccgaagaaaaacguc

SEQ ID NO: 1589 - RNA, 18 nt, Artificial Sequence
  Description of Artificial Sequence: Synthetic oligonucleotide
aagaaagcccgaagaaaa

SEQ ID NO: 1590 - RNA, 18 nt, Artificial Sequence
  Description of Artificial Sequence: Synthetic oligonucleotide
uugagaagaaagcccgaa

SEQ ID NO: 1591 - RNA, 18 nt, Artificial Sequence
  Description of Artificial Sequence: Synthetic oligonucleotide
ccuuguugagaagaaagc

SEQ ID NO: 1592 - RNA, 18 nt, Artificial Sequence
  Description of Artificial Sequence: Synthetic oligonucleotide
auaaaccuuguugagaag

SEQ ID NO: 1593 - RNA, 18 nt, Artificial Sequence
  Description of Artificial Sequence: Synthetic oligonucleotide
aaaaaauaaaccuuguug

SEQ ID NO: 1594 - RNA, 18 nt, Artificial Sequence
  Description of Artificial Sequence: Synthetic oligonucleotide
acaacaaaaaauaaaccu

SEQ ID NO: 1595 - RNA, 18 nt, Artificial Sequence
  Description of Artificial Sequence: Synthetic oligonucleotide
cagcuacaacaaaaaaua

SEQ ID NO: 1596 - RNA, 18 nt, Artificial Sequence
  Description of Artificial Sequence: Synthetic oligonucleotide
ccuuucagcuacaacaaa

SEQ ID NO: 1597 - RNA, 18 nt, Artificial Sequence
  Description of Artificial Sequence: Synthetic oligonucleotide
uguucccuuucagcuaca

SEQ ID NO: 1598 - RNA, 18 nt, Artificial Sequence
  Description of Artificial Sequence: Synthetic oligonucleotide
ccccuuguucccuuucag

SEQ ID NO: 1599 - RNA, 18 nt, Artificial Sequence
  Description of Artificial Sequence: Synthetic oligonucleotide
aaaugccccuuguucccu

SEQ ID NO: 1600 - RNA, 18 nt, Artificial Sequence
  Description of Artificial Sequence: Synthetic oligonucleotide
uccacaaaugccccuugu

SEQ ID NO: 1601 - RNA, 18 nt, Artificial Sequence
  Description of Artificial Sequence: Synthetic oligonucleotide
cacccuccacaaaugccc

SEQ ID NO: 1602 - RNA, 18 nt, Artificial Sequence
  Description of Artificial Sequence: Synthetic oligonucleotide
cccagcacccuccacaaa

SEQ ID NO: 1603 - RNA, 18 nt, Artificial Sequence
  Description of Artificial Sequence: Synthetic oligonucleotide
cccaccccagcacccucc

SEQ ID NO: 1604 - RNA, 18 nt, Artificial Sequence
  Description of Artificial Sequence: Synthetic oligonucleotide
gcugccccaccccagcac

SEQ ID NO: 1605 - RNA, 18 nt, Artificial Sequence
  Description of Artificial Sequence: Synthetic oligonucleotide
cccaggcugccccacccc

SEQ ID NO: 1606 - RNA, 18 nt, Artificial Sequence
  Description of Artificial Sequence: Synthetic oligonucleotide
gcccucccaggcugcccc

SEQ ID NO: 1607 - RNA, 18 nt, Artificial Sequence
  Description of Artificial Sequence: Synthetic oligonucleotide
cccaggcccucccaggcu

SEQ ID NO: 1608 - RNA, 18 nt, Artificial Sequence
  Description of Artificial Sequence: Synthetic oligonucleotide
ccccacccaggcccuccc

SEQ ID NO: 1609 - RNA, 18 nt, Artificial Sequence
  Description of Artificial Sequence: Synthetic oligonucleotide
cuagcccccacccaggcc

SEQ ID NO: 1610 - RNA, 18 nt, Artificial Sequence
  Description of Artificial Sequence: Synthetic oligonucleotide
ggauccuagcccccaccc

SEQ ID NO: 1611 - RNA, 18 nt, Artificial Sequence
  Description of Artificial Sequence: Synthetic oligonucleotide
cugcaggauccuagcccc

SEQ ID NO: 1612 - RNA, 18 nt, Artificial Sequence
  Description of Artificial Sequence: Synthetic oligonucleotide
augcccugcaggauccua

SEQ ID NO: 1613 - RNA, 18 nt, Artificial Sequence
  Description of Artificial Sequence: Synthetic oligonucleotide
ugcccaugcccugcagga

SEQ ID NO: 1614 - RNA, 18 nt, Artificial Sequence
  Description of Artificial Sequence: Synthetic oligonucleotide
gcccaugcccaugcccug

SEQ ID NO: 1615 - RNA, 18 nt, Artificial Sequence
  Description of Artificial Sequence: Synthetic oligonucleotide
cccaggcccaugcccaug

SEQ ID NO: 1616 - RNA, 18 nt, Artificial Sequence
  Description of Artificial Sequence: Synthetic oligonucleotide
gggcccaggcccaugccc

SEQ ID NO: 1617 - RNA, 18 nt, Artificial Sequence
  Description of Artificial Sequence: Synthetic oligonucleotide
cuaagaccauggccuggg

SEQ ID NO: 1618 - RNA, 18 nt, Artificial Sequence
  Description of Artificial Sequence: Synthetic oligonucleotide
gagaacuaagaccauggc

SEQ ID NO: 1619 - RNA, 18 nt, Artificial Sequence
  Description of Artificial Sequence: Synthetic oligonucleotide
auacaaauuucauagccc

SEQ ID NO: 1620 - RNA, 18 nt, Artificial Sequence
  Description of Artificial Sequence: Synthetic oligonucleotide
uucugauacaaauuucau

SEQ ID NO: 1621 - RNA, 18 nt, Artificial Sequence
  Description of Artificial Sequence: Synthetic oligonucleotide
guucauucugauacaaau

SEQ ID NO: 1622 - RNA, 18 nt, Artificial Sequence
  Description of Artificial Sequence: Synthetic oligonucleotide
ugggaguucauucugaua

SEQ ID NO: 1623 - RNA, 18 nt, Artificial Sequence
  Description of Artificial Sequence: Synthetic oligonucleotide
gcuuaugggaguucauuc

SEQ ID NO: 1624 - RNA, 18 nt, Artificial Sequence
  Description of Artificial Sequence: Synthetic oligonucleotide
aagaggcuuaugggaguu

SEQ ID NO: 1625 - RNA, 18 nt, Artificial Sequence
  Description of Artificial Sequence: Synthetic oligonucleotide
cagggaagaggcuuaugg

SEQ ID NO: 1626 - RNA, 18 nt, Artificial Sequence
  Description of Artificial Sequence: Synthetic oligonucleotide
agugacagggaagaggcu

SEQ ID NO: 1627 - RNA, 18 nt, Artificial Sequence
  Description of Artificial Sequence: Synthetic oligonucleotide
cacccagugacagggaag

SEQ ID NO: 1628 - RNA, 18 nt, Artificial Sequence
  Description of Artificial Sequence: Synthetic oligonucleotide
cuccacacccagugacag

SEQ ID NO: 1629 - RNA, 18 nt, Artificial Sequence
  Description of Artificial Sequence: Synthetic oligonucleotide
cugagcuccacacccagu

SEQ ID NO: 1630 - RNA, 18 nt, Artificial Sequence
  Description of Artificial Sequence: Synthetic oligonucleotide
gcugccugagcuccacac

SEQ ID NO: 1631 - RNA, 18 nt, Artificial Sequence
  Description of Artificial Sequence: Synthetic oligonucleotide
gagcggcugccugagcuc

SEQ ID NO: 1632 - RNA, 18 nt, Artificial Sequence
  Description of Artificial Sequence: Synthetic oligonucleotide
caggcgagcggcugccug

SEQ ID NO: 1633 - RNA, 18 nt, Artificial Sequence
  Description of Artificial Sequence: Synthetic oligonucleotide
ucaggcaggcgagcggcu

SEQ ID NO: 1634 - RNA, 18 nt, Artificial Sequence
  Description of Artificial Sequence: Synthetic oligonucleotide
cacccucaggcaggcgag

SEQ ID NO: 1635 - RNA, 18 nt, Artificial Sequence
  Description of Artificial Sequence: Synthetic oligonucleotide
accgucacccucaggcag

SEQ ID NO: 1636 - RNA, 18 nt, Artificial Sequence
  Description of Artificial Sequence: Synthetic oligonucleotide
cuuccaccgucacccuca

SEQ ID NO: 1637 - RNA, 18 nt, Artificial Sequence
  Description of Artificial Sequence: Synthetic oligonucleotide
guggccuuccaccgucac

SEQ ID NO: 1638 - RNA, 18 nt, Artificial Sequence
  Description of Artificial Sequence: Synthetic oligonucleotide
cccauguggccuuccacc

SEQ ID NO: 1639 - RNA, 18 nt, Artificial Sequence
  Description of Artificial Sequence: Synthetic oligonucleotide
ggauccccauguggccuu

SEQ ID NO: 1640 - RNA, 18 nt, Artificial Sequence
  Description of Artificial Sequence: Synthetic oligonucleotide
gucugggauccccaugug

SEQ ID NO: 1641 - RNA, 18 nt, Artificial Sequence
  Description of Artificial Sequence: Synthetic oligonucleotide
cagaggucugggaucccc

SEQ ID NO: 1642 - RNA, 18 nt, Artificial Sequence
  Description of Artificial Sequence: Synthetic oligonucleotide
gcacacagaggucuggga

SEQ ID NO: 1643 - RNA, 18 nt, Artificial Sequence
  Description of Artificial Sequence: Synthetic oligonucleotide
ggcaagcacacagagguc

SEQ ID NO: 1644 - RNA, 18 nt, Artificial Sequence
  Description of Artificial Sequence: Synthetic oligonucleotide
ccuccggcaagcacacag

SEQ ID NO: 1645 - RNA, 18 nt, Artificial Sequence
  Description of Artificial Sequence: Synthetic oligonucleotide
ggcugccuccggcaagca

SEQ ID NO: 1646 - RNA, 18 nt, Artificial Sequence
  Description of Artificial Sequence: Synthetic oligonucleotide
ccgcaggcugccuccggc

SEQ ID NO: 1647 - RNA, 18 nt, Artificial Sequence
  Description of Artificial Sequence: Synthetic oligonucleotide
ucugcccgcaggcugccu

SEQ ID NO: 1648 - RNA, 18 nt, Artificial Sequence
  Description of Artificial Sequence: Synthetic oligonucleotide
ugcauucugcccgcaggc

SEQ ID NO: 1649 - RNA, 18 nt, Artificial Sequence
  Description of Artificial Sequence: Synthetic oligonucleotide
cagauugcauucugcccg

SEQ ID NO: 1650 - RNA, 18 nt, Artificial Sequence
  Description of Artificial Sequence: Synthetic oligonucleotide
aggcccagauugcauucu

SEQ ID NO: 1651 - RNA, 18 nt, Artificial Sequence
  Description of Artificial Sequence: Synthetic oligonucleotide
cagacaggcccagauugc

SEQ ID NO: 1652 - RNA, 18 nt, Artificial Sequence
  Description of Artificial Sequence: Synthetic oligonucleotide
ccacacagacaggcccag

SEQ ID NO: 1653 - RNA, 18 nt, Artificial Sequence
  Description of Artificial Sequence: Synthetic oligonucleotide
ggaggccacacagacagg

SEQ ID NO: 1654 - RNA, 18 nt, Artificial Sequence
  Description of Artificial Sequence: Synthetic oligonucleotide
gaggcggaggccacacag

SEQ ID NO: 1655 - RNA, 18 nt, Artificial Sequence
  Description of Artificial Sequence: Synthetic oligonucleotide
gcagagaggcggaggcca

SEQ ID NO: 1656 - RNA, 18 nt, Artificial Sequence
  Description of Artificial Sequence: Synthetic oligonucleotide
gucaugcagagaggcgga

SEQ ID NO: 1657 - RNA, 18 nt, Artificial Sequence
  Description of Artificial Sequence: Synthetic oligonucleotide
guguagucaugcagagag

SEQ ID NO: 1658 - RNA, 18 nt, Artificial Sequence
  Description of Artificial Sequence: Synthetic oligonucleotide
aaacgguguagucaugca

SEQ ID NO: 1659 - RNA, 18 nt, Artificial Sequence
  Description of Artificial Sequence: Synthetic oligonucleotide
uggcgaaacgguguaguc

SEQ ID NO: 1660 - RNA, 18 nt, Artificial Sequence
  Description of Artificial Sequence: Synthetic oligonucleotide
ccuccuggcgaaacggug

SEQ ID NO: 1661 - RNA, 18 nt, Artificial Sequence
  Description of Artificial Sequence: Synthetic oligonucleotide
uacggccuccuggcgaaa

SEQ ID NO: 1662 - RNA, 18 nt, Artificial Sequence
  Description of Artificial Sequence: Synthetic oligonucleotide
uagguuacggccuccugg

SEQ ID NO: 1663 - RNA, 18 nt, Artificial Sequence
  Description of Artificial Sequence: Synthetic oligonucleotide
agcacuagguuacggccu

SEQ ID NO: 1664 - RNA, 18 nt, Artificial Sequence
  Description of Artificial Sequence: Synthetic oligonucleotide
acgggagcacuagguuac

SEQ ID NO: 1665 - RNA, 18 nt, Artificial Sequence
  Description of Artificial Sequence: Synthetic oligonucleotide
agcccacgggagcacuag

SEQ ID NO: 1666 - RNA, 18 nt, Artificial Sequence
  Description of Artificial Sequence: Synthetic oligonucleotide
accgaagcccacgggagc

SEQ ID NO: 1667 - RNA, 18 nt, Artificial Sequence
  Description of Artificial Sequence: Synthetic oligonucleotide
cccucaccgaagcccacg

SEQ ID NO: 1668 - RNA, 18 nt, Artificial Sequence
  Description of Artificial Sequence: Synthetic oligonucleotide
caucccccucaccgaagc

SEQ ID NO: 1669 - RNA, 18 nt, Artificial Sequence
  Description of Artificial Sequence: Synthetic oligonucleotide
accgacaucccccucacc

SEQ ID NO: 1670 - RNA, 18 nt, Artificial Sequence
  Description of Artificial Sequence: Synthetic oligonucleotide
uagagaccgacauccccc

SEQ ID NO: 1671 - RNA, 18 nt, Artificial Sequence
  Description of Artificial Sequence: Synthetic oligonucleotide
gaggcuagagaccgacau

SEQ ID NO: 1672 - RNA, 18 nt, Artificial Sequence
  Description of Artificial Sequence: Synthetic oligonucleotide
cucaggaggcuagagacc

SEQ ID NO: 1673 - RNA, 18 nt, Artificial Sequence
  Description of Artificial Sequence: Synthetic oligonucleotide
gcagacucaggaggcuag

SEQ ID NO: 1674 - RNA, 18 nt, Artificial Sequence
  Description of Artificial Sequence: Synthetic oligonucleotide
ucggagcagacucaggag

SEQ ID NO: 1675 - RNA, 18 nt, Artificial Sequence
  Description of Artificial Sequence: Synthetic oligonucleotide
acuggucggagcagacuc

SEQ ID NO: 1676 - RNA, 18 nt, Artificial Sequence
  Description of Artificial Sequence: Synthetic oligonucleotide
ggccuacuggucggagca

SEQ ID NO: 1677 - RNA, 18 nt, Artificial Sequence
  Description of Artificial Sequence: Synthetic oligonucleotide
gaccaggccuacuggucg

SEQ ID NO: 1678 - RNA, 18 nt, Artificial Sequence
  Description of Artificial Sequence: Synthetic oligonucleotide
gggaagaccaggccuacu

SEQ ID NO: 1679 - RNA, 18 nt, Artificial Sequence
  Description of Artificial Sequence: Synthetic oligonucleotide
auugucccagagaacggg

SEQ ID NO: 1680 - RNA, 18 nt, Artificial Sequence
  Description of Artificial Sequence: Synthetic oligonucleotide
ccacauugucccagagaa

SEQ ID NO: 1681 - RNA, 18 nt, Artificial Sequence
  Description of Artificial Sequence: Synthetic oligonucleotide
guggaccacauuguccca

SEQ ID NO: 1682 - RNA, 18 nt, Artificial Sequence
  Description of Artificial Sequence: Synthetic oligonucleotide
aucacguggaccacauug

SEQ ID NO: 1683 - RNA, 18 nt, Artificial Sequence
  Description of Artificial Sequence: Synthetic oligonucleotide
ugagaaucacguggacca

SEQ ID NO: 1684 - RNA, 18 nt, Artificial Sequence
  Description of Artificial Sequence: Synthetic oligonucleotide
cagcuugagaaucacgug

SEQ ID NO: 1685 - RNA, 18 nt, Artificial Sequence
  Description of Artificial Sequence: Synthetic oligonucleotide
agccucagcuugagaauc

SEQ ID NO: 1686 - RNA, 18 nt, Artificial Sequence
  Description of Artificial Sequence: Synthetic oligonucleotide
cagcgagccucagcuuga

SEQ ID NO: 1687 - RNA, 18 nt, Artificial Sequence
  Description of Artificial Sequence: Synthetic oligonucleotide
cggcccagcgagccucag

SEQ ID NO: 1688 - RNA, 18 nt, Artificial Sequence
  Description of Artificial Sequence: Synthetic oligonucleotide
gugggcggcccagcgagc

SEQ ID NO: 1689 - RNA, 18 nt, Artificial Sequence
  Description of Artificial Sequence: Synthetic oligonucleotide
agggcgugggcggcccag

SEQ ID NO: 1690 - RNA, 18 nt, Artificial Sequence
  Description of Artificial Sequence: Synthetic oligonucleotide
ccaacagggcgugggcgg

SEQ ID NO: 1691 - RNA, 18 nt, Artificial Sequence
  Description of Artificial Sequence: Synthetic oligonucleotide
agaccccaacagggcgug

SEQ ID NO: 1692 - RNA, 18 nt, Artificial Sequence
  Description of Artificial Sequence: Synthetic oligonucleotide
cggaaagaccccaacagg

SEQ ID NO: 1693 - RNA, 18 nt, Artificial Sequence
  Description of Artificial Sequence: Synthetic oligonucleotide
ucgcucggaaagacccca

SEQ ID NO: 1694 - RNA, 18 nt, Artificial Sequence
  Description of Artificial Sequence: Synthetic oligonucleotide
ggaccucgcucggaaaga

SEQ ID NO: 1695 - RNA, 18 nt, Artificial Sequence
  Description of Artificial Sequence: Synthetic oligonucleotide
gcugaggaccucgcucgg

SEQ ID NO: 1696 - RNA, 18 nt, Artificial Sequence
  Description of Artificial Sequence: Synthetic oligonucleotide
gcacggcugaggaccucg

SEQ ID NO: 1697 - RNA, 18 nt, Artificial Sequence
  Description of Artificial Sequence: Synthetic oligonucleotide
cgcaugcacggcugagga

SEQ ID NO: 1698 - RNA, 18 nt, Artificial Sequence
  Description of Artificial Sequence: Synthetic oligonucleotide
cucaacgcaugcacggcu

SEQ ID NO: 1699 - RNA, 18 nt, Artificial Sequence
  Description of Artificial Sequence: Synthetic oligonucleotide
caaagcucaacgcaugca

SEQ ID NO: 1700 - RNA, 18 nt, Artificial Sequence
  Description of Artificial Sequence: Synthetic oligonucleotide
agggccaaagcucaacgc

SEQ ID NO: 1701 - RNA, 18 nt, Artificial Sequence
  Description of Artificial Sequence: Synthetic oligonucleotide
caccaagggccaaagcuc

SEQ ID NO: 1702 - RNA, 18 nt, Artificial Sequence
  Description of Artificial Sequence: Synthetic oligonucleotide
ccuaucaccaagggccaa

SEQ ID NO: 1703 - RNA, 18 nt, Artificial Sequence
  Description of Artificial Sequence: Synthetic oligonucleotide
agccaccuaucaccaagg

SEQ ID NO: 1704 - RNA, 18 nt, Artificial Sequence
  Description of Artificial Sequence: Synthetic oligonucleotide
ggccgagccaccuaucac

SEQ ID NO: 1705 - RNA, 18 nt, Artificial Sequence
  Description of Artificial Sequence: Synthetic oligonucleotide
gggcgggccgagccaccu

SEQ ID NO: 1706 - RNA, 18 nt, Artificial Sequence
  Description of Artificial Sequence: Synthetic oligonucleotide
agguagggcgggccgagc

SEQ ID NO: 1707 - RNA, 18 nt, Artificial Sequence
  Description of Artificial Sequence: Synthetic oligonucleotide
gugccagguagggcgggc

SEQ ID NO: 1708 - RNA, 18 nt, Artificial Sequence
  Description of Artificial Sequence: Synthetic oligonucleotide
ucagggugccagguaggg

SEQ ID NO: 1709 - RNA, 18 nt, Artificial Sequence
  Description of Artificial Sequence: Synthetic oligonucleotide
cagggucagggugccagg

SEQ ID NO: 1710 - RNA, 18 nt, Artificial Sequence
  Description of Artificial Sequence: Synthetic oligonucleotide
gugaccagggucagggug

SEQ ID NO: 1711 - RNA, 18 nt, Artificial Sequence
  Description of Artificial Sequence: Synthetic oligonucleotide
gagggacgucuguauccu

SEQ ID NO: 1712 - RNA, 18 nt, Artificial Sequence
  Description of Artificial Sequence: Synthetic oligonucleotide
cuggugagggacgucugu

SEQ ID NO: 1713 - RNA, 18 nt, Artificial Sequence
  Description of Artificial Sequence: Synthetic oligonucleotide
uggcacuggugagggacg

SEQ ID NO: 1714 - RNA, 18 nt, Artificial Sequence
  Description of Artificial Sequence: Synthetic oligonucleotide
caagcuggcacuggugag

SEQ ID NO: 1715 - RNA, 18 nt, Artificial Sequence
  Description of Artificial Sequence: Synthetic oligonucleotide
gaccccaagcuggcacug

SEQ ID NO: 1716 - RNA, 18 nt, Artificial Sequence
  Description of Artificial Sequence: Synthetic oligonucleotide
cugcagaccccaagcugg

SEQ ID NO: 1717 - RNA, 18 nt, Artificial Sequence
  Description of Artificial Sequence: Synthetic oligonucleotide
cucaucugcagaccccaa

SEQ ID NO: 1718 - RNA, 18 nt, Artificial Sequence
  Description of Artificial Sequence: Synthetic oligonucleotide
gaguucucaucugcagac

SEQ ID NO: 1719 - RNA, 18 nt, Artificial Sequence
  Description of Artificial Sequence: Synthetic oligonucleotide
ccacggaguucucaucug

SEQ ID NO: 1720 - RNA, 18 nt, Artificial Sequence
  Description of Artificial Sequence: Synthetic oligonucleotide
cugggccacggaguucuc

SEQ ID NO: 1721 - RNA, 18 nt, Artificial Sequence
  Description of Artificial Sequence: Synthetic oligonucleotide
ucagccugggccacggag

SEQ ID NO: 1722 - RNA, 18 nt, Artificial Sequence
  Description of Artificial Sequence: Synthetic oligonucleotide
uaucgucagccugggcca

SEQ ID NO: 1723 - RNA, 18 nt, Artificial Sequence
  Description of Artificial Sequence: Synthetic oligonucleotide
caggcuaucgucagccug

SEQ ID NO: 1724 - RNA, 18 nt, Artificial Sequence
  Description of Artificial Sequence: Synthetic oligonucleotide
uuuuucaggcuaucguca

SEQ ID NO: 1725 - RNA, 18 nt, Artificial Sequence
  Description of Artificial Sequence: Synthetic oligonucleotide
ggagguuuuucaggcuau

SEQ ID NO: 1726 - RNA, 18 nt, Artificial Sequence
  Description of Artificial Sequence: Synthetic oligonucleotide
cagguggagguuuuucag

SEQ ID NO: 1727 - RNA, 18 nt, Artificial Sequence
  Description of Artificial Sequence: Synthetic oligonucleotide
agcuccagguggagguuu

SEQ ID NO: 1728 - RNA, 18 nt, Artificial Sequence
  Description of Artificial Sequence: Synthetic oligonucleotide
ccgugagcuccaggugga

SEQ ID NO: 1729 - RNA, 18 nt, Artificial Sequence
  Description of Artificial Sequence: Synthetic oligonucleotide
gguuuccgugagcuccag

SEQ ID NO: 1730 - RNA, 18 nt, Artificial Sequence
  Description of Artificial Sequence: Synthetic oligonucleotide
agacagguuuccgugagc

SEQ ID NO: 1731 - RNA, 18 nt, Artificial Sequence
  Description of Artificial Sequence: Synthetic oligonucleotide
uguccagacagguuuccg

SEQ ID NO: 1732 - RNA, 18 nt, Artificial Sequence
  Description of Artificial Sequence: Synthetic oligonucleotide
caucauguccagacaggu

SEQ ID NO: 1733 - RNA, 18 nt, Artificial Sequence
  Description of Artificial Sequence: Synthetic oligonucleotide
cgagccaucauguccaga

SEQ ID NO: 1734 - RNA, 18 nt, Artificial Sequence
  Description of Artificial Sequence: Synthetic oligonucleotide
cguaucgagccaucaugu

SEQ ID NO: 1735 - RNA, 18 nt, Artificial Sequence
  Description of Artificial Sequence: Synthetic oligonucleotide
gaagacguaucgagccau

SEQ ID NO: 1736 - RNA, 18 nt, Artificial Sequence
  Description of Artificial Sequence: Synthetic oligonucleotide
uuggagaagacguaucga

SEQ ID NO: 1737 - RNA, 18 nt, Artificial Sequence
  Description of Artificial Sequence: Synthetic oligonucleotide
ugaaguuggagaagacgu

SEQ ID NO: 1738 - RNA, 18 nt, Artificial Sequence
  Description of Artificial Sequence: Synthetic oligonucleotide
agccgugaaguuggagaa

SEQ ID NO: 1739 - RNA, 18 nt, Artificial Sequence
  Description of Artificial Sequence: Synthetic oligonucleotide
gggacagccgugaaguug

SEQ ID NO: 1740 - RNA, 18 nt, Artificial Sequence
  Description of Artificial Sequence: Synthetic oligonucleotide
ucuucgggacagccguga

SEQ ID NO: 1741 - RNA, 18 nt, Artificial Sequence
  Description of Artificial Sequence: Synthetic oligonucleotide
gagugcuuccacugcgug

SEQ ID NO: 1742 - RNA, 18 nt, Artificial Sequence
  Description of Artificial Sequence: Synthetic oligonucleotide
uuccagagugcuuccacu

SEQ ID NO: 1743 - RNA, 18 nt, Artificial Sequence
  Description of Artificial Sequence: Synthetic oligonucleotide
ccgccuuccagagugcuu

SEQ ID NO: 1744 - RNA, 18 nt, Artificial Sequence
  Description of Artificial Sequence: Synthetic oligonucleotide
cgcgaccgccuuccagag

SEQ ID NO: 1745 - RNA, 18 nt, Artificial Sequence
  Description of Artificial Sequence: Synthetic oligonucleotide
agauccgcgaccgccuuc

SEQ ID NO: 1746 - RNA, 18 nt, Artificial Sequence
  Description of Artificial Sequence: Synthetic oligonucleotide
gcaacagauccgcgaccg

SEQ ID NO: 1747 - RNA, 18 nt, Artificial Sequence
  Description of Artificial Sequence: Synthetic oligonucleotide
cggcugcaacagauccgc

SEQ ID NO: 1748 - RNA, 18 nt, Artificial Sequence
  Description of Artificial Sequence: Synthetic oligonucleotide
cgcuccggcugcaacaga

SEQ ID NO: 1749 - RNA, 18 nt, Artificial Sequence
  Description of Artificial Sequence: Synthetic oligonucleotide
gcggccgcuccggcugca

SEQ ID NO: 1750 - RNA, 18 nt, Artificial Sequence
  Description of Artificial Sequence: Synthetic oligonucleotide
cuccagcggccgcuccgg

SEQ ID NO: 1751 - RNA, 18 nt, Artificial Sequence
  Description of Artificial Sequence: Synthetic oligonucleotide
cgggccuccagcggccgc

SEQ ID NO: 1752 - RNA, 18 nt, Artificial Sequence
  Description of Artificial Sequence: Synthetic oligonucleotide
cgugccgggccuccagcg

SEQ ID NO: 1753 - RNA, 18 nt, Artificial Sequence
  Description of Artificial Sequence: Synthetic oligonucleotide
caccgcgugccgggccuc

SEQ ID NO: 1754 - RNA, 18 nt, Artificial Sequence
  Description of Artificial Sequence: Synthetic oligonucleotide
gccagcaccgcgugccgg

SEQ ID NO: 1755 - RNA, 18 nt, Artificial Sequence
  Description of Artificial Sequence: Synthetic oligonucleotide
gcagagccagcaccgcgu

SEQ ID NO: 1756 - RNA, 18 nt, Artificial Sequence
  Description of Artificial Sequence: Synthetic oligonucleotide
cuucagcagagccagcac

SEQ ID NO: 1757 - RNA, 18 nt, Artificial Sequence
  Description of Artificial Sequence: Synthetic oligonucleotide
auggccuucagcagagcc

SEQ ID NO: 1758 - RNA, 18 nt, Artificial Sequence
  Description of Artificial Sequence: Synthetic oligonucleotide
gcacgauggccuucagca

SEQ ID NO: 1759 - RNA, 18 nt, Artificial Sequence
  Description of Artificial Sequence: Synthetic oligonucleotide
ccccugcacgauggccuu

SEQ ID NO: 1760 - RNA, 18 nt, Artificial Sequence
  Description of Artificial Sequence: Synthetic oligonucleotide
cccagcgucgcccugggc

SEQ ID NO: 1761 - RNA, 18 nt, Artificial Sequence
  Description of Artificial Sequence: Synthetic oligonucleotide
cccaucccagcgucgccc

SEQ ID NO: 1762 - RNA, 18 nt, Artificial Sequence
  Description of Artificial Sequence: Synthetic oligonucleotide
cgucacccaucccagcgu

SEQ ID NO: 1763 - RNA, 18 nt, Artificial Sequence
  Description of Artificial Sequence: Synthetic oligonucleotide
ccugacgucacccauccc

SEQ ID NO: 1764 - RNA, 18 nt, Artificial Sequence
  Description of Artificial Sequence: Synthetic oligonucleotide
ggcagccugacgucaccc

SEQ ID NO: 1765 - RNA, 18 nt, Artificial Sequence
  Description of Artificial Sequence: Synthetic oligonucleotide
cagugggcagccugacgu

SEQ ID NO: 1766 - RNA, 18 nt, Artificial Sequence
  Description of Artificial Sequence: Synthetic oligonucleotide
acagucagugggcagccu

SEQ ID NO: 1767 - RNA, 18 nt, Artificial Sequence
  Description of Artificial Sequence: Synthetic oligonucleotide
acaggacagucagugggc

SEQ ID NO: 1768 - RNA, 18 nt, Artificial Sequence
  Description of Artificial Sequence: Synthetic oligonucleotide
cagggacaggacagucag

SEQ ID NO: 1769 - RNA, 18 nt, Artificial Sequence
  Description of Artificial Sequence: Synthetic oligonucleotide
cccagcagggacaggaca

SEQ ID NO: 1770 - RNA, 18 nt, Artificial Sequence
  Description of Artificial Sequence: Synthetic oligonucleotide
cacggcccagcagggaca

SEQ ID NO: 1771 - RNA, 18 nt, Artificial Sequence
  Description of Artificial Sequence: Synthetic oligonucleotide
ccaaacacggcccagcag

SEQ ID NO: 1772 - RNA, 18 nt, Artificial Sequence
  Description of Artificial Sequence: Synthetic oligonucleotide
ggaguccaaacacggccc

SEQ ID NO: 1773 - RNA, 18 nt, Artificial Sequence
  Description of Artificial Sequence: Synthetic oligonucleotide
aggcaggaguccaaacac

SEQ ID NO: 1774 - RNA, 18 nt, Artificial Sequence
  Description of Artificial Sequence: Synthetic oligonucleotide
caccgaggcaggagucca

SEQ ID NO: 1775 - RNA, 18 nt, Artificial Sequence
  Description of Artificial Sequence: Synthetic oligonucleotide
caacucaccgaggcagga

SEQ ID NO: 1776 - RNA, 18 nt, Artificial Sequence
  Description of Artificial Sequence: Synthetic oligonucleotide
cccagcaacucaccgagg

SEQ ID NO: 1777 - RNA, 18 nt, Artificial Sequence
  Description of Artificial Sequence: Synthetic oligonucleotide
cugugcccagcaacucac

SEQ ID NO: 1778 - RNA, 18 nt, Artificial Sequence
  Description of Artificial Sequence: Synthetic oligonucleotide
agacccugugcccagcaa

SEQ ID NO: 1779 - RNA, 18 nt, Artificial Sequence
  Description of Artificial Sequence: Synthetic oligonucleotide
ccccuagacccugugccc

SEQ ID NO: 1780 - RNA, 18 nt, Artificial Sequence
  Description of Artificial Sequence: Synthetic oligonucleotide
aucagccccuagacccug

SEQ ID NO: 1781 - RNA, 18 nt, Artificial Sequence
  Description of Artificial Sequence: Synthetic oligonucleotide
agcccaucagccccuaga

SEQ ID NO: 1782 - RNA, 18 nt, Artificial Sequence
  Description of Artificial Sequence: Synthetic oligonucleotide
uccagagcccaucagccc

SEQ ID NO: 1783 - RNA, 18 nt, Artificial Sequence
  Description of Artificial Sequence: Synthetic oligonucleotide
ccagcuccagagcccauc

SEQ ID NO: 1784 - RNA, 18 nt, Artificial Sequence
  Description of Artificial Sequence: Synthetic oligonucleotide
gccauccagcuccagagc

SEQ ID NO: 1785 - RNA, 18 nt, Artificial Sequence
  Description of Artificial Sequence: Synthetic oligonucleotide
cacaggccauccagcucc

SEQ ID NO: 1786 - RNA, 18 nt, Artificial Sequence
  Description of Artificial Sequence: Synthetic oligonucleotide
gaccccacaggccaucca

SEQ ID NO: 1787 - RNA, 18 nt, Artificial Sequence
  Description of Artificial Sequence: Synthetic oligonucleotide
caggagaccccacaggcc

SEQ ID NO: 1788 - RNA, 18 nt, Artificial Sequence
  Description of Artificial Sequence: Synthetic oligonucleotide
gacaccaggagaccccac

SEQ ID NO: 1789 - RNA, 18 nt, Artificial Sequence
  Description of Artificial Sequence: Synthetic oligonucleotide
cucaugacaccaggagac

SEQ ID NO: 1790 - RNA, 18 nt, Artificial Sequence
  Description of Artificial Sequence: Synthetic oligonucleotide
cagaccucaugacaccag

SEQ ID NO: 1791 - RNA, 18 nt, Artificial Sequence
  Description of Artificial Sequence: Synthetic oligonucleotide
ucacacagaccucaugac

SEQ ID NO: 1792 - RNA, 18 nt, Artificial Sequence
  Description of Artificial Sequence: Synthetic oligonucleotide
uacggucacacagaccuc

SEQ ID NO: 1793 - RNA, 18 nt, Artificial Sequence
  Description of Artificial Sequence: Synthetic oligonucleotide
gugccuacggucacacag

SEQ ID NO: 1794 - RNA, 18 nt, Artificial Sequence
  Description of Artificial Sequence: Synthetic oligonucleotide
aggcagugccuacgguca

SEQ ID NO: 1795 - RNA, 18 nt, Artificial Sequence
  Description of Artificial Sequence: Synthetic oligonucleotide
cgaggaggcagugccuac

SEQ ID NO: 1796 - RNA, 18 nt, Artificial Sequence
  Description of Artificial Sequence: Synthetic oligonucleotide
acaggcgaggaggcagug

SEQ ID NO: 1797 - RNA, 18 nt, Artificial Sequence
  Description of Artificial Sequence: Synthetic oligonucleotide
uguuuacaggcgaggagg

SEQ ID NO: 1798 - RNA, 18 nt, Artificial Sequence
  Description of Artificial Sequence: Synthetic oligonucleotide
ccaucuguuuacaggcga

SEQ ID NO: 1799 - RNA, 18 nt, Artificial Sequence
  Description of Artificial Sequence: Synthetic oligonucleotide
agugaccaucuguuuaca

SEQ ID NO: 1800 - RNA, 18 nt, Artificial Sequence
  Description of Artificial Sequence: Synthetic oligonucleotide
ggugcagugaccaucugu

SEQ ID NO: 1801 - RNA, 18 nt, Artificial Sequence
  Description of Artificial Sequence: Synthetic oligonucleotide
aggaaggugcagugacca

SEQ ID NO: 1802 - RNA, 18 nt, Artificial Sequence
  Description of Artificial Sequence: Synthetic oligonucleotide
auaagaggaaggugcagu

SEQ ID NO: 1803 - RNA, 18 nt, Artificial Sequence
  Description of Artificial Sequence: Synthetic oligonucleotide
aucccauaagaggaaggu

SEQ ID NO: 1804 - RNA, 18 nt, Artificial Sequence
  Description of Artificial Sequence: Synthetic oligonucleotide
agaacaucccauaagagg

SEQ ID NO: 1805 - RNA, 18 nt, Artificial Sequence
  Description of Artificial Sequence: Synthetic oligonucleotide
uccccagaacaucccaua

SEQ ID NO: 1806 - RNA, 18 nt, Artificial Sequence
  Description of Artificial Sequence: Synthetic oligonucleotide
uaugauccccagaacauc

SEQ ID NO: 1807 - RNA, 18 nt, Artificial Sequence
  Description of Artificial Sequence: Synthetic oligonucleotide
ccucauaugauccccaga

SEQ ID NO: 1808 - RNA, 18 nt, Artificial Sequence
  Description of Artificial Sequence: Synthetic oligonucleotide
aacugccucauaugaucc

SEQ ID NO: 1809 - RNA, 18 nt, Artificial Sequence
  Description of Artificial Sequence: Synthetic oligonucleotide
gcgagaacugccucauau

SEQ ID NO: 1810 - RNA, 18 nt, Artificial Sequence
  Description of Artificial Sequence: Synthetic oligonucleotide
acucugcgagaacugccu

SEQ ID NO: 1811 - RNA, 18 nt, Artificial Sequence
  Description of Artificial Sequence: Synthetic oligonucleotide
ucagcacucugcgagaac

SEQ ID NO: 1812 - RNA, 18 nt, Artificial Sequence
  Description of Artificial Sequence: Synthetic oligonucleotide
cgaucucagcacucugcg

SEQ ID NO: 1813 - RNA, 18 nt, Artificial Sequence
  Description of Artificial Sequence: Synthetic oligonucleotide
agguacgaucucagcacu

SEQ ID NO: 1814 - RNA, 18 nt, Artificial Sequence
  Description of Artificial Sequence: Synthetic oligonucleotide
cugccagguacgaucuca

SEQ ID NO: 1815 - RNA, 18 nt, Artificial Sequence
  Description of Artificial Sequence: Synthetic oligonucleotide
accagcugccagguacga

SEQ ID NO: 1816 - RNA, 18 nt, Artificial Sequence
  Description of Artificial Sequence: Synthetic oligonucleotide
cccacaccagcugccagg

SEQ ID NO: 1817 - RNA, 18 nt, Artificial Sequence
  Description of Artificial Sequence: Synthetic oligonucleotide
guagccccacaccagcug

SEQ ID NO: 1818 - RNA, 18 nt, Artificial Sequence
  Description of Artificial Sequence: Synthetic oligonucleotide
acaccguagccccacacc

SEQ ID NO: 1819 - RNA, 18 nt, Artificial Sequence
  Description of Artificial Sequence: Synthetic oligonucleotide
aaacaacaccguagcccc

SEQ ID NO: 1820 - RNA, 18 nt, Artificial Sequence
  Description of Artificial Sequence: Synthetic oligonucleotide
gggcaaaacaacaccgua

SEQ ID NO: 1821 - RNA, 18 nt, Artificial Sequence
  Description of Artificial Sequence: Synthetic oligonucleotide
ugcaagggcaaaacaaca

SEQ ID NO: 1822 - RNA, 18 nt, Artificial Sequence
  Description of Artificial Sequence: Synthetic oligonucleotide
aagggugcaagggcaaaa

SEQ ID NO: 1823 - RNA, 18 nt, Artificial Sequence
  Description of Artificial Sequence: Synthetic oligonucleotide
cccgaaagggugcaaggg

SEQ ID NO: 1824 - RNA, 18 nt, Artificial Sequence
  Description of Artificial Sequence: Synthetic oligonucleotide
guggccccgaaagggugc

SEQ ID NO: 1825 - RNA, 18 nt, Artificial Sequence
  Description of Artificial Sequence: Synthetic oligonucleotide
gggaguggccccgaaagg

SEQ ID NO: 1826 - RNA, 18 nt, Artificial Sequence
  Description of Artificial Sequence: Synthetic oligonucleotide
ggaaugcagugagcaggg

SEQ ID NO: 1827 - RNA, 18 nt, Artificial Sequence
  Description of Artificial Sequence: Synthetic oligonucleotide
cagauggaaugcagugag

SEQ ID NO: 1828 - RNA, 18 nt, Artificial Sequence
  Description of Artificial Sequence: Synthetic oligonucleotide
cagcacagauggaaugca

SEQ ID NO: 1829 - RNA, 18 nt, Artificial Sequence
  Description of Artificial Sequence: Synthetic oligonucleotide
aagaccagcacagaugga

SEQ ID NO: 1830 - RNA, 18 nt, Artificial Sequence
  Description of Artificial Sequence: Synthetic oligonucleotide
cagccaagaccagcacag

SEQ ID NO: 1831 - RNA, 18 nt, Artificial Sequence
  Description of Artificial Sequence: Synthetic oligonucleotide
agggucagccaagaccag

SEQ ID NO: 1832 - RNA, 18 nt, Artificial Sequence
  Description of Artificial Sequence: Synthetic oligonucleotide
uguucagggucagccaag

SEQ ID NO: 1833 - RNA, 18 nt, Artificial Sequence
  Description of Artificial Sequence: Synthetic oligonucleotide
cuggguguucagggucag

SEQ ID NO: 1834 - RNA, 18 nt, Artificial Sequence
  Description of Artificial Sequence: Synthetic oligonucleotide
gaggccuggguguucagg

SEQ ID NO: 1835 - RNA, 18 nt, Artificial Sequence
  Description of Artificial Sequence: Synthetic oligonucleotide
accaagaggccugggugu

SEQ ID NO: 1836 - RNA, 18 nt, Artificial Sequence
  Description of Artificial Sequence: Synthetic oligonucleotide
ggaacaccaagaggccug

SEQ ID NO: 1837 - RNA, 18 nt, Artificial Sequence
  Description of Artificial Sequence: Synthetic oligonucleotide
aggcaggaacaccaagag

SEQ ID NO: 1838 - RNA, 18 nt, Artificial Sequence
  Description of Artificial Sequence: Synthetic oligonucleotide
gggaggcaggaacaccaa

SEQ ID NO: 1839 - RNA, 18 nt, Artificial Sequence
  Description of Artificial Sequence: Synthetic oligonucleotide
agaaguggccgaccaggg

SEQ ID NO: 1840 - RNA, 18 nt, Artificial Sequence
  Description of Artificial Sequence: Synthetic oligonucleotide
ggaguagaaguggccgac

SEQ ID NO: 1841 - RNA, 18 nt, Artificial Sequence
  Description of Artificial Sequence: Synthetic oligonucleotide
augaaggaguagaagugg

SEQ ID NO: 1842 - RNA, 18 nt, Artificial Sequence
  Description of Artificial Sequence: Synthetic oligonucleotide
gggacaugaaggaguaga

SEQ ID NO: 1843 - RNA, 18 nt, Artificial Sequence
  Description of Artificial Sequence: Synthetic oligonucleotide
gaacaccaagaggccugg

SEQ ID NO: 1844 - RNA, 18 nt, Artificial Sequence
  Description of Artificial Sequence: Synthetic oligonucleotide
ggcaggaacaccaagagg

SEQ ID NO: 1845 - RNA, 18 nt, Artificial Sequence
  Description of Artificial Sequence: Synthetic oligonucleotide
agaaguggccgaccaggg

SEQ ID NO: 1846 - RNA, 18 nt, Artificial Sequence
  Description of Artificial Sequence: Synthetic oligonucleotide
ggaguagaaguggccgac

SEQ ID NO: 1847 - RNA, 18 nt, Artificial Sequence
  Description of Artificial Sequence: Synthetic oligonucleotide
augaaggaguagaagugg

SEQ ID NO: 1848 - RNA, 18 nt, Artificial Sequence
  Description of Artificial Sequence: Synthetic oligonucleotide
gggacaugaaggaguaga

SEQ ID NO: 1849 - RNA, 18 nt, Artificial Sequence
  Description of Artificial Sequence: Synthetic oligonucleotide
cagcugggacaugaagga

SEQ ID NO: 1850 - RNA, 18 nt, Artificial Sequence
  Description of Artificial Sequence: Synthetic oligonucleotide
cugagcagcugggacaug

SEQ ID NO: 1851 - RNA, 18 nt, Artificial Sequence
  Description of Artificial Sequence: Synthetic oligonucleotide
cccuucugagcagcuggg

SEQ ID NO: 1852 - RNA, 18 nt, Artificial Sequence
  Description of Artificial Sequence: Synthetic oligonucleotide
gacggcccuucugagcag

SEQ ID NO: 1853 - RNA, 18 nt, Artificial Sequence
  Description of Artificial Sequence: Synthetic oligonucleotide
gaguggacggcccuucug

SEQ ID NO: 1854 - RNA, 18 nt, Artificial Sequence
  Description of Artificial Sequence: Synthetic oligonucleotide
ugugagaguggacggccc

SEQ ID NO: 1855 - RNA, 18 nt, Artificial Sequence
  Description of Artificial Sequence: Synthetic oligonucleotide
gagccugugagaguggac

SEQ ID NO: 1856 - RNA, 18 nt, Artificial Sequence
  Description of Artificial Sequence: Synthetic oligonucleotide
caggagagccugugagag

SEQ ID NO: 1857 - RNA, 18 nt, Artificial Sequence
  Description of Artificial Sequence: Synthetic oligonucleotide
aaacccaggagagccugu

SEQ ID NO: 1858 - RNA, 18 nt, Artificial Sequence
  Description of Artificial Sequence: Synthetic oligonucleotide
ggacaaggccugaguggg

SEQ ID NO: 1859 - RNA, 18 nt, Artificial Sequence
  Description of Artificial Sequence: Synthetic oligonucleotide
acugaggacaaggccuga

SEQ ID NO: 1860 - RNA, 18 nt, Artificial Sequence
  Description of Artificial Sequence: Synthetic oligonucleotide
cagagacugaggacaagg

SEQ ID NO: 1861 - RNA, 18 nt, Artificial Sequence
  Description of Artificial Sequence: Synthetic oligonucleotide
gugcucagagacugagga

SEQ ID NO: 1862 - RNA, 18 nt, Artificial Sequence
  Description of Artificial Sequence: Synthetic oligonucleotide
gccuugugcucagagacu

SEQ ID NO: 1863 - RNA, 18 nt, Artificial Sequence
  Description of Artificial Sequence: Synthetic oligonucleotide
agacagccuugugcucag

SEQ ID NO: 1864 - RNA, 18 nt, Artificial Sequence
  Description of Artificial Sequence: Synthetic oligonucleotide
agggcagacagccuugug

SEQ ID NO: 1865 - RNA, 18 nt, Artificial Sequence
  Description of Artificial Sequence: Synthetic oligonucleotide
ggugcagggcagacagcc

SEQ ID NO: 1866 - RNA, 18 nt, Artificial Sequence
  Description of Artificial Sequence: Synthetic oligonucleotide
cacucggugcagggcaga

SEQ ID NO: 1867 - RNA, 18 nt, Artificial Sequence
  Description of Artificial Sequence: Synthetic oligonucleotide
cccugcacucggugcagg

SEQ ID NO: 1868 - RNA, 18 nt, Artificial Sequence
  Description of Artificial Sequence: Synthetic oligonucleotide
ccgaccccugcacucggu

SEQ ID NO: 1869 - RNA, 18 nt, Artificial Sequence
  Description of Artificial Sequence: Synthetic oligonucleotide
ccugcccgaccccugcac

SEQ ID NO: 1870 - RNA, 18 nt, Artificial Sequence
  Description of Artificial Sequence: Synthetic oligonucleotide
cagcuccugcccgacccc

SEQ ID NO: 1871 - RNA, 18 nt, Artificial Sequence
  Description of Artificial Sequence: Synthetic oligonucleotide
ugacacagcuccugcccg

SEQ ID NO: 1872 - RNA, 18 nt, Artificial Sequence
  Description of Artificial Sequence: Synthetic oligonucleotide
ggguggcgcagagcaggg

SEQ ID NO: 1873 - RNA, 18 nt, Artificial Sequence
  Description of Artificial Sequence: Synthetic oligonucleotide
acagcggguggcgcagag

SEQ ID NO: 1874 - RNA, 18 nt, Artificial Sequence
  Description of Artificial Sequence: Synthetic oligonucleotide
cuggcacagcggguggcg

SEQ ID NO: 1875 - RNA, 18 nt, Artificial Sequence
  Description of Artificial Sequence: Synthetic oligonucleotide
gggaccuggcacagcggg

SEQ ID NO: 1876 - RNA, 18 nt, Artificial Sequence
  Description of Artificial Sequence: Synthetic oligonucleotide
gugucgggaccuggcaca

SEQ ID NO: 1877 - RNA, 18 nt, Artificial Sequence
  Description of Artificial Sequence: Synthetic oligonucleotide
gcugugugucgggaccug

SEQ ID NO: 1878 - RNA, 18 nt, Artificial Sequence
  Description of Artificial Sequence: Synthetic oligonucleotide
caacugcugugugucggg

SEQ ID NO: 1879 - RNA, 18 nt, Artificial Sequence
  Description of Artificial Sequence: Synthetic oligonucleotide
gggagcaacugcugugug

SEQ ID NO: 1880 - RNA, 18 nt, Artificial Sequence
  Description of Artificial Sequence: Synthetic oligonucleotide
cgcagagcggcguauggg

SEQ ID NO: 1881 - RNA, 18 nt, Artificial Sequence
  Description of Artificial Sequence: Synthetic oligonucleotide
gaccgcagagcggcguau

SEQ ID NO: 1882 - RNA, 18 nt, Artificial Sequence
  Description of Artificial Sequence: Synthetic oligonucleotide
cggccgaccgcagagcgg

SEQ ID NO: 1883 - RNA, 18 nt, Artificial Sequence
  Description of Artificial Sequence: Synthetic oligonucleotide
ugcaccggccgaccgcag

SEQ ID NO: 1884 - RNA, 18 nt, Artificial Sequence
  Description of Artificial Sequence: Synthetic oligonucleotide
ccggaugcaccggccgac

SEQ ID NO: 1885 - RNA, 18 nt, Artificial Sequence
  Description of Artificial Sequence: Synthetic oligonucleotide
gcauuguacagggcaggg

SEQ ID NO: 1886 - RNA, 18 nt, Artificial Sequence
  Description of Artificial Sequence: Synthetic oligonucleotide
caucagcauuguacaggg

SEQ ID NO: 1887 - RNA, 18 nt, Artificial Sequence
  Description of Artificial Sequence: Synthetic oligonucleotide
ugcagcaucagcauugua

SEQ ID NO: 1888 - RNA, 18 nt, Artificial Sequence
  Description of Artificial Sequence: Synthetic oligonucleotide
aggucugcagcaucagca

SEQ ID NO: 1889 - RNA, 18 nt, Artificial Sequence
  Description of Artificial Sequence: Synthetic oligonucleotide
gagacaggucugcagcau

SEQ ID NO: 1890 - RNA, 18 nt, Artificial Sequence
  Description of Artificial Sequence: Synthetic oligonucleotide
ugcaagagacaggucugc

SEQ ID NO: 1891 - RNA, 18 nt, Artificial Sequence
  Description of Artificial Sequence: Synthetic oligonucleotide
cgcccugcaagagacagg

SEQ ID NO: 1892 - RNA, 18 nt, Artificial Sequence
  Description of Artificial Sequence: Synthetic oligonucleotide
agaggcgcccugcaagag

SEQ ID NO: 1893 - RNA, 18 nt, Artificial Sequence
  Description of Artificial Sequence: Synthetic oligonucleotide
cccacagaggcgcccugc

SEQ ID NO: 1894 - RNA, 18 nt, Artificial Sequence
  Description of Artificial Sequence: Synthetic oligonucleotide
uccuucccacagaggcgc

SEQ ID NO: 1895 - RNA, 18 nt, Artificial Sequence
  Description of Artificial Sequence: Synthetic oligonucleotide
cccucuccuucccacaga

SEQ ID NO: 1896 - RNA, 18 nt, Artificial Sequence
  Description of Artificial Sequence: Synthetic oligonucleotide
uggaccccucuccuuccc

SEQ ID NO: 1897 - RNA, 18 nt, Artificial Sequence
  Description of Artificial Sequence: Synthetic oligonucleotide
agcccuggaccccucucc

SEQ ID NO: 1898 - RNA, 18 nt, Artificial Sequence
  Description of Artificial Sequence: Synthetic oligonucleotide
acuccagcccuggacccc

SEQ ID NO: 1899 - RNA, 18 nt, Artificial Sequence
  Description of Artificial Sequence: Synthetic oligonucleotide
cccggacuccagcccugg

SEQ ID NO: 1900 - RNA, 18 nt, Artificial Sequence
  Description of Artificial Sequence: Synthetic oligonucleotide
gggcacccggacuccagc

SEQ ID NO: 1901 - RNA, 18 nt, Artificial Sequence
  Description of Artificial Sequence: Synthetic oligonucleotide
agucccugaagugcaggg

SEQ ID NO: 1902 - RNA, 18 nt, Artificial Sequence
  Description of Artificial Sequence: Synthetic oligonucleotide
aagucccugaagugcagg

SEQ ID NO: 1903 - RNA, 18 nt, Artificial Sequence
  Description of Artificial Sequence: Synthetic oligonucleotide
ccaagaagucccugaagu

SEQ ID NO: 1904 - RNA, 18 nt, Artificial Sequence
  Description of Artificial Sequence: Synthetic oligonucleotide
ggcugccaagaagucccu

SEQ ID NO: 1905 - RNA, 18 nt, Artificial Sequence
  Description of Artificial Sequence: Synthetic oligonucleotide
cacacggcugccaagaag

SEQ ID NO: 1906 - RNA, 18 nt, Artificial Sequence
  Description of Artificial Sequence: Synthetic oligonucleotide
ucgcccacacggcugcca

SEQ ID NO: 1907 - RNA, 18 nt, Artificial Sequence
  Description of Artificial Sequence: Synthetic oligonucleotide
cagcgucgcccacacggc

SEQ ID NO: 1908 - RNA, 18 nt, Artificial Sequence
  Description of Artificial Sequence: Synthetic oligonucleotide
ccugccagcgucgcccac

SEQ ID NO: 1909 - RNA, 18 nt, Artificial Sequence
  Description of Artificial Sequence: Synthetic oligonucleotide
cagagccugccagcgucg

SEQ ID NO: 1910 - RNA, 18 nt, Artificial Sequence
  Description of Artificial Sequence: Synthetic oligonucleotide
aucagcagagccugccag

SEQ ID NO: 1911 - RNA, 18 nt, Artificial Sequence
  Description of Artificial Sequence: Synthetic oligonucleotide
acaggaucagcagagccu

SEQ ID NO: 1912 - RNA, 18 nt, Artificial Sequence
  Description of Artificial Sequence: Synthetic oligonucleotide
ggacccccaaacgcucgc

SEQ ID NO: 1913 - RNA, 18 nt, Artificial Sequence
  Description of Artificial Sequence: Synthetic oligonucleotide
ucugaggacccccaaacg

SEQ ID NO: 1914 - RNA, 18 nt, Artificial Sequence
  Description of Artificial Sequence: Synthetic oligonucleotide
agggcucugaggaccccc

SEQ ID NO: 1915 - RNA, 18 nt, Artificial Sequence
  Description of Artificial Sequence: Synthetic oligonucleotide
agaagagggcucugagga

SEQ ID NO: 1916 - RNA, 18 nt, Artificial Sequence
  Description of Artificial Sequence: Synthetic oligonucleotide
cuuaaagaagagggcucu

SEQ ID NO: 1917 - RNA, 18 nt, Artificial Sequence
  Description of Artificial Sequence: Synthetic oligonucleotide
augaccuuaaagaagagg

SEQ ID NO: 1918 - RNA, 18 nt, Artificial Sequence
  Description of Artificial Sequence: Synthetic oligonucleotide
ccuugaugaccuuaaaga

SEQ ID NO: 1919 - RNA, 18 nt, Artificial Sequence
  Description of Artificial Sequence: Synthetic oligonucleotide
guaauccuugaugaccuu

SEQ ID NO: 1920 - RNA, 18 nt, Artificial Sequence
  Description of Artificial Sequence: Synthetic oligonucleotide
gaaggguaauccuugaug

SEQ ID NO: 1921 - RNA, 18 nt, Artificial Sequence
  Description of Artificial Sequence: Synthetic oligonucleotide
cguuggaaggguaauccu

SEQ ID NO: 1922 - RNA, 18 nt, Artificial Sequence
  Description of Artificial Sequence: Synthetic oligonucleotide
gucuucguuggaagggua

SEQ ID NO: 1923 - RNA, 18 nt, Artificial Sequence
  Description of Artificial Sequence: Synthetic oligonucleotide
ugaaggucuucguuggaa

SEQ ID NO: 1924 - RNA, 18 nt, Artificial Sequence
  Description of Artificial Sequence: Synthetic oligonucleotide
uuucgugaaggucuucgu

SEQ ID NO: 1925 - RNA, 18 nt, Artificial Sequence
  Description of Artificial Sequence: Synthetic oligonucleotide
cagccuuucgugaagguc

SEQ ID NO: 1926 - RNA, 18 nt, Artificial Sequence
  Description of Artificial Sequence: Synthetic oligonucleotide
accuccagccuuucguga

SEQ ID NO: 1927 - RNA, 18 nt, Artificial Sequence
  Description of Artificial Sequence: Synthetic oligonucleotide
ugaaaaccuccagccuuu

SEQ ID NO: 1928 - RNA, 18 nt, Artificial Sequence
  Description of Artificial Sequence: Synthetic oligonucleotide
ggccuugaaaaccuccag

SEQ ID NO: 1929 - RNA, 18 nt, Artificial Sequence
  Description of Artificial Sequence: Synthetic oligonucleotide
gugagggccuugaaaacc

SEQ ID NO: 1930 - RNA, 18 nt, Artificial Sequence
  Description of Artificial Sequence: Synthetic oligonucleotide
ugucugugagggccuuga

SEQ ID NO: 1931 - RNA, 18 nt, Artificial Sequence
  Description of Artificial Sequence: Synthetic oligonucleotide
cccauugucugugagggc

SEQ ID NO: 1932 - RNA, 18 nt, Artificial Sequence
  Description of Artificial Sequence: Synthetic oligonucleotide
ugucucccauugucugug

SEQ ID NO: 1933 - RNA, 18 nt, Artificial Sequence
  Description of Artificial Sequence: Synthetic oligonucleotide
ugaugugucucccauugu

SEQ ID NO: 1934 - RNA, 18 nt, Artificial Sequence
  Description of Artificial Sequence: Synthetic oligonucleotide
guaggugaugugucuccc

SEQ ID NO: 1935 - RNA, 18 nt, Artificial Sequence
  Description of Artificial Sequence: Synthetic oligonucleotide
uccaaguaggugaugugu

SEQ ID NO: 1936 - RNA, 18 nt, Artificial Sequence
  Description of Artificial Sequence: Synthetic oligonucleotide
cuuccuccaaguagguga

SEQ ID NO: 1937 - RNA, 18 nt, Artificial Sequence
  Description of Artificial Sequence: Synthetic oligonucleotide
cagcucuuccuccaagua

SEQ ID NO: 1938 - RNA, 18 nt, Artificial Sequence
  Description of Artificial Sequence: Synthetic oligonucleotide
ucaucagccagcuggugu

SEQ ID NO: 1939 - RNA, 18 nt, Artificial Sequence
  Description of Artificial Sequence: Synthetic oligonucleotide
caggcucaucagccagcu

SEQ ID NO: 1940 - RNA, 18 nt, Artificial Sequence
  Description of Artificial Sequence: Synthetic oligonucleotide
uucuccaggcucaucagc

SEQ ID NO: 1941 - RNA, 18 nt, Artificial Sequence
  Description of Artificial Sequence: Synthetic oligonucleotide
gcggguucuccaggcuca

SEQ ID NO: 1942 - RNA, 18 nt, Artificial Sequence
  Description of Artificial Sequence: Synthetic oligonucleotide
gcugagcggguucuccag

SEQ ID NO: 1943 - RNA, 18 nt, Artificial Sequence
  Description of Artificial Sequence: Synthetic oligonucleotide
aaagggcugagcggguuc

SEQ ID NO: 1944 - RNA, 18 nt, Artificial Sequence
  Description of Artificial Sequence: Synthetic oligonucleotide
aggagaaagggcugagcg

SEQ ID NO: 1945 - RNA, 18 nt, Artificial Sequence
  Description of Artificial Sequence: Synthetic oligonucleotide
guccgaggagaaagggcu

SEQ ID NO: 1946 - RNA, 18 nt, Artificial Sequence
  Description of Artificial Sequence: Synthetic oligonucleotide
uugauguccgaggagaaa

SEQ ID NO: 1947 - RNA, 18 nt, Artificial Sequence
  Description of Artificial Sequence: Synthetic oligonucleotide
uguuguugauguccgagg

SEQ ID NO: 1948 - RNA, 18 nt, Artificial Sequence
  Description of Artificial Sequence: Synthetic oligonucleotide
gggcauguuguugauguc

SEQ ID NO: 1949 - RNA, 18 nt, Artificial Sequence
  Description of Artificial Sequence: Synthetic oligonucleotide
uagacagcuccugcaggg

SEQ ID NO: 1950 - RNA, 18 nt, Artificial Sequence
  Description of Artificial Sequence: Synthetic oligonucleotide
gcguuagacagcuccugc

SEQ ID NO: 1951 - RNA, 18 nt, Artificial Sequence
  Description of Artificial Sequence: Synthetic oligonucleotide
ugagggcguuagacagcu

SEQ ID NO: 1952 - RNA, 18 nt, Artificial Sequence
  Description of Artificial Sequence: Synthetic oligonucleotide
cgccaugagggcguuaga

SEQ ID NO: 1953 - RNA, 18 nt, Artificial Sequence
  Description of Artificial Sequence: Synthetic oligonucleotide
ucagccgccaugagggcg

SEQ ID NO: 1954 - RNA, 18 nt, Artificial Sequence
  Description of Artificial Sequence: Synthetic oligonucleotide
agcgcucagccgccauga

SEQ ID NO: 1955 - RNA, 18 nt, Artificial Sequence
  Description of Artificial Sequence: Synthetic oligonucleotide
cuugaagcgcucagccgc

SEQ ID NO: 1956 - RNA, 18 nt, Artificial Sequence
  Description of Artificial Sequence: Synthetic oligonucleotide
ugcuccuugaagcgcuca

SEQ ID NO: 1957 - RNA, 18 nt, Artificial Sequence
  Description of Artificial Sequence: Synthetic oligonucleotide
cccggugcuccuugaagc

SEQ ID NO: 1958 - RNA, 18 nt, Artificial Sequence
  Description of Artificial Sequence: Synthetic oligonucleotide
ugugucccggugcuccuu

SEQ ID NO: 1959 - RNA, 18 nt, Artificial Sequence
  Description of Artificial Sequence: Synthetic oligonucleotide
agggcugugucccggugc

SEQ ID NO: 1960 - RNA, 18 nt, Artificial Sequence
  Description of Artificial Sequence: Synthetic oligonucleotide
uguacagggcuguguccc

SEQ ID NO: 1961 - RNA, 18 nt, Artificial Sequence
  Description of Artificial Sequence: Synthetic oligonucleotide
ugacuuguacagggcugu

SEQ ID NO: 1962 - RNA, 18 nt, Artificial Sequence
  Description of Artificial Sequence: Synthetic oligonucleotide
gacagugacuuguacagg

SEQ ID NO: 1963 - RNA, 18 nt, Artificial Sequence
  Description of Artificial Sequence: Synthetic oligonucleotide
gcaccgacagugacuugu

SEQ ID NO: 1964 - RNA, 18 nt, Artificial Sequence
  Description of Artificial Sequence: Synthetic oligonucleotide
ugccggcaccgacaguga

SEQ ID NO: 1965 - RNA, 18 nt, Artificial Sequence
  Description of Artificial Sequence: Synthetic oligonucleotide
cuggcugccggcaccgac

SEQ ID NO: 1966 - RNA, 18 nt, Artificial Sequence
  Description of Artificial Sequence: Synthetic oligonucleotide
ccgugcuggcugccggca

SEQ ID NO: 1967 - RNA, 18 nt, Artificial Sequence
  Description of Artificial Sequence: Synthetic oligonucleotide
uuuggccgugcuggcugc

SEQ ID NO: 1968 - RNA, 18 nt, Artificial Sequence
  Description of Artificial Sequence: Synthetic oligonucleotide
gagcgaggcagaggaggg

SEQ ID NO: 1969 - RNA, 18 nt, Artificial Sequence
  Description of Artificial Sequence: Synthetic oligonucleotide
uguuggagcgaggcagag

SEQ ID NO: 1970 - RNA, 18 nt, Artificial Sequence
  Description of Artificial Sequence: Synthetic oligonucleotide
ccaaggcccgccaugcca

SEQ ID NO: 1971 - RNA, 18 nt, Artificial Sequence
  Description of Artificial Sequence: Synthetic oligonucleotide
ccgugccaaggcccgcca

SEQ ID NO: 1972 - RNA, 18 nt, Artificial Sequence
  Description of Artificial Sequence: Synthetic oligonucleotide
agagcccgugccaaggcc

SEQ ID NO: 1973 - RNA, 18 nt, Artificial Sequence
  Description of Artificial Sequence: Synthetic oligonucleotide
ggagcagagcccgugcca

SEQ ID NO: 1974 - RNA, 18 nt, Artificial Sequence
  Description of Artificial Sequence: Synthetic oligonucleotide
cagugggagcagagcccg

SEQ ID NO: 1975 - RNA, 18 nt, Artificial Sequence
  Description of Artificial Sequence: Synthetic oligonucleotide
caggccagugggagcaga

SEQ ID NO: 1976 - RNA, 18 nt, Artificial Sequence
  Description of Artificial Sequence: Synthetic oligonucleotide
agcaccaggccaguggga

SEQ ID NO: 1977 - RNA, 18 nt, Artificial Sequence
  Description of Artificial Sequence: Synthetic oligonucleotide
ccgggagcaccaggccag

SEQ ID NO: 1978 - RNA, 18 nt, Artificial Sequence
  Description of Artificial Sequence: Synthetic oligonucleotide
cgucaccgggagcaccag

SEQ ID NO: 1979 - RNA, 18 nt, Artificial Sequence
  Description of Artificial Sequence: Synthetic oligonucleotide
auugccgucaccgggagc

SEQ ID NO: 1980 - RNA, 18 nt, Artificial Sequence
  Description of Artificial Sequence: Synthetic oligonucleotide
gccacauugccgucaccg

SEQ ID NO: 1981 - RNA, 18 nt, Artificial Sequence
  Description of Artificial Sequence: Synthetic oligonucleotide
gaggagccacauugccgu

SEQ ID NO: 1982 - RNA, 18 nt, Artificial Sequence
  Description of Artificial Sequence: Synthetic oligonucleotide
gcagagaggagccacauu

SEQ ID NO: 1983 - RNA, 18 nt, Artificial Sequence
  Description of Artificial Sequence: Synthetic oligonucleotide
ccucagcagagaggagcc

SEQ ID NO: 1984 - RNA, 18 nt, Artificial Sequence
  Description of Artificial Sequence: Synthetic oligonucleotide
ggcgcccucagcagagag

SEQ ID NO: 1985 - RNA, 18 nt, Artificial Sequence
  Description of Artificial Sequence: Synthetic oligonucleotide
gugugggcgcccucagca

SEQ ID NO: 1986 - RNA, 18 nt, Artificial Sequence
  Description of Artificial Sequence: Synthetic oligonucleotide
cagccgugugggcgcccu

SEQ ID NO: 1987 - RNA, 18 nt, Artificial Sequence
  Description of Artificial Sequence: Synthetic oligonucleotide
acucccagccgugugggc

SEQ ID NO: 1988 - RNA, 18 nt, Artificial Sequence
  Description of Artificial Sequence: Synthetic oligonucleotide
ggaccacucccagccgug

SEQ ID NO: 1989 - RNA, 18 nt, Artificial Sequence
  Description of Artificial Sequence: Synthetic oligonucleotide
gccagggaccacucccag

SEQ ID NO: 1990 - RNA, 18 nt, Artificial Sequence
  Description of Artificial Sequence: Synthetic oligonucleotide
ggcaggccagggaccacu

SEQ ID NO: 1991 - RNA, 18 nt, Artificial Sequence
  Description of Artificial Sequence: Synthetic oligonucleotide
gcugaggcaggccaggga

SEQ ID NO: 1992 - RNA, 18 nt, Artificial Sequence
  Description of Artificial Sequence: Synthetic oligonucleotide
auggugcugaggcaggcc

SEQ ID NO: 1993 - RNA, 18 nt, Artificial Sequence
  Description of Artificial Sequence: Synthetic oligonucleotide
gaacaauggugcugaggc

SEQ ID NO: 1994 - RNA, 18 nt, Artificial Sequence
  Description of Artificial Sequence: Synthetic oligonucleotide
ccggagaacaauggugcu

SEQ ID NO: 1995 - RNA, 18 nt, Artificial Sequence
  Description of Artificial Sequence: Synthetic oligonucleotide
aaacaccggagaacaaug

SEQ ID NO: 1996 - RNA, 18 nt, Artificial Sequence
  Description of Artificial Sequence: Synthetic oligonucleotide
cucccaaacaccggagaa

SEQ ID NO: 1997 - RNA, 18 nt, Artificial Sequence
  Description of Artificial Sequence: Synthetic oligonucleotide
gccuccucccaaacaccg

SEQ ID NO: 1998 - RNA, 18 nt, Artificial Sequence
  Description of Artificial Sequence: Synthetic oligonucleotide
ggucagccuccucccaaa

SEQ ID NO: 1999 - RNA, 18 nt, Artificial Sequence
  Description of Artificial Sequence: Synthetic oligonucleotide
ccacgggucagccuccuc

SEQ ID NO: 2000 - RNA, 18 nt, Artificial Sequence
  Description of Artificial Sequence: Synthetic oligonucleotide
accucccacgggucagcc

SEQ ID NO: 2001 - RNA, 18 nt, Artificial Sequence
  Description of Artificial Sequence: Synthetic oligonucleotide
cagacaccucccacgggu

SEQ ID NO: 2002 - RNA, 18 nt, Artificial Sequence
  Description of Artificial Sequence: Synthetic oligonucleotide
cagggcagacaccuccca

SEQ ID NO: 2003 - RNA, 18 nt, Artificial Sequence
  Description of Artificial Sequence: Synthetic oligonucleotide
cugagcagggcagacacc

SEQ ID NO: 2004 - RNA, 18 nt, Artificial Sequence
  Description of Artificial Sequence: Synthetic oligonucleotide
gcuuccugagcagggcag

SEQ ID NO: 2005 - RNA, 18 nt, Artificial Sequence
  Description of Artificial Sequence: Synthetic oligonucleotide
ccccagcuuccugagcag

SEQ ID NO: 2006 - RNA, 18 nt, Artificial Sequence
  Description of Artificial Sequence: Synthetic oligonucleotide
gccagccccagcuuccug

SEQ ID NO: 2007 - RNA, 18 nt, Artificial Sequence
  Description of Artificial Sequence: Synthetic oligonucleotide
aagcugccagccccagcu

SEQ ID NO: 2008 - RNA, 18 nt, Artificial Sequence
  Description of Artificial Sequence: Synthetic oligonucleotide
uucugaagcugccagccc

SEQ ID NO: 2009 - RNA, 18 nt, Artificial Sequence
  Description of Artificial Sequence: Synthetic oligonucleotide
acugcuucugaagcugcc

SEQ ID NO: 2010 - RNA, 18 nt, Artificial Sequence
  Description of Artificial Sequence: Synthetic oligonucleotide
ccccuacugcuucugaag

SEQ ID NO: 2011 - RNA, 18 nt, Artificial Sequence
  Description of Artificial Sequence: Synthetic oligonucleotide
cagggccccuacugcuuc

SEQ ID NO: 2012 - RNA, 18 nt, Artificial Sequence
  Description of Artificial Sequence: Synthetic oligonucleotide
cuccacagggccccuacu

SEQ ID NO: 2013 - RNA, 18 nt, Artificial Sequence
  Description of Artificial Sequence: Synthetic oligonucleotide
agaggcuccacagggccc

SEQ ID NO: 2014 - RNA, 18 nt, Artificial Sequence
  Description of Artificial Sequence: Synthetic oligonucleotide
ugggcagaggcuccacag

SEQ ID NO: 2015 - RNA, 18 nt, Artificial Sequence
  Description of Artificial Sequence: Synthetic oligonucleotide
gaugcugggcagaggcuc

SEQ ID NO: 2016 - RNA, 18 nt, Artificial Sequence
  Description of Artificial Sequence: Synthetic oligonucleotide
cggaggaugcugggcaga

SEQ ID NO: 2017 - RNA, 18 nt, Artificial Sequence
  Description of Artificial Sequence: Synthetic oligonucleotide
ccccacggaggaugcugg

SEQ ID NO: 2018 - RNA, 18 nt, Artificial Sequence
  Description of Artificial Sequence: Synthetic oligonucleotide
ggacuccccacggaggau

SEQ ID NO: 2019 - RNA, 18 nt, Artificial Sequence
  Description of Artificial Sequence: Synthetic oligonucleotide
gugcuggacuccccacgg

SEQ ID NO: 2020 - RNA, 18 nt, Artificial Sequence
  Description of Artificial Sequence: Synthetic oligonucleotide
ccgcagugcuggacuccc

SEQ ID NO: 2021 - RNA, 18 nt, Artificial Sequence
  Description of Artificial Sequence: Synthetic oligonucleotide
ggagcccgcagugcugga

SEQ ID NO: 2022 - RNA, 18 nt, Artificial Sequence
  Description of Artificial Sequence: Synthetic oligonucleotide
cuccuggagcccgcagug

SEQ ID NO: 2023 - RNA, 18 nt, Artificial Sequence
  Description of Artificial Sequence: Synthetic oligonucleotide
agagccuccuggagcccg

SEQ ID NO: 2024 - RNA, 18 nt, Artificial Sequence
  Description of Artificial Sequence: Synthetic oligonucleotide
gccgcagagccuccugga

SEQ ID NO: 2025 - RNA, 18 nt, Artificial Sequence
  Description of Artificial Sequence: Synthetic oligonucleotide
aggcugccgcagagccuc

SEQ ID NO: 2026 - RNA, 18 nt, Artificial Sequence
  Description of Artificial Sequence: Synthetic oligonucleotide
gagggaggcugccgcaga

SEQ ID NO: 2027 - RNA, 18 nt, Artificial Sequence
  Description of Artificial Sequence: Synthetic oligonucleotide
gcagggagggaggcugcc

SEQ ID NO: 2028 - RNA, 18 nt, Artificial Sequence
  Description of Artificial Sequence: Synthetic oligonucleotide
cccaggcagggagggagg

SEQ ID NO: 2029 - RNA, 18 nt, Artificial Sequence
  Description of Artificial Sequence: Synthetic oligonucleotide
cugggcccaggcagggag

SEQ ID NO: 2030 - RNA, 18 nt, Artificial Sequence
  Description of Artificial Sequence: Synthetic oligonucleotide
caaaccugggcccaggca

SEQ ID NO: 2031 - RNA, 18 nt, Artificial Sequence
  Description of Artificial Sequence: Synthetic oligonucleotide
guguccaaaccugggccc

SEQ ID NO: 2032 - RNA, 18 nt, Artificial Sequence
  Description of Artificial Sequence: Synthetic oligonucleotide
cucagguguccaaaccug

SEQ ID NO: 2033 - RNA, 18 nt, Artificial Sequence
  Description of Artificial Sequence: Synthetic oligonucleotide
gcgggcucagguguccaa

SEQ ID NO: 2034 - RNA, 18 nt, Artificial Sequence
  Description of Artificial Sequence: Synthetic oligonucleotide
cgcaggcgggcucaggug

SEQ ID NO: 2035 - RNA, 18 nt, Artificial Sequence
  Description of Artificial Sequence: Synthetic oligonucleotide
gagugcgcaggcgggcuc

SEQ ID NO: 2036 - RNA, 18 nt, Artificial Sequence
  Description of Artificial Sequence: Synthetic oligonucleotide
gggagggaggcugccgca

SEQ ID NO: 2037 - RNA, 18 nt, Artificial Sequence
  Description of Artificial Sequence: Synthetic oligonucleotide
aggcagggagggaggcug

SEQ ID NO: 2038 - RNA, 18 nt, Artificial Sequence
  Description of Artificial Sequence: Synthetic oligonucleotide
ggcccaggcagggaggga

SEQ ID NO: 2039 - RNA, 18 nt, Artificial Sequence
  Description of Artificial Sequence: Synthetic oligonucleotide
accugggcccaggcaggg

SEQ ID NO: 2040 - RNA, 18 nt, Artificial Sequence
  Description of Artificial Sequence: Synthetic oligonucleotide
uccaaaccugggcccagg

SEQ ID NO: 2041 - RNA, 18 nt, Artificial Sequence
  Description of Artificial Sequence: Synthetic oligonucleotide
agguguccaaaccugggc

SEQ ID NO: 2042 - RNA, 18 nt, Artificial Sequence
  Description of Artificial Sequence: Synthetic oligonucleotide
ggcucagguguccaaacc

SEQ ID NO: 2043 - RNA, 18 nt, Artificial Sequence
  Description of Artificial Sequence: Synthetic oligonucleotide
aggcgggcucaggugucc

SEQ ID NO: 2044 - RNA, 18 nt, Artificial Sequence
  Description of Artificial Sequence: Synthetic oligonucleotide
ugcgcaggcgggcucagg

SEQ ID NO: 2045 - RNA, 18 nt, Artificial Sequence
  Description of Artificial Sequence: Synthetic oligonucleotide
cagagugcgcaggcgggc

SEQ ID NO: 2046 - RNA, 18 nt, Artificial Sequence
  Description of Artificial Sequence: Synthetic oligonucleotide
gggcccagagugcgcagg

SEQ ID NO: 2047 - RNA, 18 nt, Artificial Sequence
  Description of Artificial Sequence: Synthetic oligonucleotide
agcacggugccgaguggg

SEQ ID NO: 2048 - RNA, 18 nt, Artificial Sequence
  Description of Artificial Sequence: Synthetic oligonucleotide
gaagcacggugccgagug

SEQ ID NO: 2049 - RNA, 18 nt, Artificial Sequence
  Description of Artificial Sequence: Synthetic oligonucleotide
ggcgagaagcacggugcc

SEQ ID NO: 2050 - RNA, 18 nt, Artificial Sequence
  Description of Artificial Sequence: Synthetic oligonucleotide
ggccuggcgagaagcacg

SEQ ID NO: 2051 - RNA, 18 nt, Artificial Sequence
  Description of Artificial Sequence: Synthetic oligonucleotide
cagagggccuggcgagaa

SEQ ID NO: 2052 - RNA, 18 nt, Artificial Sequence
  Description of Artificial Sequence: Synthetic oligonucleotide
agagccagagggccuggc

SEQ ID NO: 2053 - RNA, 18 nt, Artificial Sequence
  Description of Artificial Sequence: Synthetic oligonucleotide
agggaagagccagagggc

SEQ ID NO: 2054 - RNA, 18 nt, Artificial Sequence
  Description of Artificial Sequence: Synthetic oligonucleotide
gccacagggaagagccag

SEQ ID NO: 2055 - RNA, 18 nt, Artificial Sequence
  Description of Artificial Sequence: Synthetic oligonucleotide
cugcagccacagggaaga

SEQ ID NO: 2056 - RNA, 18 nt, Artificial Sequence
  Description of Artificial Sequence: Synthetic oligonucleotide
gccaucugcagccacagg

SEQ ID NO: 2057 - RNA, 18 nt, Artificial Sequence
  Description of Artificial Sequence: Synthetic oligonucleotide
uaagugccaucugcagcc

SEQ ID NO: 2058 - RNA, 18 nt, Artificial Sequence
  Description of Artificial Sequence: Synthetic oligonucleotide
gccgcuaagugccaucug

SEQ ID NO: 2059 - RNA, 18 nt, Artificial Sequence
  Description of Artificial Sequence: Synthetic oligonucleotide
ccuaggccgcuaagugcc

SEQ ID NO: 2060 - RNA, 18 nt, Artificial Sequence
  Description of Artificial Sequence: Synthetic oligonucleotide
gacguccuaggccgcuaa

SEQ ID NO: 2061 - RNA, 18 nt, Artificial Sequence
  Description of Artificial Sequence: Synthetic oligonucleotide
gaauagacguccuaggcc

SEQ ID NO: 2062 - RNA, 18 nt, Artificial Sequence
  Description of Artificial Sequence: Synthetic oligonucleotide
cccgugaauagacguccu

SEQ ID NO: 2063 - RNA, 18 nt, Artificial Sequence
  Description of Artificial Sequence: Synthetic oligonucleotide
cuccucccgugaauagac

SEQ ID NO: 2064 - RNA, 18 nt, Artificial Sequence
  Description of Artificial Sequence: Synthetic oligonucleotide
ccucccuccucccgugaa

SEQ ID NO: 2065 - RNA, 18 nt, Artificial Sequence
  Description of Artificial Sequence: Synthetic oligonucleotide
cagugccucccuccuccc

SEQ ID NO: 2066 - RNA, 18 nt, Artificial Sequence
  Description of Artificial Sequence: Synthetic oligonucleotide
gagggcagugccucccuc

SEQ ID NO: 2067 - RNA, 18 nt, Artificial Sequence
  Description of Artificial Sequence: Synthetic oligonucleotide
cugaggagggcagugccu

SEQ ID NO: 2068 - RNA, 18 nt, Artificial Sequence
  Description of Artificial Sequence: Synthetic oligonucleotide
cagaccugaggagggcag

SEQ ID NO: 2069 - RNA, 18 nt, Artificial Sequence
  Description of Artificial Sequence: Synthetic oligonucleotide
uugggcagaccugaggag

SEQ ID NO: 2070 - RNA, 18 nt, Artificial Sequence
  Description of Artificial Sequence: Synthetic oligonucleotide
gcugcuugggcagaccug

SEQ ID NO: 2071 - RNA, 18 nt, Artificial Sequence
  Description of Artificial Sequence: Synthetic oligonucleotide
uacaagcugcuugggcag

SEQ ID NO: 2072 - RNA, 18 nt, Artificial Sequence
  Description of Artificial Sequence: Synthetic oligonucleotide
cuagcuacaagcugcuug

SEQ ID NO: 2073 - RNA, 18 nt, Artificial Sequence
  Description of Artificial Sequence: Synthetic oligonucleotide
cagugcuagcuacaagcu

SEQ ID NO: 2074 - RNA, 18 nt, Artificial Sequence
  Description of Artificial Sequence: Synthetic oligonucleotide
gggcccagugcuagcuac

SEQ ID NO: 2075 - RNA, 18 nt, Artificial Sequence
  Description of Artificial Sequence: Synthetic oligonucleotide
ggccagcggccggcaggg

SEQ ID NO: 2076 - RNA, 18 nt, Artificial Sequence
  Description of Artificial Sequence: Synthetic oligonucleotide
gggccagcggccggcagg

SEQ ID NO: 2077 - RNA, 18 nt, Artificial Sequence
  Description of Artificial Sequence: Synthetic oligonucleotide
gggcagggccagcggccg

SEQ ID NO: 2078 - RNA, 18 nt, Artificial Sequence
  Description of Artificial Sequence: Synthetic oligonucleotide
agagagggcagggccagc

SEQ ID NO: 2079 - RNA, 18 nt, Artificial Sequence
  Description of Artificial Sequence: Synthetic oligonucleotide
agaggagagagggcaggg

SEQ ID NO: 2080 - RNA, 18 nt, Artificial Sequence
  Description of Artificial Sequence: Synthetic oligonucleotide
ccugcagaggagagaggg

SEQ ID NO: 2081 - RNA, 18 nt, Artificial Sequence
  Description of Artificial Sequence: Synthetic oligonucleotide
ccgugccugcagaggaga

SEQ ID NO: 2082 - RNA, 18 nt, Artificial Sequence
  Description of Artificial Sequence: Synthetic oligonucleotide
aggccccgugccugcaga

SEQ ID NO: 2083 - RNA, 18 nt, Artificial Sequence
  Description of Artificial Sequence: Synthetic oligonucleotide
agcacaggccccgugccu

SEQ ID NO: 2084 - RNA, 18 nt, Artificial Sequence
  Description of Artificial Sequence: Synthetic oligonucleotide
cagagagcacaggccccg

SEQ ID NO: 2085 - RNA, 18 nt, Artificial Sequence
  Description of Artificial Sequence: Synthetic oligonucleotide
ucgagcagagagcacagg

SEQ ID NO: 2086 - RNA, 18 nt, Artificial Sequence
  Description of Artificial Sequence: Synthetic oligonucleotide
acaggucgagcagagagc

SEQ ID NO: 2087 - RNA, 18 nt, Artificial Sequence
  Description of Artificial Sequence: Synthetic oligonucleotide
uacacacaggucgagcag

SEQ ID NO: 2088 - RNA, 18 nt, Artificial Sequence
  Description of Artificial Sequence: Synthetic oligonucleotide
acgucagcaggaggaggg

SEQ ID NO: 2089 - RNA, 18 nt, Artificial Sequence
  Description of Artificial Sequence: Synthetic oligonucleotide
cggccacgucagcaggag

SEQ ID NO: 2090 - RNA, 18 nt, Artificial Sequence
  Description of Artificial Sequence: Synthetic oligonucleotide
gugugcggccacgucagc

SEQ ID NO: 2091 - RNA, 18 nt, Artificial Sequence
  Description of Artificial Sequence: Synthetic oligonucleotide
agggaggagaaagaggcc

SEQ ID NO: 2092 - RNA, 18 nt, Artificial Sequence
  Description of Artificial Sequence: Synthetic oligonucleotide
gguacagggaggagaaag

SEQ ID NO: 2093 - RNA, 18 nt, Artificial Sequence
  Description of Artificial Sequence: Synthetic oligonucleotide
ggacugguacagggagga

SEQ ID NO: 2094 - RNA, 18 nt, Artificial Sequence
  Description of Artificial Sequence: Synthetic oligonucleotide
cagcuggacugguacagg

SEQ ID NO: 2095 - RNA, 18 nt, Artificial Sequence
  Description of Artificial Sequence: Synthetic oligonucleotide
cuuggcagcuggacuggu

SEQ ID NO: 2096 - RNA, 18 nt, Artificial Sequence
  Description of Artificial Sequence: Synthetic oligonucleotide
cuguccuuggcagcugga

SEQ ID NO: 2097 - RNA, 18 nt, Artificial Sequence
  Description of Artificial Sequence: Synthetic oligonucleotide
ugcagcuguccuuggcag

SEQ ID NO: 2098 - RNA, 18 nt, Artificial Sequence
  Description of Artificial Sequence: Synthetic oligonucleotide
uccugugcagcuguccuu

SEQ ID NO: 2099 - RNA, 18 nt, Artificial Sequence
  Description of Artificial Sequence: Synthetic oligonucleotide
aacgcuccugugcagcug

SEQ ID NO: 2100 - RNA, 18 nt, Artificial Sequence
  Description of Artificial Sequence: Synthetic oligonucleotide
caggaaacgcuccugugc

SEQ ID NO: 2101 - RNA, 18 nt, Artificial Sequence
  Description of Artificial Sequence: Synthetic oligonucleotide
cugcccaggaaacgcucc

SEQ ID NO: 2102 - RNA, 18 nt, Artificial Sequence
  Description of Artificial Sequence: Synthetic oligonucleotide
agaggacauuggaccgca

SEQ ID NO: 2103 - RNA, 18 nt, Artificial Sequence
  Description of Artificial Sequence: Synthetic oligonucleotide
agacaagaggacauugga

SEQ ID NO: 2104 - RNA, 18 nt, Artificial Sequence
  Description of Artificial Sequence: Synthetic oligonucleotide
ucaaaagacaagaggaca

SEQ ID NO: 2105 - RNA, 18 nt, Artificial Sequence
  Description of Artificial Sequence: Synthetic oligonucleotide
ugucaucaaaagacaaga

SEQ ID NO: 2106 - RNA, 18 nt, Artificial Sequence
  Description of Artificial Sequence: Synthetic oligonucleotide
gaagcuguccuucucggg

SEQ ID NO: 2107 - RNA, 18 nt, Artificial Sequence
  Description of Artificial Sequence: Synthetic oligonucleotide
gcccugaagcuguccuuc

SEQ ID NO: 2108 - RNA, 18 nt, Artificial Sequence
  Description of Artificial Sequence: Synthetic oligonucleotide
uccgggcccugaagcugu

SEQ ID NO: 2109 - RNA, 18 nt, Artificial Sequence
  Description of Artificial Sequence: Synthetic oligonucleotide
aguacuccgggcccugaa

SEQ ID NO: 2110 - RNA, 18 nt, Artificial Sequence
  Description of Artificial Sequence: Synthetic oligonucleotide
agacuaguacuccgggcc

SEQ ID NO: 2111 - RNA, 18 nt, Artificial Sequence
  Description of Artificial Sequence: Synthetic oligonucleotide
cguugagacuaguacucc

SEQ ID NO: 2112 - RNA, 18 nt, Artificial Sequence
  Description of Artificial Sequence: Synthetic oligonucleotide
ucucucguugagacuagu

SEQ ID NO: 2113 - RNA, 18 nt, Artificial Sequence
  Description of Artificial Sequence: Synthetic oligonucleotide
uugggucucucguugaga

SEQ ID NO: 2114 - RNA, 18 nt, Artificial Sequence
  Description of Artificial Sequence: Synthetic oligonucleotide
aggcacacccccgcaggc

SEQ ID NO: 2115 - RNA, 18 nt, Artificial Sequence
  Description of Artificial Sequence: Synthetic oligonucleotide
acuccaggcacacccccg

SEQ ID NO: 2116 - RNA, 18 nt, Artificial Sequence
  Description of Artificial Sequence: Synthetic oligonucleotide
caccgacuccaggcacac

SEQ ID NO: 2117 - RNA, 18 nt, Artificial Sequence
  Description of Artificial Sequence: Synthetic oligonucleotide
ccccacaccgacuccagg

SEQ ID NO: 2118 - RNA, 18 nt, Artificial Sequence
  Description of Artificial Sequence: Synthetic oligonucleotide
ccccaccccacaccgacu

SEQ ID NO: 2119 - RNA, 18 nt, Artificial Sequence
  Description of Artificial Sequence: Synthetic oligonucleotide
uccuuccccaccccacac

SEQ ID NO: 2120 - RNA, 18 nt, Artificial Sequence
  Description of Artificial Sequence: Synthetic oligonucleotide
ccauguccuuccccaccc

SEQ ID NO: 2121 - RNA, 18 nt, Artificial Sequence
  Description of Artificial Sequence: Synthetic oligonucleotide
cagccccauguccuuccc

SEQ ID NO: 2122 - RNA, 18 nt, Artificial Sequence
  Description of Artificial Sequence: Synthetic oligonucleotide
ggccacagccccaugucc

SEQ ID NO: 2123 - RNA, 18 nt, Artificial Sequence
  Description of Artificial Sequence: Synthetic oligonucleotide
aggcaggccacagcccca

SEQ ID NO: 2124 - RNA, 18 nt, Artificial Sequence
  Description of Artificial Sequence: Synthetic oligonucleotide
ccgucaggcaggccacag

SEQ ID NO: 2125 - RNA, 18 nt, Artificial Sequence
  Description of Artificial Sequence: Synthetic oligonucleotide
aggcaccgucaggcaggc

SEQ ID NO: 2126 - RNA, 18 nt, Artificial Sequence
  Description of Artificial Sequence: Synthetic oligonucleotide
cuuggaggcaccgucagg

SEQ ID NO: 2127 - RNA, 18 nt, Artificial Sequence
  Description of Artificial Sequence: Synthetic oligonucleotide
acugacuuggaggcaccg

SEQ ID NO: 2128 - RNA, 18 nt, Artificial Sequence
  Description of Artificial Sequence: Synthetic oligonucleotide
cacucacugacuuggagg

SEQ ID NO: 2129 - RNA, 18 nt, Artificial Sequence
  Description of Artificial Sequence: Synthetic oligonucleotide
auuuccacucacugacuu

SEQ ID NO: 2130 - RNA, 18 nt, Artificial Sequence
  Description of Artificial Sequence: Synthetic oligonucleotide
gacccauuuccacucacu

SEQ ID NO: 2131 - RNA, 18 nt, Artificial Sequence
  Description of Artificial Sequence: Synthetic oligonucleotide
cacaggacccauuuccac

SEQ ID NO: 2132 - RNA, 18 nt, Artificial Sequence
  Description of Artificial Sequence: Synthetic oligonucleotide
gggcacacaggacccauu

SEQ ID NO: 2133 - RNA, 18 nt, Artificial Sequence
  Description of Artificial Sequence: Synthetic oligonucleotide
cuccagggcacacaggac

SEQ ID NO: 2134 - RNA, 18 nt, Artificial Sequence
  Description of Artificial Sequence: Synthetic oligonucleotide
acauacuccagggcacac

SEQ ID NO: 2135 - RNA, 18 nt, Artificial Sequence
  Description of Artificial Sequence: Synthetic oligonucleotide
gccucacauacuccaggg

SEQ ID NO: 2136 - RNA, 18 nt, Artificial Sequence
  Description of Artificial Sequence: Synthetic oligonucleotide
gcccugccucacauacuc

SEQ ID NO: 2137 - RNA, 18 nt, Artificial Sequence
  Description of Artificial Sequence: Synthetic oligonucleotide
guccugcccugccucaca

SEQ ID NO: 2138 - RNA, 18 nt, Artificial Sequence
  Description of Artificial Sequence: Synthetic oligonucleotide
ugcagguccugcccugcc

SEQ ID NO: 2139 - RNA, 18 nt, Artificial Sequence
  Description of Artificial Sequence: Synthetic oligonucleotide
gcccuugcagguccugcc

SEQ ID NO: 2140 - RNA, 18 nt, Artificial Sequence
  Description of Artificial Sequence: Synthetic oligonucleotide
uagcggcccuugcagguc

SEQ ID NO: 2141 - RNA, 18 nt, Artificial Sequence
  Description of Artificial Sequence: Synthetic oligonucleotide
gguguuagcggcccuugc

SEQ ID NO: 2142 - RNA, 18 nt, Artificial Sequence
  Description of Artificial Sequence: Synthetic oligonucleotide
ggguguuagcggcccuug

SEQ ID NO: 2143 - RNA, 18 nt, Artificial Sequence
  Description of Artificial Sequence: Synthetic oligonucleotide
cggccaaccugcugaggg

SEQ ID NO: 2144 - RNA, 18 nt, Artificial Sequence
  Description of Artificial Sequence: Synthetic oligonucleotide
caccacggccaaccugcu

SEQ ID NO: 2145 - RNA, 18 nt, Artificial Sequence
  Description of Artificial Sequence: Synthetic oligonucleotide
caggccaccacggccaac

SEQ ID NO: 2146 - RNA, 18 nt, Artificial Sequence
  Description of Artificial Sequence: Synthetic oligonucleotide
ggacccaggccaccacgg

SEQ ID NO: 2147 - RNA, 18 nt, Artificial Sequence
  Description of Artificial Sequence: Synthetic oligonucleotide
agcccggacccaggccac

SEQ ID NO: 2148 - RNA, 18 nt, Artificial Sequence
  Description of Artificial Sequence: Synthetic oligonucleotide
cacgcagcccggacccag

SEQ ID NO: 2149 - RNA, 18 nt, Artificial Sequence
  Description of Artificial Sequence: Synthetic oligonucleotide
uggcacacgcagcccgga

SEQ ID NO: 2150 - RNA, 18 nt, Artificial Sequence
  Description of Artificial Sequence: Synthetic oligonucleotide
gcccguggcacacgcagc

SEQ ID NO: 2151 - RNA, 18 nt, Artificial Sequence
  Description of Artificial Sequence: Synthetic oligonucleotide
uaggugcccguggcacac

SEQ ID NO: 2152 - RNA, 18 nt, Artificial Sequence
  Description of Artificial Sequence: Synthetic oligonucleotide
acaaguaggugcccgugg

SEQ ID NO: 2153 - RNA, 18 nt, Artificial Sequence
  Description of Artificial Sequence: Synthetic oligonucleotide
auuccacaaguaggugcc

SEQ ID NO: 2154 - RNA, 18 nt, Artificial Sequence
  Description of Artificial Sequence: Synthetic oligonucleotide
ccccaauuccacaaguag

SEQ ID NO: 2155 - RNA, 18 nt, Artificial Sequence
  Description of Artificial Sequence: Synthetic oligonucleotide
ccaacccccaauuccaca

SEQ ID NO: 2156 - RNA, 18 nt, Artificial Sequence
  Description of Artificial Sequence: Synthetic oligonucleotide
gcaccccaacccccaauu

SEQ ID NO: 2157 - RNA, 18 nt, Artificial Sequence
  Description of Artificial Sequence: Synthetic oligonucleotide
agcuugcaccccaacccc

SEQ ID NO: 2158 - RNA, 18 nt, Artificial Sequence
  Description of Artificial Sequence: Synthetic oligonucleotide
ccuaaagcuugcacccca

SEQ ID NO: 2159 - RNA, 18 nt, Artificial Sequence
  Description of Artificial Sequence: Synthetic oligonucleotide
aggcgccuaaagcuugca

SEQ ID NO: 2160 - RNA, 18 nt, Artificial Sequence
  Description of Artificial Sequence: Synthetic oligonucleotide
ggcucaggcgccuaaagc

SEQ ID NO: 2161 - RNA, 18 nt, Artificial Sequence
  Description of Artificial Sequence: Synthetic oligonucleotide
gggcucaggcgccuaaag

SEQ ID NO: 2162 - RNA, 18 nt, Artificial Sequence
  Description of Artificial Sequence: Synthetic oligonucleotide
ggccggcuccuucgaggg

SEQ ID NO: 2163 - RNA, 18 nt, Artificial Sequence
  Description of Artificial Sequence: Synthetic oligonucleotide
gacaaggccggcuccuuc

SEQ ID NO: 2164 - RNA, 18 nt, Artificial Sequence
  Description of Artificial Sequence: Synthetic oligonucleotide
ccccagacaaggccggcu

SEQ ID NO: 2165 - RNA, 18 nt, Artificial Sequence
  Description of Artificial Sequence: Synthetic oligonucleotide
ggcagccccagacaaggc

SEQ ID NO: 2166 - RNA, 18 nt, Artificial Sequence
  Description of Artificial Sequence: Synthetic oligonucleotide
gggcagccccagacaagg

SEQ ID NO: 2167 - RNA, 18 nt, Artificial Sequence
  Description of Artificial Sequence: Synthetic oligonucleotide
ggcuagcagcaggcuggg

SEQ ID NO: 2168 - RNA, 18 nt, Artificial Sequence
  Description of Artificial Sequence: Synthetic oligonucleotide
uccccggcuagcagcagg

SEQ ID NO: 2169 - RNA, 18 nt, Artificial Sequence
  Description of Artificial Sequence: Synthetic oligonucleotide
cagaguccccggcuagca

SEQ ID NO: 2170 - RNA, 18 nt, Artificial Sequence
  Description of Artificial Sequence: Synthetic oligonucleotide
ugaagcagaguccccggc

SEQ ID NO: 2171 - RNA, 18 nt, Artificial Sequence
  Description of Artificial Sequence: Synthetic oligonucleotide
ggugaugaagcagagucc

SEQ ID NO: 2172 - RNA, 18 nt, Artificial Sequence
  Description of Artificial Sequence: Synthetic oligonucleotide
gcggcggugaugaagcag

SEQ ID NO: 2173 - RNA, 18 nt, Artificial Sequence
  Description of Artificial Sequence: Synthetic oligonucleotide
gcaaggcggcggugauga

SEQ ID NO: 2174 - RNA, 18 nt, Artificial Sequence
  Description of Artificial Sequence: Synthetic oligonucleotide
guccggcaaggcggcggu

SEQ ID NO: 2175 - RNA, 18 nt, Artificial Sequence
  Description of Artificial Sequence: Synthetic oligonucleotide
uugcgguccggcaaggcg

SEQ ID NO: 2176 - RNA, 18 nt, Artificial Sequence
  Description of Artificial Sequence: Synthetic oligonucleotide
gcucuuugcgguccggca

SEQ ID NO: 2177 - RNA, 18 nt, Artificial Sequence
  Description of Artificial Sequence: Synthetic oligonucleotide
gcucagcucuuugcgguc

SEQ ID NO: 2178 - RNA, 18 nt, Artificial Sequence
  Description of Artificial Sequence: Synthetic oligonucleotide
ggcuggcucagcucuuug

SEQ ID NO: 2179 - RNA, 18 nt, Artificial Sequence
  Description of Artificial Sequence: Synthetic oligonucleotide
acagaggcuggcucagcu

SEQ ID NO: 2180 - RNA, 18 nt, Artificial Sequence
  Description of Artificial Sequence: Synthetic oligonucleotide
agaacacagaggcuggcu

SEQ ID NO: 2181 - RNA, 18 nt, Artificial Sequence
  Description of Artificial Sequence: Synthetic oligonucleotide
aaacaagaacacagaggc

SEQ ID NO: 2182 - RNA, 18 nt, Artificial Sequence
  Description of Artificial Sequence: Synthetic oligonucleotide
aaugcaaacaagaacaca

SEQ ID NO: 2183 - RNA, 18 nt, Artificial Sequence
  Description of Artificial Sequence: Synthetic oligonucleotide
aaugaaaugcaaacaaga

SEQ ID NO: 2184 - RNA, 18 nt, Artificial Sequence
  Description of Artificial Sequence: Synthetic oligonucleotide
guucaaaugaaaugcaaa

SEQ ID NO: 2185 - RNA, 18 nt, Artificial Sequence
  Description of Artificial Sequence: Synthetic oligonucleotide
aagccguucaaaugaaau

SEQ ID NO: 2186 - RNA, 18 nt, Artificial Sequence
  Description of Artificial Sequence: Synthetic oligonucleotide
ggagaaagccguucaaau

SEQ ID NO: 2187 - RNA, 18 nt, Artificial Sequence
  Description of Artificial Sequence: Synthetic oligonucleotide
caggaggagaaagccguu

SEQ ID NO: 2188 - RNA, 18 nt, Artificial Sequence
  Description of Artificial Sequence: Synthetic oligonucleotide
gggacaggaggagaaagc

SEQ ID NO: 2189 - RNA, 18 nt, Artificial Sequence
  Description of Artificial Sequence: Synthetic oligonucleotide
cucgggcaggaagguggg

SEQ ID NO: 2190 - RNA, 18 nt, Artificial Sequence
  Description of Artificial Sequence: Synthetic oligonucleotide
aauagcucgggcaggaag

SEQ ID NO: 2191 - RNA, 18 nt, Artificial Sequence
  Description of Artificial Sequence: Synthetic oligonucleotide
gccaaaauagcucgggca

SEQ ID NO: 2192 - RNA, 18 nt, Artificial Sequence
  Description of Artificial Sequence: Synthetic oligonucleotide
ggaaagccaaaauagcuc

SEQ ID NO: 2193 - RNA, 18 nt, Artificial Sequence
  Description of Artificial Sequence: Synthetic oligonucleotide
ucuagggaaagccaaaau

SEQ ID NO: 2194 - RNA, 18 nt, Artificial Sequence
  Description of Artificial Sequence: Synthetic oligonucleotide
ucccaucuagggaaagcc

SEQ ID NO: 2195 - RNA, 18 nt, Artificial Sequence
  Description of Artificial Sequence: Synthetic oligonucleotide
cguauucccaucuaggga

SEQ ID NO: 2196 - RNA, 18 nt, Artificial Sequence
  Description of Artificial Sequence: Synthetic oligonucleotide
aaugccguauucccaucu

SEQ ID NO: 2197 - RNA, 18 nt, Artificial Sequence
  Description of Artificial Sequence: Synthetic oligonucleotide
uggaaaaugccguauucc

SEQ ID NO: 2198 - RNA, 18 nt, Artificial Sequence
  Description of Artificial Sequence: Synthetic oligonucleotide
cacgcuggaaaaugccgu

SEQ ID NO: 2199 - RNA, 18 nt, Artificial Sequence
  Description of Artificial Sequence: Synthetic oligonucleotide
gaggucacgcuggaaaau

SEQ ID NO: 2200 - RNA, 18 nt, Artificial Sequence
  Description of Artificial Sequence: Synthetic oligonucleotide
gaguugaggucacgcugg

SEQ ID NO: 2201 - RNA, 18 nt, Artificial Sequence
  Description of Artificial Sequence: Synthetic oligonucleotide
cuuccgaguugaggucac

SEQ ID NO: 2202 - RNA, 18 nt, Artificial Sequence
  Description of Artificial Sequence: Synthetic oligonucleotide
auacaaauuucauagccc

SEQ ID NO: 2203 - RNA, 18 nt, Artificial Sequence
  Description of Artificial Sequence: Synthetic oligonucleotide
uucugauacaaauuucau

SEQ ID NO: 2204 - RNA, 18 nt, Artificial Sequence
  Description of Artificial Sequence: Synthetic oligonucleotide
guucauucugauacaaau

SEQ ID NO: 2205 - RNA, 18 nt, Artificial Sequence
  Description of Artificial Sequence: Synthetic oligonucleotide
ugggaguucauucugaua

SEQ ID NO: 2206 - RNA, 18 nt, Artificial Sequence
  Description of Artificial Sequence: Synthetic oligonucleotide
gcuuaugggaguucauuc

SEQ ID NO: 2207 - RNA, 18 nt, Artificial Sequence
  Description of Artificial Sequence: Synthetic oligonucleotide
aagaggcuuaugggaguu

SEQ ID NO: 2208 - RNA, 18 nt, Artificial Sequence
  Description of Artificial Sequence: Synthetic oligonucleotide
cagggaagaggcuuaugg

SEQ ID NO: 2209 - RNA, 18 nt, Artificial Sequence
  Description of Artificial Sequence: Synthetic oligonucleotide
agugacagggaagaggcu

SEQ ID NO: 2210 - RNA, 18 nt, Artificial Sequence
  Description of Artificial Sequence: Synthetic oligonucleotide
cacccagugacagggaag

SEQ ID NO: 2211 - RNA, 18 nt, Artificial Sequence
  Description of Artificial Sequence: Synthetic oligonucleotide
cuccacacccagugacag

SEQ ID NO: 2212 - RNA, 18 nt, Artificial Sequence
  Description of Artificial Sequence: Synthetic oligonucleotide
cugagcuccacacccagu

SEQ ID NO: 2213 - RNA, 18 nt, Artificial Sequence
  Description of Artificial Sequence: Synthetic oligonucleotide
gcugccugagcuccacac

SEQ ID NO: 2214 - RNA, 18 nt, Artificial Sequence
  Description of Artificial Sequence: Synthetic oligonucleotide
gagcggcugccugagcuc

SEQ ID NO: 2215 - RNA, 18 nt, Artificial Sequence
  Description of Artificial Sequence: Synthetic oligonucleotide
caggcgagcggcugccug

SEQ ID NO: 2216 - RNA, 18 nt, Artificial Sequence
  Description of Artificial Sequence: Synthetic oligonucleotide
ucaggcaggcgagcggcu

SEQ ID NO: 2217 - RNA, 18 nt, Artificial Sequence
  Description of Artificial Sequence: Synthetic oligonucleotide
cacccucaggcaggcgag

SEQ ID NO: 2218 - RNA, 18 nt, Artificial Sequence
  Description of Artificial Sequence: Synthetic oligonucleotide
accgucacccucaggcag

SEQ ID NO: 2219 - RNA, 18 nt, Artificial Sequence
  Description of Artificial Sequence: Synthetic oligonucleotide
cuuccaccgucacccuca

SEQ ID NO: 2220 - RNA, 18 nt, Artificial Sequence
  Description of Artificial Sequence: Synthetic oligonucleotide
guggccuuccaccgucac

SEQ ID NO: 2221 - RNA, 18 nt, Artificial Sequence
  Description of Artificial Sequence: Synthetic oligonucleotide
cccauguggccuuccacc

SEQ ID NO: 2222 - RNA, 18 nt, Artificial Sequence
  Description of Artificial Sequence: Synthetic oligonucleotide
ggauccccauguggccuu

SEQ ID NO: 2223 - RNA, 18 nt, Artificial Sequence
  Description of Artificial Sequence: Synthetic oligonucleotide
gucugggauccccaugug

SEQ ID NO: 2224 - RNA, 18 nt, Artificial Sequence
  Description of Artificial Sequence: Synthetic oligonucleotide
cagaggucugggaucccc

SEQ ID NO: 2225 - RNA, 18 nt, Artificial Sequence
  Description of Artificial Sequence: Synthetic oligonucleotide
gcacacagaggucuggga

SEQ ID NO: 2226 - RNA, 18 nt, Artificial Sequence
  Description of Artificial Sequence: Synthetic oligonucleotide
ggcaagcacacagagguc

SEQ ID NO: 2227 - RNA, 18 nt, Artificial Sequence
  Description of Artificial Sequence: Synthetic oligonucleotide
ccuccggcaagcacacag

SEQ ID NO: 2228 - RNA, 18 nt, Artificial Sequence
  Description of Artificial Sequence: Synthetic oligonucleotide
ggcugccuccggcaagca

SEQ ID NO: 2229 - RNA, 18 nt, Artificial Sequence
  Description of Artificial Sequence: Synthetic oligonucleotide
ccgcaggcugccuccggc

SEQ ID NO: 2230 - RNA, 18 nt, Artificial Sequence
  Description of Artificial Sequence: Synthetic oligonucleotide
ucugcccgcaggcugccu

SEQ ID NO: 2231 - RNA, 18 nt, Artificial Sequence
  Description of Artificial Sequence: Synthetic oligonucleotide
ugcauucugcccgcaggc

SEQ ID NO: 2232 - RNA, 18 nt, Artificial Sequence
  Description of Artificial Sequence: Synthetic oligonucleotide
cagauugcauucugcccg

SEQ ID NO: 2233 - RNA, 18 nt, Artificial Sequence
  Description of Artificial Sequence: Synthetic oligonucleotide
aggcccagauugcauucu

SEQ ID NO: 2234 - RNA, 18 nt, Artificial Sequence
  Description of Artificial Sequence: Synthetic oligonucleotide
cagacaggcccagauugc

SEQ ID NO: 2235 - RNA, 18 nt, Artificial Sequence
  Description of Artificial Sequence: Synthetic oligonucleotide
ccacacagacaggcccag

SEQ ID NO: 2236 - RNA, 18 nt, Artificial Sequence
  Description of Artificial Sequence: Synthetic oligonucleotide
ggaggccacacagacagg

SEQ ID NO: 2237 - RNA, 18 nt, Artificial Sequence
  Description of Artificial Sequence: Synthetic oligonucleotide
gaggcggaggccacacag

SEQ ID NO: 2238 - RNA, 18 nt, Artificial Sequence
  Description of Artificial Sequence: Synthetic oligonucleotide
gcagagaggcggaggcca

SEQ ID NO: 2239 - RNA, 18 nt, Artificial Sequence
  Description of Artificial Sequence: Synthetic oligonucleotide
gucaugcagagaggcgga

SEQ ID NO: 2240 - RNA, 18 nt, Artificial Sequence
  Description of Artificial Sequence: Synthetic oligonucleotide
guguagucaugcagagag

SEQ ID NO: 2241 - RNA, 18 nt, Artificial Sequence
  Description of Artificial Sequence: Synthetic oligonucleotide
aaacgguguagucaugca

SEQ ID NO: 2242 - RNA, 18 nt, Artificial Sequence
  Description of Artificial Sequence: Synthetic oligonucleotide
uggcgaaacgguguaguc

SEQ ID NO: 2243 - RNA, 18 nt, Artificial Sequence
  Description of Artificial Sequence: Synthetic oligonucleotide
ccuccuggcgaaacggug

SEQ ID NO: 2244 - RNA, 18 nt, Artificial Sequence
  Description of Artificial Sequence: Synthetic oligonucleotide
uacggccuccuggcgaaa

SEQ ID NO: 2245 - RNA, 18 nt, Artificial Sequence
  Description of Artificial Sequence: Synthetic oligonucleotide
uagguuacggccuccugg

SEQ ID NO: 2246 - RNA, 18 nt, Artificial Sequence
  Description of Artificial Sequence: Synthetic oligonucleotide
agcacuagguuacggccu

SEQ ID NO: 2247 - RNA, 18 nt, Artificial Sequence
  Description of Artificial Sequence: Synthetic oligonucleotide
acgggagcacuagguuac

SEQ ID NO: 2248 - RNA, 18 nt, Artificial Sequence
  Description of Artificial Sequence: Synthetic oligonucleotide
agcccacgggagcacuag

SEQ ID NO: 2249 - RNA, 18 nt, Artificial Sequence
  Description of Artificial Sequence: Synthetic oligonucleotide
accgaagcccacgggagc

SEQ ID NO: 2250 - RNA, 18 nt, Artificial Sequence
  Description of Artificial Sequence: Synthetic oligonucleotide
cccucaccgaagcccacg

SEQ ID NO: 2251 - RNA, 18 nt, Artificial Sequence
  Description of Artificial Sequence: Synthetic oligonucleotide
caucccccucaccgaagc

SEQ ID NO: 2252 - RNA, 18 nt, Artificial Sequence
  Description of Artificial Sequence: Synthetic oligonucleotide
accgacaucccccucacc

SEQ ID NO: 2253 - RNA, 18 nt, Artificial Sequence
  Description of Artificial Sequence: Synthetic oligonucleotide
uagagaccgacauccccc

SEQ ID NO: 2254 - RNA, 18 nt, Artificial Sequence
  Description of Artificial Sequence: Synthetic oligonucleotide
gaggcuagagaccgacau

SEQ ID NO: 2255 - RNA, 18 nt, Artificial Sequence
  Description of Artificial Sequence: Synthetic oligonucleotide
cucaggaggcuagagacc

SEQ ID NO: 2256 - RNA, 18 nt, Artificial Sequence
  Description of Artificial Sequence: Synthetic oligonucleotide
gcagacucaggaggcuag

SEQ ID NO: 2257 - RNA, 18 nt, Artificial Sequence
  Description of Artificial Sequence: Synthetic oligonucleotide
ucggagcagacucaggag

SEQ ID NO: 2258 - RNA, 18 nt, Artificial Sequence
  Description of Artificial Sequence: Synthetic oligonucleotide
acuggucggagcagacuc

SEQ ID NO: 2259 - RNA, 18 nt, Artificial Sequence
  Description of Artificial Sequence: Synthetic oligonucleotide
ggccuacuggucggagca

SEQ ID NO: 2260 - RNA, 18 nt, Artificial Sequence
  Description of Artificial Sequence: Synthetic oligonucleotide
gaccaggccuacuggucg

SEQ ID NO: 2261 - RNA, 18 nt, Artificial Sequence
  Description of Artificial Sequence: Synthetic oligonucleotide
gggaagaccaggccuacu

SEQ ID NO: 2262 - RNA, 18 nt, Artificial Sequence
  Description of Artificial Sequence: Synthetic oligonucleotide
auugucccagagaacggg

SEQ ID NO: 2263 - RNA, 18 nt, Artificial Sequence
  Description of Artificial Sequence: Synthetic oligonucleotide
acauugucccagagaacg

SEQ ID NO: 2264 - RNA, 18 nt, Artificial Sequence
  Description of Artificial Sequence: Synthetic oligonucleotide
ggaccacauugucccaga

SEQ ID NO: 2265 - RNA, 18 nt, Artificial Sequence
  Description of Artificial Sequence: Synthetic oligonucleotide
cacguggaccacauuguc

SEQ ID NO: 2266 - RNA, 18 nt, Artificial Sequence
  Description of Artificial Sequence: Synthetic oligonucleotide
agaaucacguggaccaca

SEQ ID NO: 2267 - RNA, 18 nt, Artificial Sequence
  Description of Artificial Sequence: Synthetic oligonucleotide
gcuugagaaucacgugga

SEQ ID NO: 2268 - RNA, 18 nt, Artificial Sequence
  Description of Artificial Sequence: Synthetic oligonucleotide
ccucagcuugagaaucac

SEQ ID NO: 2269 - RNA, 18 nt, Artificial Sequence
  Description of Artificial Sequence: Synthetic oligonucleotide
gcgagccucagcuugaga

SEQ ID NO: 2270 - RNA, 18 nt, Artificial Sequence
  Description of Artificial Sequence: Synthetic oligonucleotide
gcccagcgagccucagcu

SEQ ID NO: 2271 - RNA, 18 nt, Artificial Sequence
  Description of Artificial Sequence: Synthetic oligonucleotide
gggcggcccagcgagccu

SEQ ID NO: 2272 - RNA, 18 nt, Artificial Sequence
  Description of Artificial Sequence: Synthetic oligonucleotide
ggcgugggcggcccagcg

SEQ ID NO: 2273 - RNA, 18 nt, Artificial Sequence
  Description of Artificial Sequence: Synthetic oligonucleotide
aacagggcgugggcggcc

SEQ ID NO: 2274 - RNA, 18 nt, Artificial Sequence
  Description of Artificial Sequence: Synthetic oligonucleotide
accccaacagggcguggg

SEQ ID NO: 2275 - RNA, 18 nt, Artificial Sequence
  Description of Artificial Sequence: Synthetic oligonucleotide
gaaagaccccaacagggc

SEQ ID NO: 2276 - RNA, 18 nt, Artificial Sequence
  Description of Artificial Sequence: Synthetic oligonucleotide
gcucggaaagaccccaac

SEQ ID NO: 2277 - RNA, 18 nt, Artificial Sequence
  Description of Artificial Sequence: Synthetic oligonucleotide
accucgcucggaaagacc

SEQ ID NO: 2278 - RNA, 18 nt, Artificial Sequence
  Description of Artificial Sequence: Synthetic oligonucleotide
ugaggaccucgcucggaa

SEQ ID NO: 2279 - RNA, 18 nt, Artificial Sequence
  Description of Artificial Sequence: Synthetic oligonucleotide
acggcugaggaccucgcu

SEQ ID NO: 2280 - RNA, 18 nt, Artificial Sequence
  Description of Artificial Sequence: Synthetic oligonucleotide
caugcacggcugaggacc

SEQ ID NO: 2281 - RNA, 18 nt, Artificial Sequence
  Description of Artificial Sequence: Synthetic oligonucleotide
caacgcaugcacggcuga

SEQ ID NO: 2282 - RNA, 18 nt, Artificial Sequence
  Description of Artificial Sequence: Synthetic oligonucleotide
aagcucaacgcaugcacg

SEQ ID NO: 2283 - RNA, 18 nt, Artificial Sequence
  Description of Artificial Sequence: Synthetic oligonucleotide
ggccaaagcucaacgcau

SEQ ID NO: 2284 - RNA, 18 nt, Artificial Sequence
  Description of Artificial Sequence: Synthetic oligonucleotide
ccaagggccaaagcucaa

SEQ ID NO: 2285 - RNA, 18 nt, Artificial Sequence
  Description of Artificial Sequence: Synthetic oligonucleotide
uaucaccaagggccaaag

SEQ ID NO: 2286 - RNA, 18 nt, Artificial Sequence
  Description of Artificial Sequence: Synthetic oligonucleotide
ccaccuaucaccaagggc

SEQ ID NO: 2287 - RNA, 18 nt, Artificial Sequence
  Description of Artificial Sequence: Synthetic oligonucleotide
ccgagccaccuaucacca

SEQ ID NO: 2288 - RNA, 18 nt, Artificial Sequence
  Description of Artificial Sequence: Synthetic oligonucleotide
gcgggccgagccaccuau

SEQ ID NO: 2289 - RNA, 18 nt, Artificial Sequence
  Description of Artificial Sequence: Synthetic oligonucleotide
guagggcgggccgagcca

SEQ ID NO: 2290 - RNA, 18 nt, Artificial Sequence
  Description of Artificial Sequence: Synthetic oligonucleotide
gccagguagggcgggccg

SEQ ID NO: 2291 - RNA, 18 nt, Artificial Sequence
  Description of Artificial Sequence: Synthetic oligonucleotide
agggugccagguagggcg

SEQ ID NO: 2292 - RNA, 18 nt, Artificial Sequence
  Description of Artificial Sequence: Synthetic oligonucleotide
gggucagggugccaggua

SEQ ID NO: 2293 - RNA, 18 nt, Artificial Sequence
  Description of Artificial Sequence: Synthetic oligonucleotide
gaccagggucagggugcc

SEQ ID NO: 2294 - RNA, 18 nt, Artificial Sequence
  Description of Artificial Sequence: Synthetic oligonucleotide
gccgugaccagggucagg

SEQ ID NO: 2295 - RNA, 18 nt, Artificial Sequence
  Description of Artificial Sequence: Synthetic oligonucleotide
ggugagggacgucuguau

SEQ ID NO: 2296 - RNA, 18 nt, Artificial Sequence
  Description of Artificial Sequence: Synthetic oligonucleotide
gcacuggugagggacguc

SEQ ID NO: 2297 - RNA, 18 nt, Artificial Sequence
  Description of Artificial Sequence: Synthetic oligonucleotide
agcuggcacuggugaggg

SEQ ID NO: 2298 - RNA, 18 nt, Artificial Sequence
  Description of Artificial Sequence: Synthetic oligonucleotide
ccccaagcuggcacuggu

SEQ ID NO: 2299 - RNA, 18 nt, Artificial Sequence
  Description of Artificial Sequence: Synthetic oligonucleotide
gcagaccccaagcuggca

SEQ ID NO: 2300 - RNA, 18 nt, Artificial Sequence
  Description of Artificial Sequence: Synthetic oligonucleotide
caucugcagaccccaagc

SEQ ID NO: 2301 - RNA, 18 nt, Artificial Sequence
  Description of Artificial Sequence: Synthetic oligonucleotide
guucucaucugcagaccc

SEQ ID NO: 2302 - RNA, 18 nt, Artificial Sequence
  Description of Artificial Sequence: Synthetic oligonucleotide
acggaguucucaucugca

SEQ ID NO: 2303 - RNA, 18 nt, Artificial Sequence
  Description of Artificial Sequence: Synthetic oligonucleotide
gggccacggaguucucau

SEQ ID NO: 2304 - RNA, 18 nt, Artificial Sequence
  Description of Artificial Sequence: Synthetic oligonucleotide
agccugggccacggaguu

SEQ ID NO: 2305 - RNA, 18 nt, Artificial Sequence
  Description of Artificial Sequence: Synthetic oligonucleotide
ucgucagccugggccacg

SEQ ID NO: 2306 - RNA, 18 nt, Artificial Sequence
  Description of Artificial Sequence: Synthetic oligonucleotide
ggcuaucgucagccuggg

SEQ ID NO: 2307 - RNA, 18 nt, Artificial Sequence
  Description of Artificial Sequence: Synthetic oligonucleotide
uuucaggcuaucgucagc

SEQ ID NO: 2308 - RNA, 18 nt, Artificial Sequence
  Description of Artificial Sequence: Synthetic oligonucleotide
agguuuuucaggcuaucg

SEQ ID NO: 2309 - RNA, 18 nt, Artificial Sequence
  Description of Artificial Sequence: Synthetic oligonucleotide
gguggagguuuuucaggc

SEQ ID NO: 2310 - RNA, 18 nt, Artificial Sequence
  Description of Artificial Sequence: Synthetic oligonucleotide
cuccagguggagguuuuu

SEQ ID NO: 2311 - RNA, 18 nt, Artificial Sequence
  Description of Artificial Sequence: Synthetic oligonucleotide
gugagcuccagguggagg

SEQ ID NO: 2312 - RNA, 18 nt, Artificial Sequence
  Description of Artificial Sequence: Synthetic oligonucleotide
uuuccgugagcuccaggu

SEQ ID NO: 2313 - RNA, 18 nt, Artificial Sequence
  Description of Artificial Sequence: Synthetic oligonucleotide
acagguuuccgugagcuc

SEQ ID NO: 2314 - RNA, 18 nt, Artificial Sequence
  Description of Artificial Sequence: Synthetic oligonucleotide
uccagacagguuuccgug

SEQ ID NO: 2315 - RNA, 18 nt, Artificial Sequence
  Description of Artificial Sequence: Synthetic oligonucleotide
ucauguccagacagguuu

SEQ ID NO: 2316 - RNA, 18 nt, Artificial Sequence
  Description of Artificial Sequence: Synthetic oligonucleotide
agccaucauguccagaca

SEQ ID NO: 2317 - RNA, 18 nt, Artificial Sequence
  Description of Artificial Sequence: Synthetic oligonucleotide
uaucgagccaucaugucc

SEQ ID NO: 2318 - RNA, 18 nt, Artificial Sequence
  Description of Artificial Sequence: Synthetic oligonucleotide
agacguaucgagccauca

SEQ ID NO: 2319 - RNA, 18 nt, Artificial Sequence
  Description of Artificial Sequence: Synthetic oligonucleotide
ggagaagacguaucgagc

SEQ ID NO: 2320 - RNA, 18 nt, Artificial Sequence
  Description of Artificial Sequence: Synthetic oligonucleotide
aaguuggagaagacguau

SEQ ID NO: 2321 - RNA, 18 nt, Artificial Sequence
  Description of Artificial Sequence: Synthetic oligonucleotide
ccgugaaguuggagaaga

SEQ ID NO: 2322 - RNA, 18 nt, Artificial Sequence
  Description of Artificial Sequence: Synthetic oligonucleotide
gacagccgugaaguugga

SEQ ID NO: 2323 - RNA, 18 nt, Artificial Sequence
  Description of Artificial Sequence: Synthetic oligonucleotide
uucgggacagccgugaag

SEQ ID NO: 2324 - RNA, 18 nt, Artificial Sequence
  Description of Artificial Sequence: Synthetic oligonucleotide
gagugcuuccacugcgug

SEQ ID NO: 2325 - RNA, 18 nt, Artificial Sequence
  Description of Artificial Sequence: Synthetic oligonucleotide
uuccagagugcuuccacu

SEQ ID NO: 2326 - RNA, 18 nt, Artificial Sequence
  Description of Artificial Sequence: Synthetic oligonucleotide
ccgccuuccagagugcuu

SEQ ID NO: 2327 - RNA, 18 nt, Artificial Sequence
  Description of Artificial Sequence: Synthetic oligonucleotide
cgcgaccgccuuccagag

SEQ ID NO: 2328 - RNA, 18 nt, Artificial Sequence
  Description of Artificial Sequence: Synthetic oligonucleotide
agauccgcgaccgccuuc

SEQ ID NO: 2329 - RNA, 18 nt, Artificial Sequence
  Description of Artificial Sequence: Synthetic oligonucleotide
gcaacagauccgcgaccg

SEQ ID NO: 2330 - RNA, 18 nt, Artificial Sequence
  Description of Artificial Sequence: Synthetic oligonucleotide
cggcugcaacagauccgc

SEQ ID NO: 2331 - RNA, 18 nt, Artificial Sequence
  Description of Artificial Sequence: Synthetic oligonucleotide
cgcuccggcugcaacaga

SEQ ID NO: 2332 - RNA, 18 nt, Artificial Sequence
  Description of Artificial Sequence: Synthetic oligonucleotide
gcggccgcuccggcugca

SEQ ID NO: 2333 - RNA, 18 nt, Artificial Sequence
  Description of Artificial Sequence: Synthetic oligonucleotide
cuccagcggccgcuccgg

SEQ ID NO: 2334 - RNA, 18 nt, Artificial Sequence
  Description of Artificial Sequence: Synthetic oligonucleotide
cgggccuccagcggccgc

SEQ ID NO: 2335 - RNA, 18 nt, Artificial Sequence
  Description of Artificial Sequence: Synthetic oligonucleotide
cgugccgggccuccagcg

SEQ ID NO: 2336 - RNA, 18 nt, Artificial Sequence
  Description of Artificial Sequence: Synthetic oligonucleotide
caccgcgugccgggccuc

SEQ ID NO: 2337 - RNA, 18 nt, Artificial Sequence
  Description of Artificial Sequence: Synthetic oligonucleotide
gccagcaccgcgugccgg

SEQ ID NO: 2338 - RNA, 18 nt, Artificial Sequence
  Description of Artificial Sequence: Synthetic oligonucleotide
gcagagccagcaccgcgu

SEQ ID NO: 2339 - RNA, 18 nt, Artificial Sequence
  Description of Artificial Sequence: Synthetic oligonucleotide
cuucagcagagccagcac

SEQ ID NO: 2340 - RNA, 18 nt, Artificial Sequence
  Description of Artificial Sequence: Synthetic oligonucleotide
auggccuucagcagagcc

SEQ ID NO: 2341 - RNA, 18 nt, Artificial Sequence
  Description of Artificial Sequence: Synthetic oligonucleotide
gcacgauggccuucagca

SEQ ID NO: 2342 - RNA, 18 nt, Artificial Sequence
  Description of Artificial Sequence: Synthetic oligonucleotide
ccccugcacgauggccuu

SEQ ID NO: 2343 - RNA, 18 nt, Artificial Sequence
  Description of Artificial Sequence: Synthetic oligonucleotide
cccagcgucgcccugggc

SEQ ID NO: 2344 - RNA, 18 nt, Artificial Sequence
  Description of Artificial Sequence: Synthetic oligonucleotide
cccaucccagcgucgccc

SEQ ID NO: 2345 - RNA, 18 nt, Artificial Sequence
  Description of Artificial Sequence: Synthetic oligonucleotide
cgucacccaucccagcgu

SEQ ID NO: 2346 - RNA, 18 nt, Artificial Sequence
  Description of Artificial Sequence: Synthetic oligonucleotide
ccugacgucacccauccc

SEQ ID NO: 2347 - RNA, 18 nt, Artificial Sequence
  Description of Artificial Sequence: Synthetic oligonucleotide
ggcagccugacgucaccc

SEQ ID NO: 2348 - RNA, 18 nt, Artificial Sequence
  Description of Artificial Sequence: Synthetic oligonucleotide
cagugggcagccugacgu

SEQ ID NO: 2349 - RNA, 18 nt, Artificial Sequence
  Description of Artificial Sequence: Synthetic oligonucleotide
acagucagugggcagccu

SEQ ID NO: 2350 - RNA, 18 nt, Artificial Sequence
  Description of Artificial Sequence: Synthetic oligonucleotide
acaggacagucagugggc

SEQ ID NO: 2351 - RNA, 18 nt, Artificial Sequence
  Description of Artificial Sequence: Synthetic oligonucleotide
cagggacaggacagucag

SEQ ID NO: 2352 - RNA, 18 nt, Artificial Sequence
  Description of Artificial Sequence: Synthetic oligonucleotide
cccagcagggacaggaca

SEQ ID NO: 2353 - RNA, 18 nt, Artificial Sequence
  Description of Artificial Sequence: Synthetic oligonucleotide
cacggcccagcagggaca

SEQ ID NO: 2354 - RNA, 18 nt, Artificial Sequence
  Description of Artificial Sequence: Synthetic oligonucleotide
ccaaacacggcccagcag

SEQ ID NO: 2355 - RNA, 18 nt, Artificial Sequence
  Description of Artificial Sequence: Synthetic oligonucleotide
ggaguccaaacacggccc

SEQ ID NO: 2356 - RNA, 18 nt, Artificial Sequence
  Description of Artificial Sequence: Synthetic oligonucleotide
aggcaggaguccaaacac

SEQ ID NO: 2357 - RNA, 18 nt, Artificial Sequence
  Description of Artificial Sequence: Synthetic oligonucleotide
caccgaggcaggagucca

SEQ ID NO: 2358 - RNA, 18 nt, Artificial Sequence
  Description of Artificial Sequence: Synthetic oligonucleotide
caacucaccgaggcagga

SEQ ID NO: 2359 - RNA, 18 nt, Artificial Sequence
  Description of Artificial Sequence: Synthetic oligonucleotide
cccagcaacucaccgagg

SEQ ID NO: 2360 - RNA, 18 nt, Artificial Sequence
  Description of Artificial Sequence: Synthetic oligonucleotide
cugugcccagcaacucac

SEQ ID NO: 2361 - RNA, 18 nt, Artificial Sequence
  Description of Artificial Sequence: Synthetic oligonucleotide
agacccugugcccagcaa

SEQ ID NO: 2362 - RNA, 18 nt, Artificial Sequence
  Description of Artificial Sequence: Synthetic oligonucleotide
ccccuagacccugugccc

SEQ ID NO: 2363 - RNA, 18 nt, Artificial Sequence
  Description of Artificial Sequence: Synthetic oligonucleotide
aucagccccuagacccug

SEQ ID NO: 2364 - RNA, 18 nt, Artificial Sequence
  Description of Artificial Sequence: Synthetic oligonucleotide
agcccaucagccccuaga

SEQ ID NO: 2365 - RNA, 18 nt, Artificial Sequence
  Description of Artificial Sequence: Synthetic oligonucleotide
uccagagcccaucagccc

SEQ ID NO: 2366 - RNA, 18 nt, Artificial Sequence
  Description of Artificial Sequence: Synthetic oligonucleotide
ccagcuccagagcccauc

SEQ ID NO: 2367 - RNA, 18 nt, Artificial Sequence
  Description of Artificial Sequence: Synthetic oligonucleotide
gccauccagcuccagagc

SEQ ID NO: 2368 - RNA, 18 nt, Artificial Sequence
  Description of Artificial Sequence: Synthetic oligonucleotide
cacaggccauccagcucc

SEQ ID NO: 2369 - RNA, 18 nt, Artificial Sequence
  Description of Artificial Sequence: Synthetic oligonucleotide
gaccccacaggccaucca

SEQ ID NO: 2370 - RNA, 18 nt, Artificial Sequence
  Description of Artificial Sequence: Synthetic oligonucleotide
caggagaccccacaggcc

SEQ ID NO: 2371 - RNA, 18 nt, Artificial Sequence
  Description of Artificial Sequence: Synthetic oligonucleotide
gacaccaggagaccccac

SEQ ID NO: 2372 - RNA, 18 nt, Artificial Sequence
  Description of Artificial Sequence: Synthetic oligonucleotide
cucaugacaccaggagac

SEQ ID NO: 2373 - RNA, 18 nt, Artificial Sequence
  Description of Artificial Sequence: Synthetic oligonucleotide
cagaccucaugacaccag

SEQ ID NO: 2374 - RNA, 18 nt, Artificial Sequence
  Description of Artificial Sequence: Synthetic oligonucleotide
ucacacagaccucaugac

SEQ ID NO: 2375 - RNA, 18 nt, Artificial Sequence
  Description of Artificial Sequence: Synthetic oligonucleotide
uacggucacacagaccuc

SEQ ID NO: 2376 - RNA, 18 nt, Artificial Sequence
  Description of Artificial Sequence: Synthetic oligonucleotide
gugccuacggucacacag

SEQ ID NO: 2377 - RNA, 18 nt, Artificial Sequence
  Description of Artificial Sequence: Synthetic oligonucleotide
aggcagugccuacgguca

SEQ ID NO: 2378 - RNA, 18 nt, Artificial Sequence
  Description of Artificial Sequence: Synthetic oligonucleotide
cgaggaggcagugccuac

SEQ ID NO: 2379 - RNA, 18 nt, Artificial Sequence
  Description of Artificial Sequence: Synthetic oligonucleotide
acaggcgaggaggcagug

SEQ ID NO: 2380 - RNA, 18 nt, Artificial Sequence
  Description of Artificial Sequence: Synthetic oligonucleotide
uguuuacaggcgaggagg

SEQ ID NO: 2381 - RNA, 18 nt, Artificial Sequence
  Description of Artificial Sequence: Synthetic oligonucleotide
ccaucuguuuacaggcga

SEQ ID NO: 2382 - RNA, 18 nt, Artificial Sequence
  Description of Artificial Sequence: Synthetic oligonucleotide
agugaccaucuguuuaca

SEQ ID NO: 2383 - RNA, 18 nt, Artificial Sequence
  Description of Artificial Sequence: Synthetic oligonucleotide
ggugcagugaccaucugu

SEQ ID NO: 2384 - RNA, 18 nt, Artificial Sequence
  Description of Artificial Sequence: Synthetic oligonucleotide
aggaaggugcagugacca

SEQ ID NO: 2385 - RNA, 18 nt, Artificial Sequence
  Description of Artificial Sequence: Synthetic oligonucleotide
auaagaggaaggugcagu

SEQ ID NO: 2386 - RNA, 18 nt, Artificial Sequence
  Description of Artificial Sequence: Synthetic oligonucleotide
aucccauaagaggaaggu

SEQ ID NO: 2387 - RNA, 18 nt, Artificial Sequence
  Description of Artificial Sequence: Synthetic oligonucleotide
agaacaucccauaagagg

SEQ ID NO: 2388 - RNA, 18 nt, Artificial Sequence
  Description of Artificial Sequence: Synthetic oligonucleotide
uccccagaacaucccaua

SEQ ID NO: 2389 - RNA, 18 nt, Artificial Sequence
  Description of Artificial Sequence: Synthetic oligonucleotide
uaugauccccagaacauc

SEQ ID NO: 2390 - RNA, 18 nt, Artificial Sequence
  Description of Artificial Sequence: Synthetic oligonucleotide
ccucauaugauccccaga

SEQ ID NO: 2391 - RNA, 18 nt, Artificial Sequence
  Description of Artificial Sequence: Synthetic oligonucleotide
aacugccucauaugaucc

SEQ ID NO: 2392 - RNA, 18 nt, Artificial Sequence
  Description of Artificial Sequence: Synthetic oligonucleotide
gcgagaacugccucauau

SEQ ID NO: 2393 - RNA, 18 nt, Artificial Sequence
  Description of Artificial Sequence: Synthetic oligonucleotide
acucugcgagaacugccu

SEQ ID NO: 2394 - RNA, 18 nt, Artificial Sequence
  Description of Artificial Sequence: Synthetic oligonucleotide
ucagcacucugcgagaac

SEQ ID NO: 2395 - RNA, 18 nt, Artificial Sequence
  Description of Artificial Sequence: Synthetic oligonucleotide
cgaucucagcacucugcg

SEQ ID NO: 2396 - RNA, 18 nt, Artificial Sequence
  Description of Artificial Sequence: Synthetic oligonucleotide
agguacgaucucagcacu

SEQ ID NO: 2397 - RNA, 18 nt, Artificial Sequence
  Description of Artificial Sequence: Synthetic oligonucleotide
cugccagguacgaucuca

SEQ ID NO: 2398 - RNA, 18 nt, Artificial Sequence
  Description of Artificial Sequence: Synthetic oligonucleotide
accagcugccagguacga

SEQ ID NO: 2399 - RNA, 18 nt, Artificial Sequence
  Description of Artificial Sequence: Synthetic oligonucleotide
cccacaccagcugccagg

SEQ ID NO: 2400 - RNA, 18 nt, Artificial Sequence
  Description of Artificial Sequence: Synthetic oligonucleotide
guagccccacaccagcug

SEQ ID NO: 2401 - RNA, 18 nt, Artificial Sequence
  Description of Artificial Sequence: Synthetic oligonucleotide
acaccguagccccacacc

SEQ ID NO: 2402 - RNA, 18 nt, Artificial Sequence
  Description of Artificial Sequence: Synthetic oligonucleotide
aaacaacaccguagcccc

SEQ ID NO: 2403 - RNA, 18 nt, Artificial Sequence
  Description of Artificial Sequence: Synthetic oligonucleotide
gggcaaaacaacaccgua

SEQ ID NO: 2404 - RNA, 18 nt, Artificial Sequence
  Description of Artificial Sequence: Synthetic oligonucleotide
ugcaagggcaaaacaaca

SEQ ID NO: 2405 - RNA, 18 nt, Artificial Sequence
  Description of Artificial Sequence: Synthetic oligonucleotide
aagggugcaagggcaaaa

SEQ ID NO: 2406 - RNA, 18 nt, Artificial Sequence
  Description of Artificial Sequence: Synthetic oligonucleotide
cccgaaagggugcaaggg

SEQ ID NO: 2407 - RNA, 18 nt, Artificial Sequence
  Description of Artificial Sequence: Synthetic oligonucleotide
guggccccgaaagggugc

SEQ ID NO: 2408 - RNA, 18 nt, Artificial Sequence
  Description of Artificial Sequence: Synthetic oligonucleotide
gggaguggccccgaaagg

SEQ ID NO: 2409 - RNA, 18 nt, Artificial Sequence
  Description of Artificial Sequence: Synthetic oligonucleotide
ggaaugcagugagcaggg

SEQ ID NO: 2410 - RNA, 18 nt, Artificial Sequence
  Description of Artificial Sequence: Synthetic oligonucleotide
cagauggaaugcagugag

SEQ ID NO: 2411 - RNA, 18 nt, Artificial Sequence
  Description of Artificial Sequence: Synthetic oligonucleotide
cagcacagauggaaugca

SEQ ID NO: 2412 - RNA, 18 nt, Artificial Sequence
  Description of Artificial Sequence: Synthetic oligonucleotide
aagaccagcacagaugga

SEQ ID NO: 2413 - RNA, 18 nt, Artificial Sequence
  Description of Artificial Sequence: Synthetic oligonucleotide
cagccaagaccagcacag

SEQ ID NO: 2414 - RNA, 18 nt, Artificial Sequence
  Description of Artificial Sequence: Synthetic oligonucleotide
agggucagccaagaccag

SEQ ID NO: 2415 - RNA, 18 nt, Artificial Sequence
  Description of Artificial Sequence: Synthetic oligonucleotide
uguucagggucagccaag

SEQ ID NO: 2416 - RNA, 18 nt, Artificial Sequence
  Description of Artificial Sequence: Synthetic oligonucleotide
cuggguguucagggucag

SEQ ID NO: 2417 - RNA, 18 nt, Artificial Sequence
  Description of Artificial Sequence: Synthetic oligonucleotide
gaggccuggguguucagg

SEQ ID NO: 2418 - RNA, 18 nt, Artificial Sequence
  Description of Artificial Sequence: Synthetic oligonucleotide
accaagaggccugggugu

SEQ ID NO: 2419 - RNA, 18 nt, Artificial Sequence
  Description of Artificial Sequence: Synthetic oligonucleotide
ggaacaccaagaggccug

SEQ ID NO: 2420 - RNA, 18 nt, Artificial Sequence
  Description of Artificial Sequence: Synthetic oligonucleotide
aggcaggaacaccaagag

SEQ ID NO: 2421 - RNA, 18 nt, Artificial Sequence
  Description of Artificial Sequence: Synthetic oligonucleotide
gggaggcaggaacaccaa

SEQ ID NO: 2422 - RNA, 18 nt, Artificial Sequence
  Description of Artificial Sequence: Synthetic oligonucleotide
agaaguggccgaccaggg

SEQ ID NO: 2423 - RNA, 18 nt, Artificial Sequence
  Description of Artificial Sequence: Synthetic oligonucleotide
ggaguagaaguggccgac

SEQ ID NO: 2424 - RNA, 18 nt, Artificial Sequence
  Description of Artificial Sequence: Synthetic oligonucleotide
augaaggaguagaagugg

SEQ ID NO: 2425 - RNA, 18 nt, Artificial Sequence
  Description of Artificial Sequence: Synthetic oligonucleotide
gggacaugaaggaguaga

SEQ ID NO: 2426 - RNA, 18 nt, Artificial Sequence
  Description of Artificial Sequence: Synthetic oligonucleotide
gaacaccaagaggccugg

SEQ ID NO: 2427 - RNA, 18 nt, Artificial Sequence
  Description of Artificial Sequence: Synthetic oligonucleotide
ggcaggaacaccaagagg

SEQ ID NO: 2428 - RNA, 18 nt, Artificial Sequence
  Description of Artificial Sequence: Synthetic oligonucleotide
agaaguggccgaccaggg

SEQ ID NO: 2429 - RNA, 18 nt, Artificial Sequence
  Description of Artificial Sequence: Synthetic oligonucleotide
ggaguagaaguggccgac

SEQ ID NO: 2430 - RNA, 18 nt, Artificial Sequence
  Description of Artificial Sequence: Synthetic oligonucleotide
augaaggaguagaagugg

SEQ ID NO: 2431 - RNA, 18 nt, Artificial Sequence
  Description of Artificial Sequence: Synthetic oligonucleotide
gggacaugaaggaguaga

SEQ ID NO: 2432 - RNA, 18 nt, Artificial Sequence
  Description of Artificial Sequence: Synthetic oligonucleotide
cagcugggacaugaagga

SEQ ID NO: 2433 - RNA, 18 nt, Artificial Sequence
  Description of Artificial Sequence: Synthetic oligonucleotide
cugagcagcugggacaug

SEQ ID NO: 2434 - RNA, 18 nt, Artificial Sequence
  Description of Artificial Sequence: Synthetic oligonucleotide
cccuucugagcagcuggg

SEQ ID NO: 2435 - RNA, 18 nt, Artificial Sequence
  Description of Artificial Sequence: Synthetic oligonucleotide
gacggcccuucugagcag

SEQ ID NO: 2436 - RNA, 18 nt, Artificial Sequence
  Description of Artificial Sequence: Synthetic oligonucleotide
gaguggacggcccuucug

SEQ ID NO: 2437 - RNA, 18 nt, Artificial Sequence
  Description of Artificial Sequence: Synthetic oligonucleotide
ugugagaguggacggccc

SEQ ID NO: 2438 - RNA, 18 nt, Artificial Sequence
  Description of Artificial Sequence: Synthetic oligonucleotide
gagccugugagaguggac

SEQ ID NO: 2439 - RNA, 18 nt, Artificial Sequence
  Description of Artificial Sequence: Synthetic oligonucleotide
caggagagccugugagag

SEQ ID NO: 2440 - RNA, 18 nt, Artificial Sequence
  Description of Artificial Sequence: Synthetic oligonucleotide
aaacccaggagagccugu

SEQ ID NO: 2441 - RNA, 18 nt, Artificial Sequence
  Description of Artificial Sequence: Synthetic oligonucleotide
ggacaaggccugaguggg

SEQ ID NO: 2442 - RNA, 18 nt, Artificial Sequence
  Description of Artificial Sequence: Synthetic oligonucleotide
acugaggacaaggccuga

SEQ ID NO: 2443 - RNA, 18 nt, Artificial Sequence
  Description of Artificial Sequence: Synthetic oligonucleotide
cagagacugaggacaagg

SEQ ID NO: 2444 - RNA, 18 nt, Artificial Sequence
  Description of Artificial Sequence: Synthetic oligonucleotide
gugcucagagacugagga

SEQ ID NO: 2445 - RNA, 18 nt, Artificial Sequence
  Description of Artificial Sequence: Synthetic oligonucleotide
gccuugugcucagagacu

SEQ ID NO: 2446 - RNA, 18 nt, Artificial Sequence
  Description of Artificial Sequence: Synthetic oligonucleotide
agacagccuugugcucag

SEQ ID NO: 2447 - RNA, 18 nt, Artificial Sequence
  Description of Artificial Sequence: Synthetic oligonucleotide
agggcagacagccuugug

SEQ ID NO: 2448 - RNA, 18 nt, Artificial Sequence
  Description of Artificial Sequence: Synthetic oligonucleotide
ggugcagggcagacagcc

SEQ ID NO: 2449 - RNA, 18 nt, Artificial Sequence
  Description of Artificial Sequence: Synthetic oligonucleotide
cacucggugcagggcaga

SEQ ID NO: 2450 - RNA, 18 nt, Artificial Sequence
  Description of Artificial Sequence: Synthetic oligonucleotide
cccugcacucggugcagg

SEQ ID NO: 2451 - RNA, 18 nt, Artificial Sequence
  Description of Artificial Sequence: Synthetic oligonucleotide
ccgaccccugcacucggu

SEQ ID NO: 2452 - RNA, 18 nt, Artificial Sequence
  Description of Artificial Sequence: Synthetic oligonucleotide
ccugcccgaccccugcac

SEQ ID NO: 2453 - RNA, 18 nt, Artificial Sequence
  Description of Artificial Sequence: Synthetic oligonucleotide
cagcuccugcccgacccc

SEQ ID NO: 2454 - RNA, 18 nt, Artificial Sequence
  Description of Artificial Sequence: Synthetic oligonucleotide
ugacacagcuccugcccg

SEQ ID NO: 2455 - RNA, 18 nt, Artificial Sequence
  Description of Artificial Sequence: Synthetic oligonucleotide
ggguggcgcagagcaggg

SEQ ID NO: 2456 - RNA, 18 nt, Artificial Sequence
  Description of Artificial Sequence: Synthetic oligonucleotide
acagcggguggcgcagag

SEQ ID NO: 2457 - RNA, 18 nt, Artificial Sequence
  Description of Artificial Sequence: Synthetic oligonucleotide
cuggcacagcggguggcg

SEQ ID NO: 2458 - RNA, 18 nt, Artificial Sequence
  Description of Artificial Sequence: Synthetic oligonucleotide
gggaccuggcacagcggg

SEQ ID NO: 2459 - RNA, 18 nt, Artificial Sequence
  Description of Artificial Sequence: Synthetic oligonucleotide
gugucgggaccuggcaca

SEQ ID NO: 2460 - RNA, 18 nt, Artificial Sequence
  Description of Artificial Sequence: Synthetic oligonucleotide
gcugugugucgggaccug

SEQ ID NO: 2461 - RNA, 18 nt, Artificial Sequence
  Description of Artificial Sequence: Synthetic oligonucleotide
caacugcugugugucggg

SEQ ID NO: 2462 - RNA, 18 nt, Artificial Sequence
  Description of Artificial Sequence: Synthetic oligonucleotide
gggagcaacugcugugug

SEQ ID NO: 2463 - RNA, 18 nt, Artificial Sequence
  Description of Artificial Sequence: Synthetic oligonucleotide
cgcagagcggcguauggg

SEQ ID NO: 2464 - RNA, 18 nt, Artificial Sequence
  Description of Artificial Sequence: Synthetic oligonucleotide
gaccgcagagcggcguau

SEQ ID NO: 2465 - RNA, 18 nt, Artificial Sequence
  Description of Artificial Sequence: Synthetic oligonucleotide
cggccgaccgcagagcgg

SEQ ID NO: 2466 - RNA, 18 nt, Artificial Sequence
  Description of Artificial Sequence: Synthetic oligonucleotide
ugcaccggccgaccgcag

SEQ ID NO: 2467 - RNA, 18 nt, Artificial Sequence
  Description of Artificial Sequence: Synthetic oligonucleotide
ccggaugcaccggccgac

SEQ ID NO: 2468 - RNA, 18 nt, Artificial Sequence
  Description of Artificial Sequence: Synthetic oligonucleotide
gcauuguacagggcaggg

SEQ ID NO: 2469 - RNA, 18 nt, Artificial Sequence
  Description of Artificial Sequence: Synthetic oligonucleotide
caucagcauuguacaggg

SEQ ID NO: 2470 - RNA, 18 nt, Artificial Sequence
  Description of Artificial Sequence: Synthetic oligonucleotide
ugcagcaucagcauugua

SEQ ID NO: 2471 - RNA, 18 nt, Artificial Sequence
  Description of Artificial Sequence: Synthetic oligonucleotide
aggucugcagcaucagca

SEQ ID NO: 2472 - RNA, 18 nt, Artificial Sequence
  Description of Artificial Sequence: Synthetic oligonucleotide
gagacaggucugcagcau

SEQ ID NO: 2473 - RNA, 18 nt, Artificial Sequence
  Description of Artificial Sequence: Synthetic oligonucleotide
ugcaagagacaggucugc

SEQ ID NO: 2474 - RNA, 18 nt, Artificial Sequence
  Description of Artificial Sequence: Synthetic oligonucleotide
cgcccugcaagagacagg

SEQ ID NO: 2475 - RNA, 18 nt, Artificial Sequence
  Description of Artificial Sequence: Synthetic oligonucleotide
agaggcgcccugcaagag

SEQ ID NO: 2476 - RNA, 18 nt, Artificial Sequence
  Description of Artificial Sequence: Synthetic oligonucleotide
cccacagaggcgcccugc

SEQ ID NO: 2477 - RNA, 18 nt, Artificial Sequence
  Description of Artificial Sequence: Synthetic oligonucleotide
uccuucccacagaggcgc

SEQ ID NO: 2478 - RNA, 18 nt, Artificial Sequence
  Description of Artificial Sequence: Synthetic oligonucleotide
cccucuccuucccacaga

SEQ ID NO: 2479 - RNA, 18 nt, Artificial Sequence
  Description of Artificial Sequence: Synthetic oligonucleotide
uggaccccucuccuuccc

SEQ ID NO: 2480 - RNA, 18 nt, Artificial Sequence
  Description of Artificial Sequence: Synthetic oligonucleotide
agcccuggaccccucucc

SEQ ID NO: 2481 - RNA, 18 nt, Artificial Sequence
  Description of Artificial Sequence: Synthetic oligonucleotide
acuccagcccuggacccc

SEQ ID NO: 2482 - RNA, 18 nt, Artificial Sequence
  Description of Artificial Sequence: Synthetic oligonucleotide
cccggacuccagcccugg

SEQ ID NO: 2483 - RNA, 18 nt, Artificial Sequence
  Description of Artificial Sequence: Synthetic oligonucleotide
gggcacccggacuccagc

SEQ ID NO: 2484 - RNA, 18 nt, Artificial Sequence
  Description of Artificial Sequence: Synthetic oligonucleotide
agucccugaagugcaggg

SEQ ID NO: 2485 - RNA, 18 nt, Artificial Sequence
  Description of Artificial Sequence: Synthetic oligonucleotide
aagucccugaagugcagg

SEQ ID NO: 2486 - RNA, 18 nt, Artificial Sequence
  Description of Artificial Sequence: Synthetic oligonucleotide
ccaagaagucccugaagu

SEQ ID NO: 2487 - RNA, 18 nt, Artificial Sequence
  Description of Artificial Sequence: Synthetic oligonucleotide
ggcugccaagaagucccu

SEQ ID NO: 2488 - RNA, 18 nt, Artificial Sequence
  Description of Artificial Sequence: Synthetic oligonucleotide
cacacggcugccaagaag

SEQ ID NO: 2489 - RNA, 18 nt, Artificial Sequence
  Description of Artificial Sequence: Synthetic oligonucleotide
ucgcccacacggcugcca

SEQ ID NO: 2490 - RNA, 18 nt, Artificial Sequence
  Description of Artificial Sequence: Synthetic oligonucleotide
cagcgucgcccacacggc

SEQ ID NO: 2491 - RNA, 18 nt, Artificial Sequence
  Description of Artificial Sequence: Synthetic oligonucleotide
ccugccagcgucgcccac

SEQ ID NO: 2492 - RNA, 18 nt, Artificial Sequence
  Description of Artificial Sequence: Synthetic oligonucleotide
cagagccugccagcgucg

SEQ ID NO: 2493 - RNA, 18 nt, Artificial Sequence
  Description of Artificial Sequence: Synthetic oligonucleotide
aucagcagagccugccag

SEQ ID NO: 2494 - RNA, 18 nt, Artificial Sequence
  Description of Artificial Sequence: Synthetic oligonucleotide
acaggaucagcagagccu

SEQ ID NO: 2495 - RNA, 18 nt, Artificial Sequence
  Description of Artificial Sequence: Synthetic oligonucleotide
ggacccccaaacgcucgc

SEQ ID NO: 2496 - RNA, 18 nt, Artificial Sequence
  Description of Artificial Sequence: Synthetic oligonucleotide
ucugaggacccccaaacg

SEQ ID NO: 2497 - RNA, 18 nt, Artificial Sequence
  Description of Artificial Sequence: Synthetic oligonucleotide
agggcucugaggaccccc

SEQ ID NO: 2498 - RNA, 18 nt, Artificial Sequence
  Description of Artificial Sequence: Synthetic oligonucleotide
agaagagggcucugagga

SEQ ID NO: 2499 - RNA, 18 nt, Artificial Sequence
  Description of Artificial Sequence: Synthetic oligonucleotide
cuuaaagaagagggcucu

SEQ ID NO: 2500 - RNA, 18 nt, Artificial Sequence
  Description of Artificial Sequence: Synthetic oligonucleotide
augaccuuaaagaagagg

SEQ ID NO: 2501 - RNA, 18 nt, Artificial Sequence
  Description of Artificial Sequence: Synthetic oligonucleotide
ccuugaugaccuuaaaga

SEQ ID NO: 2502 - RNA, 18 nt, Artificial Sequence
  Description of Artificial Sequence: Synthetic oligonucleotide
guaauccuugaugaccuu

SEQ ID NO: 2503 - RNA, 18 nt, Artificial Sequence
  Description of Artificial Sequence: Synthetic oligonucleotide
gaaggguaauccuugaug

SEQ ID NO: 2504 - RNA, 18 nt, Artificial Sequence
  Description of Artificial Sequence: Synthetic oligonucleotide
cguuggaaggguaauccu

SEQ ID NO: 2505 - RNA, 18 nt, Artificial Sequence
  Description of Artificial Sequence: Synthetic oligonucleotide
gucuucguuggaagggua

SEQ ID NO: 2506 - RNA, 18 nt, Artificial Sequence
  Description of Artificial Sequence: Synthetic oligonucleotide
ugaaggucuucguuggaa

SEQ ID NO: 2507 - RNA, 18 nt, Artificial Sequence
  Description of Artificial Sequence: Synthetic oligonucleotide
uuucgugaaggucuucgu

SEQ ID NO: 2508 - RNA, 18 nt, Artificial Sequence
  Description of Artificial Sequence: Synthetic oligonucleotide
cagccuuucgugaagguc

SEQ ID NO: 2509 - RNA, 18 nt, Artificial Sequence
  Description of Artificial Sequence: Synthetic oligonucleotide
accuccagccuuucguga

SEQ ID NO: 2510 - RNA, 18 nt, Artificial Sequence
  Description of Artificial Sequence: Synthetic oligonucleotide
ugaaaaccuccagccuuu

SEQ ID NO: 2511 - RNA, 18 nt, Artificial Sequence
  Description of Artificial Sequence: Synthetic oligonucleotide
ggccuugaaaaccuccag

SEQ ID NO: 2512 - RNA, 18 nt, Artificial Sequence
  Description of Artificial Sequence: Synthetic oligonucleotide
gugagggccuugaaaacc

SEQ ID NO: 2513 - RNA, 18 nt, Artificial Sequence
  Description of Artificial Sequence: Synthetic oligonucleotide
ugucugugagggccuuga

SEQ ID NO: 2514 - RNA, 18 nt, Artificial Sequence
  Description of Artificial Sequence: Synthetic oligonucleotide
cccauugucugugagggc

SEQ ID NO: 2515 - RNA, 18 nt, Artificial Sequence
  Description of Artificial Sequence: Synthetic oligonucleotide
ugucucccauugucugug

SEQ ID NO: 2516 - RNA, 18 nt, Artificial Sequence
  Description of Artificial Sequence: Synthetic oligonucleotide
ugaugugucucccauugu

SEQ ID NO: 2517 - RNA, 18 nt, Artificial Sequence
  Description of Artificial Sequence: Synthetic oligonucleotide
guaggugaugugucuccc

SEQ ID NO: 2518 - RNA, 18 nt, Artificial Sequence
  Description of Artificial Sequence: Synthetic oligonucleotide
uccaaguaggugaugugu

SEQ ID NO: 2519 - RNA, 18 nt, Artificial Sequence
  Description of Artificial Sequence: Synthetic oligonucleotide
cuuccuccaaguagguga

SEQ ID NO: 2520 - RNA, 18 nt, Artificial Sequence
  Description of Artificial Sequence: Synthetic oligonucleotide
cagcucuuccuccaagua

SEQ ID NO: 2521 - RNA, 18 nt, Artificial Sequence
  Description of Artificial Sequence: Synthetic oligonucleotide
ucaucagccagcuggugu

SEQ ID NO: 2522 - RNA, 18 nt, Artificial Sequence
  Description of Artificial Sequence: Synthetic oligonucleotide
caggcucaucagccagcu

SEQ ID NO: 2523 - RNA, 18 nt, Artificial Sequence
  Description of Artificial Sequence: Synthetic oligonucleotide
uucuccaggcucaucagc

SEQ ID NO: 2524 - RNA, 18 nt, Artificial Sequence
  Description of Artificial Sequence: Synthetic oligonucleotide
gcggguucuccaggcuca

SEQ ID NO: 2525 - RNA, 18 nt, Artificial Sequence
  Description of Artificial Sequence: Synthetic oligonucleotide
gcugagcggguucuccag

SEQ ID NO: 2526 - RNA, 18 nt, Artificial Sequence
  Description of Artificial Sequence: Synthetic oligonucleotide
aaagggcugagcggguuc

SEQ ID NO: 2527 - RNA, 18 nt, Artificial Sequence
  Description of Artificial Sequence: Synthetic oligonucleotide
aggagaaagggcugagcg

SEQ ID NO: 2528 - RNA, 18 nt, Artificial Sequence
  Description of Artificial Sequence: Synthetic oligonucleotide
guccgaggagaaagggcu

SEQ ID NO: 2529 - RNA, 18 nt, Artificial Sequence
  Description of Artificial Sequence: Synthetic oligonucleotide
uugauguccgaggagaaa

SEQ ID NO: 2530 - RNA, 18 nt, Artificial Sequence
  Description of Artificial Sequence: Synthetic oligonucleotide
uguuguugauguccgagg

SEQ ID NO: 2531 - RNA, 18 nt, Artificial Sequence
  Description of Artificial Sequence: Synthetic oligonucleotide
gggcauguuguugauguc

SEQ ID NO: 2532 - RNA, 18 nt, Artificial Sequence
  Description of Artificial Sequence: Synthetic oligonucleotide
uagacagcuccugcaggg

SEQ ID NO: 2533 - RNA, 18 nt, Artificial Sequence
  Description of Artificial Sequence: Synthetic oligonucleotide
gcguuagacagcuccugc

SEQ ID NO: 2534 - RNA, 18 nt, Artificial Sequence
  Description of Artificial Sequence: Synthetic oligonucleotide
ugagggcguuagacagcu

SEQ ID NO: 2535 - RNA, 18 nt, Artificial Sequence
  Description of Artificial Sequence: Synthetic oligonucleotide
cgccaugagggcguuaga

SEQ ID NO: 2536 - RNA, 18 nt, Artificial Sequence
  Description of Artificial Sequence: Synthetic oligonucleotide
ucagccgccaugagggcg

SEQ ID NO: 2537 - RNA, 18 nt, Artificial Sequence
  Description of Artificial Sequence: Synthetic oligonucleotide
agcgcucagccgccauga

SEQ ID NO: 2538 - RNA, 18 nt, Artificial Sequence
  Description of Artificial Sequence: Synthetic oligonucleotide
cuugaagcgcucagccgc

SEQ ID NO: 2539 - RNA, 18 nt, Artificial Sequence
  Description of Artificial Sequence: Synthetic oligonucleotide
ugcuccuugaagcgcuca

SEQ ID NO: 2540 - RNA, 18 nt, Artificial Sequence
  Description of Artificial Sequence: Synthetic oligonucleotide
cccggugcuccuugaagc

SEQ ID NO: 2541 - RNA, 18 nt, Artificial Sequence
  Description of Artificial Sequence: Synthetic oligonucleotide
ugugucccggugcuccuu

SEQ ID NO: 2542 - RNA, 18 nt, Artificial Sequence
  Description of Artificial Sequence: Synthetic oligonucleotide
agggcugugucccggugc

SEQ ID NO: 2543 - RNA, 18 nt, Artificial Sequence
  Description of Artificial Sequence: Synthetic oligonucleotide
uguacagggcuguguccc

SEQ ID NO: 2544 - RNA, 18 nt, Artificial Sequence
  Description of Artificial Sequence: Synthetic oligonucleotide
ugacuuguacagggcugu

SEQ ID NO: 2545 - RNA, 18 nt, Artificial Sequence
  Description of Artificial Sequence: Synthetic oligonucleotide
gacagugacuuguacagg

SEQ ID NO: 2546 - RNA, 18 nt, Artificial Sequence
  Description of Artificial Sequence: Synthetic oligonucleotide
gcaccgacagugacuugu

SEQ ID NO: 2547 - RNA, 18 nt, Artificial Sequence
  Description of Artificial Sequence: Synthetic oligonucleotide
ugccggcaccgacaguga

SEQ ID NO: 2548 - RNA, 18 nt, Artificial Sequence
  Description of Artificial Sequence: Synthetic oligonucleotide
cuggcugccggcaccgac

SEQ ID NO: 2549 - RNA, 18 nt, Artificial Sequence
  Description of Artificial Sequence: Synthetic oligonucleotide
ccgugcuggcugccggca

SEQ ID NO: 2550 - RNA, 18 nt, Artificial Sequence
  Description of Artificial Sequence: Synthetic oligonucleotide
uuuggccgugcuggcugc

SEQ ID NO: 2551 - RNA, 18 nt, Artificial Sequence
  Description of Artificial Sequence: Synthetic oligonucleotide
gagcgaggcagaggaggg

SEQ ID NO: 2552 - RNA, 18 nt, Artificial Sequence
  Description of Artificial Sequence: Synthetic oligonucleotide
uguuggagcgaggcagag

SEQ ID NO: 2553 - RNA, 18 nt, Artificial Sequence
  Description of Artificial Sequence: Synthetic oligonucleotide
ccaaggcccgccaugcca

SEQ ID NO: 2554 - RNA, 18 nt, Artificial Sequence
  Description of Artificial Sequence: Synthetic oligonucleotide
ccgugccaaggcccgcca

SEQ ID NO: 2555 - RNA, 18 nt, Artificial Sequence
  Description of Artificial Sequence: Synthetic oligonucleotide
agagcccgugccaaggcc

SEQ ID NO: 2556 - RNA, 18 nt, Artificial Sequence
  Description of Artificial Sequence: Synthetic oligonucleotide
ggagcagagcccgugcca

SEQ ID NO: 2557 - RNA, 18 nt, Artificial Sequence
  Description of Artificial Sequence: Synthetic oligonucleotide
cagugggagcagagcccg

SEQ ID NO: 2558 - RNA, 18 nt, Artificial Sequence
  Description of Artificial Sequence: Synthetic oligonucleotide
caggccagugggagcaga

SEQ ID NO: 2559 - RNA, 18 nt, Artificial Sequence
  Description of Artificial Sequence: Synthetic oligonucleotide
agcaccaggccaguggga

SEQ ID NO: 2560 - RNA, 18 nt, Artificial Sequence
  Description of Artificial Sequence: Synthetic oligonucleotide
ccgggagcaccaggccag

SEQ ID NO: 2561 - RNA, 18 nt, Artificial Sequence
  Description of Artificial Sequence: Synthetic oligonucleotide
cgucaccgggagcaccag

SEQ ID NO: 2562 - RNA, 18 nt, Artificial Sequence
  Description of Artificial Sequence: Synthetic oligonucleotide
auugccgucaccgggagc

SEQ ID NO: 2563 - RNA, 18 nt, Artificial Sequence
  Description of Artificial Sequence: Synthetic oligonucleotide
gccacauugccgucaccg

SEQ ID NO: 2564 - RNA, 18 nt, Artificial Sequence
  Description of Artificial Sequence: Synthetic oligonucleotide
gaggagccacauugccgu

SEQ ID NO: 2565 - RNA, 18 nt, Artificial Sequence
  Description of Artificial Sequence: Synthetic oligonucleotide
gcagagaggagccacauu

SEQ ID NO: 2566 - RNA, 18 nt, Artificial Sequence
  Description of Artificial Sequence: Synthetic oligonucleotide
ccucagcagagaggagcc

SEQ ID NO: 2567 - RNA, 18 nt, Artificial Sequence
  Description of Artificial Sequence: Synthetic oligonucleotide
ggcgcccucagcagagag

SEQ ID NO: 2568 - RNA, 18 nt, Artificial Sequence
  Description of Artificial Sequence: Synthetic oligonucleotide
gugugggcgcccucagca

SEQ ID NO: 2569 - RNA, 18 nt, Artificial Sequence
  Description of Artificial Sequence: Synthetic oligonucleotide
cagccgugugggcgcccu

SEQ ID NO: 2570 - RNA, 18 nt, Artificial Sequence
  Description of Artificial Sequence: Synthetic oligonucleotide
acucccagccgugugggc

SEQ ID NO: 2571 - RNA, 18 nt, Artificial Sequence
  Description of Artificial Sequence: Synthetic oligonucleotide
ggaccacucccagccgug

SEQ ID NO: 2572 - RNA, 18 nt, Artificial Sequence
  Description of Artificial Sequence: Synthetic oligonucleotide
gccagggaccacucccag

SEQ ID NO: 2573 - RNA, 18 nt, Artificial Sequence
  Description of Artificial Sequence: Synthetic oligonucleotide
ggcaggccagggaccacu

SEQ ID NO: 2574 - RNA, 18 nt, Artificial Sequence
  Description of Artificial Sequence: Synthetic oligonucleotide
gcugaggcaggccaggga

SEQ ID NO: 2575 - RNA, 18 nt, Artificial Sequence
  Description of Artificial Sequence: Synthetic oligonucleotide
auggugcugaggcaggcc

SEQ ID NO: 2576 - RNA, 18 nt, Artificial Sequence
  Description of Artificial Sequence: Synthetic oligonucleotide
gaacaauggugcugaggc

SEQ ID NO: 2577 - RNA, 18 nt, Artificial Sequence
  Description of Artificial Sequence: Synthetic oligonucleotide
ccggagaacaauggugcu

SEQ ID NO: 2578 - RNA, 18 nt, Artificial Sequence
  Description of Artificial Sequence: Synthetic oligonucleotide
aaacaccggagaacaaug

SEQ ID NO: 2579 - RNA, 18 nt, Artificial Sequence
  Description of Artificial Sequence: Synthetic oligonucleotide
cucccaaacaccggagaa

SEQ ID NO: 2580 - RNA, 18 nt, Artificial Sequence
  Description of Artificial Sequence: Synthetic oligonucleotide
gccuccucccaaacaccg

SEQ ID NO: 2581 - RNA, 18 nt, Artificial Sequence
  Description of Artificial Sequence: Synthetic oligonucleotide
ggucagccuccucccaaa

SEQ ID NO: 2582 - RNA, 18 nt, Artificial Sequence
  Description of Artificial Sequence: Synthetic oligonucleotide
ccacgggucagccuccuc

SEQ ID NO: 2583 - RNA, 18 nt, Artificial Sequence
  Description of Artificial Sequence: Synthetic oligonucleotide
accucccacgggucagcc

SEQ ID NO: 2584 - RNA, 18 nt, Artificial Sequence
  Description of Artificial Sequence: Synthetic oligonucleotide
cagacaccucccacgggu

SEQ ID NO: 2585 - RNA, 18 nt, Artificial Sequence
  Description of Artificial Sequence: Synthetic oligonucleotide
cagggcagacaccuccca

SEQ ID NO: 2586 - RNA, 18 nt, Artificial Sequence
  Description of Artificial Sequence: Synthetic oligonucleotide
cugagcagggcagacacc

SEQ ID NO: 2587 - RNA, 18 nt, Artificial Sequence
  Description of Artificial Sequence: Synthetic oligonucleotide
gcuuccugagcagggcag

SEQ ID NO: 2588 - RNA, 18 nt, Artificial Sequence
  Description of Artificial Sequence: Synthetic oligonucleotide
ccccagcuuccugagcag

SEQ ID NO: 2589 - RNA, 18 nt, Artificial Sequence
  Description of Artificial Sequence: Synthetic oligonucleotide
gccagccccagcuuccug

SEQ ID NO: 2590 - RNA, 18 nt, Artificial Sequence
  Description of Artificial Sequence: Synthetic oligonucleotide
aagcugccagccccagcu

SEQ ID NO: 2591 - RNA, 18 nt, Artificial Sequence
  Description of Artificial Sequence: Synthetic oligonucleotide
uucugaagcugccagccc

SEQ ID NO: 2592 - RNA, 18 nt, Artificial Sequence
  Description of Artificial Sequence: Synthetic oligonucleotide
acugcuucugaagcugcc

SEQ ID NO: 2593 - RNA, 18 nt, Artificial Sequence
  Description of Artificial Sequence: Synthetic oligonucleotide
ccccuacugcuucugaag

SEQ ID NO: 2594 - RNA, 18 nt, Artificial Sequence
  Description of Artificial Sequence: Synthetic oligonucleotide
cagggccccuacugcuuc

SEQ ID NO: 2595 - RNA, 18 nt, Artificial Sequence
  Description of Artificial Sequence: Synthetic oligonucleotide
cuccacagggccccuacu

SEQ ID NO: 2596 - RNA, 18 nt, Artificial Sequence
  Description of Artificial Sequence: Synthetic oligonucleotide
agaggcuccacagggccc

SEQ ID NO: 2597 - RNA, 18 nt, Artificial Sequence
  Description of Artificial Sequence: Synthetic oligonucleotide
ugggcagaggcuccacag

SEQ ID NO: 2598 - RNA, 18 nt, Artificial Sequence
  Description of Artificial Sequence: Synthetic oligonucleotide
gaugcugggcagaggcuc

SEQ ID NO: 2599 - RNA, 18 nt, Artificial Sequence
  Description of Artificial Sequence: Synthetic oligonucleotide
cggaggaugcugggcaga

SEQ ID NO: 2600 - RNA, 18 nt, Artificial Sequence
  Description of Artificial Sequence: Synthetic oligonucleotide
ccccacggaggaugcugg

SEQ ID NO: 2601 - RNA, 18 nt, Artificial Sequence
  Description of Artificial Sequence: Synthetic oligonucleotide
ggacuccccacggaggau

SEQ ID NO: 2602 - RNA, 18 nt, Artificial Sequence
  Description of Artificial Sequence: Synthetic oligonucleotide
gugcuggacuccccacgg

SEQ ID NO: 2603 - RNA, 18 nt, Artificial Sequence
  Description of Artificial Sequence: Synthetic oligonucleotide
ccgcagugcuggacuccc

SEQ ID NO: 2604 - RNA, 18 nt, Artificial Sequence
  Description of Artificial Sequence: Synthetic oligonucleotide
ggagcccgcagugcugga

SEQ ID NO: 2605 - RNA, 18 nt, Artificial Sequence
  Description of Artificial Sequence: Synthetic oligonucleotide
cuccuggagcccgcagug

SEQ ID NO: 2606 - RNA, 18 nt, Artificial Sequence
  Description of Artificial Sequence: Synthetic oligonucleotide
agagccuccuggagcccg

SEQ ID NO: 2607 - RNA, 18 nt, Artificial Sequence
  Description of Artificial Sequence: Synthetic oligonucleotide
gccgcagagccuccugga

SEQ ID NO: 2608 - RNA, 18 nt, Artificial Sequence
  Description of Artificial Sequence: Synthetic oligonucleotide
aggcugccgcagagccuc

SEQ ID NO: 2609 - RNA, 18 nt, Artificial Sequence
  Description of Artificial Sequence: Synthetic oligonucleotide
gagggaggcugccgcaga

SEQ ID NO: 2610 - RNA, 18 nt, Artificial Sequence
  Description of Artificial Sequence: Synthetic oligonucleotide
gcagggagggaggcugcc

SEQ ID NO: 2611 - RNA, 18 nt, Artificial Sequence
  Description of Artificial Sequence: Synthetic oligonucleotide
cccaggcagggagggagg

SEQ ID NO: 2612 - RNA, 18 nt, Artificial Sequence
  Description of Artificial Sequence: Synthetic oligonucleotide
cugggcccaggcagggag

SEQ ID NO: 2613 - RNA, 18 nt, Artificial Sequence
  Description of Artificial Sequence: Synthetic oligonucleotide
caaaccugggcccaggca

SEQ ID NO: 2614 - RNA, 18 nt, Artificial Sequence
  Description of Artificial Sequence: Synthetic oligonucleotide
guguccaaaccugggccc

SEQ ID NO: 2615 - RNA, 18 nt, Artificial Sequence
  Description of Artificial Sequence: Synthetic oligonucleotide
cucagguguccaaaccug

SEQ ID NO: 2616 - RNA, 18 nt, Artificial Sequence
  Description of Artificial Sequence: Synthetic oligonucleotide
gcgggcucagguguccaa

SEQ ID NO: 2617 - RNA, 18 nt, Artificial Sequence
  Description of Artificial Sequence: Synthetic oligonucleotide
cgcaggcgggcucaggug

SEQ ID NO: 2618 - RNA, 18 nt, Artificial Sequence
  Description of Artificial Sequence: Synthetic oligonucleotide
gagugcgcaggcgggcuc

SEQ ID NO: 2619 - RNA, 18 nt, Artificial Sequence
  Description of Artificial Sequence: Synthetic oligonucleotide
gcccagagugcgcaggcg

SEQ ID NO: 2620 - RNA, 18 nt, Artificial Sequence
  Description of Artificial Sequence: Synthetic oligonucleotide
gggcccagagugcgcagg

SEQ ID NO: 2621 - RNA, 18 nt, Artificial Sequence
  Description of Artificial Sequence: Synthetic oligonucleotide
agcacggugccgaguggg

SEQ ID NO: 2622 - RNA, 18 nt, Artificial Sequence
  Description of Artificial Sequence: Synthetic oligonucleotide
cgagaagcacggugccga

SEQ ID NO: 2623 - RNA, 18 nt, Artificial Sequence
  Description of Artificial Sequence: Synthetic oligonucleotide
ccuggcgagaagcacggu

SEQ ID NO: 2624 - RNA, 18 nt, Artificial Sequence
  Description of Artificial Sequence: Synthetic oligonucleotide
gagggccuggcgagaagc

SEQ ID NO: 2625 - RNA, 18 nt, Artificial Sequence
  Description of Artificial Sequence: Synthetic oligonucleotide
agccagagggccuggcga

SEQ ID NO: 2626 - RNA, 18 nt, Artificial Sequence
  Description of Artificial Sequence: Synthetic oligonucleotide
ggaagagccagagggccu

SEQ ID NO: 2627 - RNA, 18 nt, Artificial Sequence
  Description of Artificial Sequence: Synthetic oligonucleotide
cacagggaagagccagag

SEQ ID NO: 2628 - RNA, 18 nt, Artificial Sequence
  Description of Artificial Sequence: Synthetic oligonucleotide
gcagccacagggaagagc

SEQ ID NO: 2629 - RNA, 18 nt, Artificial Sequence
  Description of Artificial Sequence: Synthetic oligonucleotide
caucugcagccacaggga

SEQ ID NO: 2630 - RNA, 18 nt, Artificial Sequence
  Description of Artificial Sequence: Synthetic oligonucleotide
agugccaucugcagccac

SEQ ID NO: 2631 - RNA, 18 nt, Artificial Sequence
  Description of Artificial Sequence: Synthetic oligonucleotide
cgcuaagugccaucugca

SEQ ID NO: 2632 - RNA, 18 nt, Artificial Sequence
  Description of Artificial Sequence: Synthetic oligonucleotide
uaggccgcuaagugccau

SEQ ID NO: 2633 - RNA, 18 nt, Artificial Sequence
  Description of Artificial Sequence: Synthetic oligonucleotide
cguccuaggccgcuaagu

SEQ ID NO: 2634 - RNA, 18 nt, Artificial Sequence
  Description of Artificial Sequence: Synthetic oligonucleotide
auagacguccuaggccgc

SEQ ID NO: 2635 - RNA, 18 nt, Artificial Sequence
  Description of Artificial Sequence: Synthetic oligonucleotide
cgugaauagacguccuag

SEQ ID NO: 2636 - RNA, 18 nt, Artificial Sequence
  Description of Artificial Sequence: Synthetic oligonucleotide
ccucccgugaauagacgu

SEQ ID NO: 2637 - RNA, 18 nt, Artificial Sequence
  Description of Artificial Sequence: Synthetic oligonucleotide
ucccuccucccgugaaua

SEQ ID NO: 2638 - RNA, 18 nt, Artificial Sequence
  Description of Artificial Sequence: Synthetic oligonucleotide
gugccucccuccucccgu

SEQ ID NO: 2639 - RNA, 18 nt, Artificial Sequence
  Description of Artificial Sequence: Synthetic oligonucleotide
gggcagugccucccuccu

SEQ ID NO: 2640 - RNA, 18 nt, Artificial Sequence
  Description of Artificial Sequence: Synthetic oligonucleotide
gaggagggcagugccucc

SEQ ID NO: 2641 - RNA, 18 nt, Artificial Sequence
  Description of Artificial Sequence: Synthetic oligonucleotide
gaccugaggagggcagug

SEQ ID NO: 2642 - RNA, 18 nt, Artificial Sequence
  Description of Artificial Sequence: Synthetic oligonucleotide
gggcagaccugaggaggg

SEQ ID NO: 2643 - RNA, 18 nt, Artificial Sequence
  Description of Artificial Sequence: Synthetic oligonucleotide
ugcuugggcagaccugag

SEQ ID NO: 2644 - RNA, 18 nt, Artificial Sequence
  Description of Artificial Sequence: Synthetic oligonucleotide
caagcugcuugggcagac

SEQ ID NO: 2645 - RNA, 18 nt, Artificial Sequence
  Description of Artificial Sequence: Synthetic oligonucleotide
agcuacaagcugcuuggg

SEQ ID NO: 2646 - RNA, 18 nt, Artificial Sequence
  Description of Artificial Sequence: Synthetic oligonucleotide
gugcuagcuacaagcugc

SEQ ID NO: 2647 - RNA, 18 nt, Artificial Sequence
  Description of Artificial Sequence: Synthetic oligonucleotide
gcccagugcuagcuacaa

SEQ ID NO: 2648 - RNA, 18 nt, Artificial Sequence
  Description of Artificial Sequence: Synthetic oligonucleotide
gggcccagugcuagcuac

SEQ ID NO: 2649 - RNA, 18 nt, Artificial Sequence
  Description of Artificial Sequence: Synthetic oligonucleotide
caaagcagcauuuccugu

SEQ ID NO: 2650 - RNA, 18 nt, Artificial Sequence
  Description of Artificial Sequence: Synthetic oligonucleotide
ggucccaaagcagcauuu

SEQ ID NO: 2651 - RNA, 18 nt, Artificial Sequence
  Description of Artificial Sequence: Synthetic oligonucleotide
ugggaggucccaaagcag

SEQ ID NO: 2652 - RNA, 18 nt, Artificial Sequence
  Description of Artificial Sequence: Synthetic oligonucleotide
gagggugggaggucccaa

SEQ ID NO: 2653 - RNA, 18 nt, Artificial Sequence
  Description of Artificial Sequence: Synthetic oligonucleotide
ggagagagggugggaggu

SEQ ID NO: 2654 - RNA, 18 nt, Artificial Sequence
  Description of Artificial Sequence: Synthetic oligonucleotide
gcuaaggagagagggugg

SEQ ID NO: 2655 - RNA, 18 nt, Artificial Sequence
  Description of Artificial Sequence: Synthetic oligonucleotide
gggacgcuaaggagagag

SEQ ID NO: 2656 - RNA, 18 nt, Artificial Sequence
  Description of Artificial Sequence: Synthetic oligonucleotide
gccagacccacagcuggg

SEQ ID NO: 2657 - RNA, 18 nt, Artificial Sequence
  Description of Artificial Sequence: Synthetic oligonucleotide
agccagacccacagcugg

SEQ ID NO: 2658 - RNA, 18 nt, Artificial Sequence
  Description of Artificial Sequence: Synthetic oligonucleotide
cuccaagccagacccaca

SEQ ID NO: 2659 - RNA, 18 nt, Artificial Sequence
  Description of Artificial Sequence: Synthetic oligonucleotide
uccaacuccaagccagac

SEQ ID NO: 2660 - RNA, 18 nt, Artificial Sequence
  Description of Artificial Sequence: Synthetic oligonucleotide
cacccuccaacuccaagc

SEQ ID NO: 2661 - RNA, 18 nt, Artificial Sequence
  Description of Artificial Sequence: Synthetic oligonucleotide
aggcucacccuccaacuc

SEQ ID NO: 2662 - RNA, 18 nt, Artificial Sequence
  Description of Artificial Sequence: Synthetic oligonucleotide
agcagaggcucacccucc

SEQ ID NO: 2663 - RNA, 18 nt, Artificial Sequence
  Description of Artificial Sequence: Synthetic oligonucleotide
ccaagagcagaggcucac

SEQ ID NO: 2664 - RNA, 18 nt, Artificial Sequence
  Description of Artificial Sequence: Synthetic oligonucleotide
ugcucccaagagcagagg

SEQ ID NO: 2665 - RNA, 18 nt, Artificial Sequence
  Description of Artificial Sequence: Synthetic oligonucleotide
cagacugcucccaagagc

SEQ ID NO: 2666 - RNA, 18 nt, Artificial Sequence
  Description of Artificial Sequence: Synthetic oligonucleotide
gcaaacagacugcuccca

SEQ ID NO: 2667 - RNA, 18 nt, Artificial Sequence
  Description of Artificial Sequence: Synthetic oligonucleotide
uguuugcaaacagacugc

SEQ ID NO: 2668 - RNA, 18 nt, Artificial Sequence
  Description of Artificial Sequence: Synthetic oligonucleotide
gucccuguuugcaaacag

SEQ ID NO: 2669 - RNA, 18 nt, Artificial Sequence
  Description of Artificial Sequence: Synthetic oligonucleotide
gggaagucccuguuugca

SEQ ID NO: 2670 - RNA, 18 nt, Artificial Sequence
  Description of Artificial Sequence: Synthetic oligonucleotide
gagacuccgugacguggg

SEQ ID NO: 2671 - RNA, 18 nt, Artificial Sequence
  Description of Artificial Sequence: Synthetic oligonucleotide
ugcggagacuccgugacg

SEQ ID NO: 2672 - RNA, 18 nt, Artificial Sequence
  Description of Artificial Sequence: Synthetic oligonucleotide
agagcugcggagacuccg

SEQ ID NO: 2673 - RNA, 18 nt, Artificial Sequence
  Description of Artificial Sequence: Synthetic oligonucleotide
cgaggagagcugcggaga

SEQ ID NO: 2674 - RNA, 18 nt, Artificial Sequence
  Description of Artificial Sequence: Synthetic oligonucleotide
guaaccgaggagagcugc

SEQ ID NO: 2675 - RNA, 18 nt, Artificial Sequence
  Description of Artificial Sequence: Synthetic oligonucleotide
cccucguaaccgaggaga

SEQ ID NO: 2676 - RNA, 18 nt, Artificial Sequence
  Description of Artificial Sequence: Synthetic oligonucleotide
accagcccucguaaccga

SEQ ID NO: 2677 - RNA, 18 nt, Artificial Sequence
  Description of Artificial Sequence: Synthetic oligonucleotide
cugaaaccagcccucgua

SEQ ID NO: 2678 - RNA, 18 nt, Artificial Sequence
  Description of Artificial Sequence: Synthetic oligonucleotide
ggagccugaaaccagccc

SEQ ID NO: 2679 - RNA, 18 nt, Artificial Sequence
  Description of Artificial Sequence: Synthetic oligonucleotide
gagcgggagccugaaacc

SEQ ID NO: 2680 - RNA, 18 nt, Artificial Sequence
  Description of Artificial Sequence: Synthetic oligonucleotide
uaaaagagcgggagccug

SEQ ID NO: 2681 - RNA, 18 nt, Artificial Sequence
  Description of Artificial Sequence: Synthetic oligonucleotide
agcucuaaaagagcggga

SEQ ID NO: 2682 - RNA, 18 nt, Artificial Sequence
  Description of Artificial Sequence: Synthetic oligonucleotide
gccucagcucuaaaagag

SEQ ID NO: 2683 - RNA, 18 nt, Artificial Sequence
  Description of Artificial Sequence: Synthetic oligonucleotide
gacgggccucagcucuaa

SEQ ID NO: 2684 - RNA, 18 nt, Artificial Sequence
  Description of Artificial Sequence: Synthetic oligonucleotide
cgcccgacgggccucagc

SEQ ID NO: 2685 - RNA, 18 nt, Artificial Sequence
  Description of Artificial Sequence: Synthetic oligonucleotide
cucuccgcccgacgggcc

SEQ ID NO: 2686 - RNA, 18 nt, Artificial Sequence
  Description of Artificial Sequence: Synthetic oligonucleotide
agacgcucuccgcccgac

SEQ ID NO: 2687 - RNA, 18 nt, Artificial Sequence
  Description of Artificial Sequence: Synthetic oligonucleotide
gggcaagacgcucuccgc

SEQ ID NO: 2688 - RNA, 18 nt, Artificial Sequence
  Description of Artificial Sequence: Synthetic oligonucleotide
gccuccagguaggcaggg

SEQ ID NO: 2689 - RNA, 18 nt, Artificial Sequence
  Description of Artificial Sequence: Synthetic oligonucleotide
gugccuccagguaggcag

SEQ ID NO: 2690 - RNA, 18 nt, Artificial Sequence
  Description of Artificial Sequence: Synthetic oligonucleotide
ccccugugccuccaggua

SEQ ID NO: 2691 - RNA, 18 nt, Artificial Sequence
  Description of Artificial Sequence: Synthetic oligonucleotide
agccaccccugugccucc

SEQ ID NO: 2692 - RNA, 18 nt, Artificial Sequence
  Description of Artificial Sequence: Synthetic oligonucleotide
ccagcagccaccccugug

SEQ ID NO: 2693 - RNA, 18 nt, Artificial Sequence
  Description of Artificial Sequence: Synthetic oligonucleotide
guccaccagcagccaccc

SEQ ID NO: 2694 - RNA, 18 nt, Artificial Sequence
  Description of Artificial Sequence: Synthetic oligonucleotide
cuaguguccaccagcagc

SEQ ID NO: 2695 - RNA, 18 nt, Artificial Sequence
  Description of Artificial Sequence: Synthetic oligonucleotide
ccacccuaguguccacca

SEQ ID NO: 2696 - RNA, 18 nt, Artificial Sequence
  Description of Artificial Sequence: Synthetic oligonucleotide
ucugcccacccuaguguc

SEQ ID NO: 2697 - RNA, 18 nt, Artificial Sequence
  Description of Artificial Sequence: Synthetic oligonucleotide
ucggcucugcccacccua

SEQ ID NO: 2698 - RNA, 18 nt, Artificial Sequence
  Description of Artificial Sequence: Synthetic oligonucleotide
ggcaaucggcucugccca

SEQ ID NO: 2699 - RNA, 18 nt, Artificial Sequence
  Description of Artificial Sequence: Synthetic oligonucleotide
gggcaggcaaucggcucu

SEQ ID NO: 2700 - RNA, 18 nt, Artificial Sequence
  Description of Artificial Sequence: Synthetic oligonucleotide
ggguugggcaggcaaucg

SEQ ID NO: 2701 - RNA, 18 nt, Artificial Sequence
  Description of Artificial Sequence: Synthetic oligonucleotide
ccugcaugagugcccggg

SEQ ID NO: 2702 - RNA, 18 nt, Artificial Sequence
  Description of Artificial Sequence: Synthetic oligonucleotide
uccugcaugagugcccgg

SEQ ID NO: 2703 - RNA, 18 nt, Artificial Sequence
  Description of Artificial Sequence: Synthetic oligonucleotide
gccucuccugcaugagug

SEQ ID NO: 2704 - RNA, 18 nt, Artificial Sequence
  Description of Artificial Sequence: Synthetic oligonucleotide
cacaggccucuccugcau

SEQ ID NO: 2705 - RNA, 18 nt, Artificial Sequence
  Description of Artificial Sequence: Synthetic oligonucleotide
cccgacacaggccucucc

SEQ ID NO: 2706 - RNA, 18 nt, Artificial Sequence
  Description of Artificial Sequence: Synthetic oligonucleotide
gugaccccgacacaggcc

SEQ ID NO: 2707 - RNA, 18 nt, Artificial Sequence
  Description of Artificial Sequence: Synthetic oligonucleotide
ugcacgugaccccgacac

SEQ ID NO: 2708 - RNA, 18 nt, Artificial Sequence
  Description of Artificial Sequence: Synthetic oligonucleotide
aggccugcacgugacccc

SEQ ID NO: 2709 - RNA, 18 nt, Artificial Sequence
  Description of Artificial Sequence: Synthetic oligonucleotide
ugggaaggccugcacgug

SEQ ID NO: 2710 - RNA, 18 nt, Artificial Sequence
  Description of Artificial Sequence: Synthetic oligonucleotide
gacgcugggaaggccugc

SEQ ID NO: 2711 - RNA, 18 nt, Artificial Sequence
  Description of Artificial Sequence: Synthetic oligonucleotide
gggaggacgcugggaagg

SEQ ID NO: 2712 - RNA, 18 nt, Artificial Sequence
  Description of Artificial Sequence: Synthetic oligonucleotide
gggcagggaggacgcugg

SEQ ID NO: 2713 - RNA, 18 nt, Artificial Sequence
  Description of Artificial Sequence: Synthetic oligonucleotide
cgagcgggcagggaggac

SEQ ID NO: 2714 - RNA, 18 nt, Artificial Sequence
  Description of Artificial Sequence: Synthetic oligonucleotide
uccaccgagcgggcaggg

SEQ ID NO: 2715 - RNA, 18 nt, Artificial Sequence
  Description of Artificial Sequence: Synthetic oligonucleotide
ugccauccaccgagcggg

SEQ ID NO: 2716 - RNA, 18 nt, Artificial Sequence
  Description of Artificial Sequence: Synthetic oligonucleotide
acugcugccauccaccga

SEQ ID NO: 2717 - RNA, 18 nt, Artificial Sequence
  Description of Artificial Sequence: Synthetic oligonucleotide
ugcuuacugcugccaucc

SEQ ID NO: 2718 - RNA, 18 nt, Artificial Sequence
  Description of Artificial Sequence: Synthetic oligonucleotide
ggcucugcuuacugcugc

SEQ ID NO: 2719 - RNA, 18 nt, Artificial Sequence
  Description of Artificial Sequence: Synthetic oligonucleotide
cccagggcucugcuuacu

SEQ ID NO: 2720 - RNA, 18 nt, Artificial Sequence
  Description of Artificial Sequence: Synthetic oligonucleotide
gccuccccagggcucugc

SEQ ID NO: 2721 - RNA, 18 nt, Artificial Sequence
  Description of Artificial Sequence: Synthetic oligonucleotide
ugcgagccuccccagggc

SEQ ID NO: 2722 - RNA, 18 nt, Artificial Sequence
  Description of Artificial Sequence: Synthetic oligonucleotide
agcccugcgagccucccc

SEQ ID NO: 2723 - RNA, 18 nt, Artificial Sequence
  Description of Artificial Sequence: Synthetic oligonucleotide
acagcagcccugcgagcc

SEQ ID NO: 2724 - RNA, 18 nt, Artificial Sequence
  Description of Artificial Sequence: Synthetic oligonucleotide
gagggacagcagcccugc

SEQ ID NO: 2725 - RNA, 18 nt, Artificial Sequence
  Description of Artificial Sequence: Synthetic oligonucleotide
gaccagagggacagcagc

SEQ ID NO: 2726 - RNA, 18 nt, Artificial Sequence
  Description of Artificial Sequence: Synthetic oligonucleotide
cuccugaccagagggaca

SEQ ID NO: 2727 - RNA, 18 nt, Artificial Sequence
  Description of Artificial Sequence: Synthetic oligonucleotide
gccuucuccugaccagag

SEQ ID NO: 2728 - RNA, 18 nt, Artificial Sequence
  Description of Artificial Sequence: Synthetic oligonucleotide
aaccagccuucuccugac

SEQ ID NO: 2729 - RNA, 18 nt, Artificial Sequence
  Description of Artificial Sequence: Synthetic oligonucleotide
ccgagaaccagccuucuc

SEQ ID NO: 2730 - RNA, 18 nt, Artificial Sequence
  Description of Artificial Sequence: Synthetic oligonucleotide
ggccuccgagaaccagcc

SEQ ID NO: 2731 - RNA, 18 nt, Artificial Sequence
  Description of Artificial Sequence: Synthetic oligonucleotide
gacguggccuccgagaac

SEQ ID NO: 2732 - RNA, 18 nt, Artificial Sequence
  Description of Artificial Sequence: Synthetic oligonucleotide
gcccugacguggccuccg

SEQ ID NO: 2733 - RNA, 18 nt, Artificial Sequence
  Description of Artificial Sequence: Synthetic oligonucleotide
cccuggcccugacguggc

SEQ ID NO: 2734 - RNA, 18 nt, Artificial Sequence
  Description of Artificial Sequence: Synthetic oligonucleotide
ccaggcccuggcccugac

SEQ ID NO: 2735 - RNA, 18 nt, Artificial Sequence
  Description of Artificial Sequence: Synthetic oligonucleotide
cugggccaggcccuggcc

SEQ ID NO: 2736 - RNA, 18 nt, Artificial Sequence
  Description of Artificial Sequence: Synthetic oligonucleotide
uccaugaccacggcggag

SEQ ID NO: 2737 - RNA, 18 nt, Artificial Sequence
  Description of Artificial Sequence: Synthetic oligonucleotide
ccuccuccaugaccacgg

SEQ ID NO: 2738 - RNA, 18 nt, Artificial Sequence
  Description of Artificial Sequence: Synthetic oligonucleotide
acuucccuccuccaugac

SEQ ID NO: 2739 - RNA, 18 nt, Artificial Sequence
  Description of Artificial Sequence: Synthetic oligonucleotide
cccggacuucccuccucc

SEQ ID NO: 2740 - RNA, 18 nt, Artificial Sequence
  Description of Artificial Sequence: Synthetic oligonucleotide
ccucgcccggacuucccu

SEQ ID NO: 2741 - RNA, 18 nt, Artificial Sequence
  Description of Artificial Sequence: Synthetic oligonucleotide
aggaaccucgcccggacu

SEQ ID NO: 2742 - RNA, 18 nt, Artificial Sequence
  Description of Artificial Sequence: Synthetic oligonucleotide
agcacaggaaccucgccc

SEQ ID NO: 2743 - RNA, 18 nt, Artificial Sequence
  Description of Artificial Sequence: Synthetic oligonucleotide
ccaccagcacaggaaccu

SEQ ID NO: 2744 - RNA, 18 nt, Artificial Sequence
  Description of Artificial Sequence: Synthetic oligonucleotide
gggcuccaccagcacagg

SEQ ID NO: 2745 - RNA, 18 nt, Artificial Sequence
  Description of Artificial Sequence: Synthetic oligonucleotide
ucaacguccuccaacccu

SEQ ID NO: 2746 - RNA, 18 nt, Artificial Sequence
  Description of Artificial Sequence: Synthetic oligonucleotide
cugccucaacguccucca

SEQ ID NO: 2747 - RNA, 18 nt, Artificial Sequence
  Description of Artificial Sequence: Synthetic oligonucleotide
uagcgcugccucaacguc

SEQ ID NO: 2748 - RNA, 18 nt, Artificial Sequence
  Description of Artificial Sequence: Synthetic oligonucleotide
augccuagcgcugccuca

SEQ ID NO: 2749 - RNA, 18 nt, Artificial Sequence
  Description of Artificial Sequence: Synthetic oligonucleotide
uguccaugccuagcgcug

SEQ ID NO: 2750 - RNA, 18 nt, Artificial Sequence
  Description of Artificial Sequence: Synthetic oligonucleotide
gcgccuguccaugccuag

SEQ ID NO: 2751 - RNA, 18 nt, Artificial Sequence
  Description of Artificial Sequence: Synthetic oligonucleotide
uccgugcgccuguccaug

SEQ ID NO: 2752 - RNA, 18 nt, Artificial Sequence
  Description of Artificial Sequence: Synthetic oligonucleotide
aggcauccgugcgccugu

SEQ ID NO: 2753 - RNA, 18 nt, Artificial Sequence
  Description of Artificial Sequence: Synthetic oligonucleotide
gcuguaggcauccgugcg

SEQ ID NO: 2754 - RNA, 18 nt, Artificial Sequence
  Description of Artificial Sequence: Synthetic oligonucleotide
agaggacauuggaccgca

SEQ ID NO: 2755 - RNA, 18 nt, Artificial Sequence
  Description of Artificial Sequence: Synthetic oligonucleotide
agacaagaggacauugga

SEQ ID NO: 2756 - RNA, 18 nt, Artificial Sequence
  Description of Artificial Sequence: Synthetic oligonucleotide
ucaaaagacaagaggaca

SEQ ID NO: 2757 - RNA, 18 nt, Artificial Sequence
  Description of Artificial Sequence: Synthetic oligonucleotide
ugucaucaaaagacaaga

SEQ ID NO: 2758 - RNA, 18 nt, Artificial Sequence
  Description of Artificial Sequence: Synthetic oligonucleotide
gaagcuguccuucucggg

SEQ ID NO: 2759 - RNA, 18 nt, Artificial Sequence
  Description of Artificial Sequence: Synthetic oligonucleotide
gcccugaagcuguccuuc

SEQ ID NO: 2760 - RNA, 18 nt, Artificial Sequence
  Description of Artificial Sequence: Synthetic oligonucleotide
uccgggcccugaagcugu

SEQ ID NO: 2761 - RNA, 18 nt, Artificial Sequence
  Description of Artificial Sequence: Synthetic oligonucleotide
aguacuccgggcccugaa

SEQ ID NO: 2762 - RNA, 18 nt, Artificial Sequence
  Description of Artificial Sequence: Synthetic oligonucleotide
agacuaguacuccgggcc

SEQ ID NO: 2763 - RNA, 18 nt, Artificial Sequence
  Description of Artificial Sequence: Synthetic oligonucleotide
cguugagacuaguacucc

SEQ ID NO: 2764 - RNA, 18 nt, Artificial Sequence
  Description of Artificial Sequence: Synthetic oligonucleotide
ucucucguugagacuagu

SEQ ID NO: 2765 - RNA, 18 nt, Artificial Sequence
  Description of Artificial Sequence: Synthetic oligonucleotide
uugggucucucguugaga

SEQ ID NO: 2766 - RNA, 18 nt, Artificial Sequence
  Description of Artificial Sequence: Synthetic oligonucleotide
aggcacacccccgcaggc

SEQ ID NO: 2767 - RNA, 18 nt, Artificial Sequence
  Description of Artificial Sequence: Synthetic oligonucleotide
acuccaggcacacccccg

SEQ ID NO: 2768 - RNA, 18 nt, Artificial Sequence
  Description of Artificial Sequence: Synthetic oligonucleotide
caccgacuccaggcacac

SEQ ID NO: 2769 - RNA, 18 nt, Artificial Sequence
  Description of Artificial Sequence: Synthetic oligonucleotide
ccccacaccgacuccagg

SEQ ID NO: 2770 - RNA, 18 nt, Artificial Sequence
  Description of Artificial Sequence: Synthetic oligonucleotide
ccccaccccacaccgacu

SEQ ID NO: 2771 - RNA, 18 nt, Artificial Sequence
  Description of Artificial Sequence: Synthetic oligonucleotide
uccuuccccaccccacac

SEQ ID NO: 2772 - RNA, 18 nt, Artificial Sequence
  Description of Artificial Sequence: Synthetic oligonucleotide
ccauguccuuccccaccc

SEQ ID NO: 2773 - RNA, 18 nt, Artificial Sequence
  Description of Artificial Sequence: Synthetic oligonucleotide
cagccccauguccuuccc

SEQ ID NO: 2774 - RNA, 18 nt, Artificial Sequence
  Description of Artificial Sequence: Synthetic oligonucleotide
ggccacagccccaugucc

SEQ ID NO: 2775 - RNA, 18 nt, Artificial Sequence
  Description of Artificial Sequence: Synthetic oligonucleotide
aggcaggccacagcccca

SEQ ID NO: 2776 - RNA, 18 nt, Artificial Sequence
  Description of Artificial Sequence: Synthetic oligonucleotide
ccgucaggcaggccacag

SEQ ID NO: 2777 - RNA, 18 nt, Artificial Sequence
  Description of Artificial Sequence: Synthetic oligonucleotide
aggcaccgucaggcaggc

SEQ ID NO: 2778 - RNA, 18 nt, Artificial Sequence
  Description of Artificial Sequence: Synthetic oligonucleotide
cuuggaggcaccgucagg

SEQ ID NO: 2779 - RNA, 18 nt, Artificial Sequence
  Description of Artificial Sequence: Synthetic oligonucleotide
acugacuuggaggcaccg

SEQ ID NO: 2780 - RNA, 18 nt, Artificial Sequence
  Description of Artificial Sequence: Synthetic oligonucleotide
cacucacugacuuggagg

SEQ ID NO: 2781 - RNA, 18 nt, Artificial Sequence
  Description of Artificial Sequence: Synthetic oligonucleotide
auuuccacucacugacuu

SEQ ID NO: 2782 - RNA, 18 nt, Artificial Sequence
  Description of Artificial Sequence: Synthetic oligonucleotide
gacccauuuccacucacu

SEQ ID NO: 2783 - RNA, 18 nt, Artificial Sequence
  Description of Artificial Sequence: Synthetic oligonucleotide
cacaggacccauuuccac

SEQ ID NO: 2784 - RNA, 18 nt, Artificial Sequence
  Description of Artificial Sequence: Synthetic oligonucleotide
gggcacacaggacccauu

SEQ ID NO: 2785 - RNA, 18 nt, Artificial Sequence
  Description of Artificial Sequence: Synthetic oligonucleotide
cuccagggcacacaggac

SEQ ID NO: 2786 - RNA, 18 nt, Artificial Sequence
  Description of Artificial Sequence: Synthetic oligonucleotide
acauacuccagggcacac

SEQ ID NO: 2787 - RNA, 18 nt, Artificial Sequence
  Description of Artificial Sequence: Synthetic oligonucleotide
gccucacauacuccaggg

SEQ ID NO: 2788 - RNA, 18 nt, Artificial Sequence
  Description of Artificial Sequence: Synthetic oligonucleotide
gcccugccucacauacuc

SEQ ID NO: 2789 - RNA, 18 nt, Artificial Sequence
  Description of Artificial Sequence: Synthetic oligonucleotide
guccugcccugccucaca

SEQ ID NO: 2790 - RNA, 18 nt, Artificial Sequence
  Description of Artificial Sequence: Synthetic oligonucleotide
ugcagguccugcccugcc

SEQ ID NO: 2791 - RNA, 18 nt, Artificial Sequence
  Description of Artificial Sequence: Synthetic oligonucleotide
gcccuugcagguccugcc

SEQ ID NO: 2792 - RNA, 18 nt, Artificial Sequence
  Description of Artificial Sequence: Synthetic oligonucleotide
uagcggcccuugcagguc

SEQ ID NO: 2793 - RNA, 18 nt, Artificial Sequence
  Description of Artificial Sequence: Synthetic oligonucleotide
gguguuagcggcccuugc

SEQ ID NO: 2794 - RNA, 18 nt, Artificial Sequence
  Description of Artificial Sequence: Synthetic oligonucleotide
ggguguuagcggcccuug

SEQ ID NO: 2795 - RNA, 18 nt, Artificial Sequence
  Description of Artificial Sequence: Synthetic oligonucleotide
cggccaaccugcugaggg

SEQ ID NO: 2796 - RNA, 18 nt, Artificial Sequence
  Description of Artificial Sequence: Synthetic oligonucleotide
caccacggccaaccugcu

SEQ ID NO: 2797 - RNA, 18 nt, Artificial Sequence
  Description of Artificial Sequence: Synthetic oligonucleotide
caggccaccacggccaac

SEQ ID NO: 2798 - RNA, 18 nt, Artificial Sequence
  Description of Artificial Sequence: Synthetic oligonucleotide
ggacccaggccaccacgg

SEQ ID NO: 2799 - RNA, 18 nt, Artificial Sequence
  Description of Artificial Sequence: Synthetic oligonucleotide
agcccggacccaggccac

SEQ ID NO: 2800 - RNA, 18 nt, Artificial Sequence
  Description of Artificial Sequence: Synthetic oligonucleotide
cacgcagcccggacccag

SEQ ID NO: 2801 - RNA, 18 nt, Artificial Sequence
  Description of Artificial Sequence: Synthetic oligonucleotide
uggcacacgcagcccgga

SEQ ID NO: 2802 - RNA, 18 nt, Artificial Sequence
  Description of Artificial Sequence: Synthetic oligonucleotide
gcccguggcacacgcagc

SEQ ID NO: 2803 - RNA, 18 nt, Artificial Sequence
  Description of Artificial Sequence: Synthetic oligonucleotide
uaggugcccguggcacac

SEQ ID NO: 2804 - RNA, 18 nt, Artificial Sequence
  Description of Artificial Sequence: Synthetic oligonucleotide
acaaguaggugcccgugg

SEQ ID NO: 2805 - RNA, 18 nt, Artificial Sequence
  Description of Artificial Sequence: Synthetic oligonucleotide
auuccacaaguaggugcc

SEQ ID NO: 2806 - RNA, 18 nt, Artificial Sequence
  Description of Artificial Sequence: Synthetic oligonucleotide
ccccaauuccacaaguag

SEQ ID NO: 2807 - RNA, 18 nt, Artificial Sequence
  Description of Artificial Sequence: Synthetic oligonucleotide
ccaacccccaauuccaca

SEQ ID NO: 2808 - RNA, 18 nt, Artificial Sequence
  Description of Artificial Sequence: Synthetic oligonucleotide
gcaccccaacccccaauu

SEQ ID NO: 2809 - RNA, 18 nt, Artificial Sequence
  Description of Artificial Sequence: Synthetic oligonucleotide
agcuugcaccccaacccc

SEQ ID NO: 2810 - RNA, 18 nt, Artificial Sequence
  Description of Artificial Sequence: Synthetic oligonucleotide
ccuaaagcuugcacccca

SEQ ID NO: 2811 - RNA, 18 nt, Artificial Sequence
  Description of Artificial Sequence: Synthetic oligonucleotide
aggcgccuaaagcuugca

SEQ ID NO: 2812 - RNA, 18 nt, Artificial Sequence
  Description of Artificial Sequence: Synthetic oligonucleotide
ggcucaggcgccuaaagc

SEQ ID NO: 2813 - RNA, 18 nt, Artificial Sequence
  Description of Artificial Sequence: Synthetic oligonucleotide
gggcucaggcgccuaaag

SEQ ID NO: 2814 - RNA, 18 nt, Artificial Sequence
  Description of Artificial Sequence: Synthetic oligonucleotide
ggccggcuccuucgaggg

SEQ ID NO: 2815 - RNA, 18 nt, Artificial Sequence
  Description of Artificial Sequence: Synthetic oligonucleotide
gacaaggccggcuccuuc

SEQ ID NO: 2816 - RNA, 18 nt, Artificial Sequence
  Description of Artificial Sequence: Synthetic oligonucleotide
ccccagacaaggccggcu

SEQ ID NO: 2817 - RNA, 18 nt, Artificial Sequence
  Description of Artificial Sequence: Synthetic oligonucleotide
ggcagccccagacaaggc

SEQ ID NO: 2818 - RNA, 18 nt, Artificial Sequence
  Description of Artificial Sequence: Synthetic oligonucleotide
gggcagccccagacaagg

SEQ ID NO: 2819 - RNA, 18 nt, Artificial Sequence
  Description of Artificial Sequence: Synthetic oligonucleotide
ggcuagcagcaggcuggg

SEQ ID NO: 2820 - RNA, 18 nt, Artificial Sequence
  Description of Artificial Sequence: Synthetic oligonucleotide
uccccggcuagcagcagg

SEQ ID NO: 2821 - RNA, 18 nt, Artificial Sequence
  Description of Artificial Sequence: Synthetic oligonucleotide
cagaguccccggcuagca

SEQ ID NO: 2822 - RNA, 18 nt, Artificial Sequence
  Description of Artificial Sequence: Synthetic oligonucleotide
ugaagcagaguccccggc

SEQ ID NO: 2823 - RNA, 18 nt, Artificial Sequence
  Description of Artificial Sequence: Synthetic oligonucleotide
ggugaugaagcagagucc

SEQ ID NO: 2824 - RNA, 18 nt, Artificial Sequence
  Description of Artificial Sequence: Synthetic oligonucleotide
gcggcggugaugaagcag

SEQ ID NO: 2825 - RNA, 18 nt, Artificial Sequence
  Description of Artificial Sequence: Synthetic oligonucleotide
gcaaggcggcggugauga

SEQ ID NO: 2826 - RNA, 18 nt, Artificial Sequence
  Description of Artificial Sequence: Synthetic oligonucleotide
guccggcaaggcggcggu

SEQ ID NO: 2827 - RNA, 18 nt, Artificial Sequence
  Description of Artificial Sequence: Synthetic oligonucleotide
uugcgguccggcaaggcg

SEQ ID NO: 2828 - RNA, 18 nt, Artificial Sequence
  Description of Artificial Sequence: Synthetic oligonucleotide
gcucuuugcgguccggca

SEQ ID NO: 2829 - RNA, 18 nt, Artificial Sequence
  Description of Artificial Sequence: Synthetic oligonucleotide
gcucagcucuuugcgguc

SEQ ID NO: 2830 - RNA, 18 nt, Artificial Sequence
  Description of Artificial Sequence: Synthetic oligonucleotide
ggcuggcucagcucuuug

SEQ ID NO: 2831 - RNA, 18 nt, Artificial Sequence
  Description of Artificial Sequence: Synthetic oligonucleotide
acagaggcuggcucagcu

SEQ ID NO: 2832 - RNA, 18 nt, Artificial Sequence
  Description of Artificial Sequence: Synthetic oligonucleotide
agaacacagaggcuggcu

SEQ ID NO: 2833 - RNA, 18 nt, Artificial Sequence
  Description of Artificial Sequence: Synthetic oligonucleotide
aaacaagaacacagaggc

SEQ ID NO: 2834 - RNA, 18 nt, Artificial Sequence
  Description of Artificial Sequence: Synthetic oligonucleotide
aaugcaaacaagaacaca

SEQ ID NO: 2835 - RNA, 18 nt, Artificial Sequence
  Description of Artificial Sequence: Synthetic oligonucleotide
aaugaaaugcaaacaaga

SEQ ID NO: 2836 - RNA, 18 nt, Artificial Sequence
  Description of Artificial Sequence: Synthetic oligonucleotide
guucaaaugaaaugcaaa

SEQ ID NO: 2837 - RNA, 18 nt, Artificial Sequence
  Description of Artificial Sequence: Synthetic oligonucleotide
aagccguucaaaugaaau

SEQ ID NO: 2838 - RNA, 18 nt, Artificial Sequence
  Description of Artificial Sequence: Synthetic oligonucleotide
ggagaaagccguucaaau

SEQ ID NO: 2839 - RNA, 18 nt, Artificial Sequence
  Description of Artificial Sequence: Synthetic oligonucleotide
caggaggagaaagccguu

SEQ ID NO: 2840 - RNA, 18 nt, Artificial Sequence
  Description of Artificial Sequence: Synthetic oligonucleotide
gggacaggaggagaaagc

SEQ ID NO: 2841 - RNA, 18 nt, Artificial Sequence
  Description of Artificial Sequence: Synthetic oligonucleotide
cucgggcaggaagguggg

SEQ ID NO: 2842 - RNA, 18 nt, Artificial Sequence
  Description of Artificial Sequence: Synthetic oligonucleotide
aauagcucgggcaggaag

SEQ ID NO: 2843 - RNA, 18 nt, Artificial Sequence
  Description of Artificial Sequence: Synthetic oligonucleotide
gccaaaauagcucgggca

SEQ ID NO: 2844 - RNA, 18 nt, Artificial Sequence
  Description of Artificial Sequence: Synthetic oligonucleotide
ggaaagccaaaauagcuc

SEQ ID NO: 2845 - RNA, 18 nt, Artificial Sequence
  Description of Artificial Sequence: Synthetic oligonucleotide
ucuagggaaagccaaaau

SEQ ID NO: 2846 - RNA, 18 nt, Artificial Sequence
  Description of Artificial Sequence: Synthetic oligonucleotide
ucccaucuagggaaagcc

SEQ ID NO: 2847 - RNA, 18 nt, Artificial Sequence
  Description of Artificial Sequence: Synthetic oligonucleotide
cguauucccaucuaggga

SEQ ID NO: 2848 - RNA, 18 nt, Artificial Sequence
  Description of Artificial Sequence: Synthetic oligonucleotide
aaugccguauucccaucu

SEQ ID NO: 2849 - RNA, 18 nt, Artificial Sequence
  Description of Artificial Sequence: Synthetic oligonucleotide
uggaaaaugccguauucc

SEQ ID NO: 2850 - RNA, 18 nt, Artificial Sequence
  Description of Artificial Sequence: Synthetic oligonucleotide
cacgcuggaaaaugccgu

SEQ ID NO: 2851 - RNA, 18 nt, Artificial Sequence
  Description of Artificial Sequence: Synthetic oligonucleotide
gaggucacgcuggaaaau

SEQ ID NO: 2852 - RNA, 18 nt, Artificial Sequence
  Description of Artificial Sequence: Synthetic oligonucleotide
gaguugaggucacgcugg

SEQ ID NO: 2853 - RNA, 18 nt, Artificial Sequence
  Description of Artificial Sequence: Synthetic oligonucleotide
cuuccgaguugaggucac

SEQ ID NO: 2854 - RNA, 18 nt, Artificial Sequence
  Description of Artificial Sequence: Synthetic oligonucleotide
gcuuccgaguugagguca

SEQ ID NO: 2855 - RNA, 18 nt, Artificial Sequence
  Description of Artificial Sequence: Synthetic oligonucleotide
caacagcuuccgaguuga

SEQ ID NO: 2856 - RNA, 18 nt, Artificial Sequence
  Description of Artificial Sequence: Synthetic oligonucleotide
ggagacaacagcuuccga

SEQ ID NO: 2857 - RNA, 18 nt, Artificial Sequence
  Description of Artificial Sequence: Synthetic oligonucleotide
gggcuggagacaacagcu

SEQ ID NO: 2858 - RNA, 18 nt, Artificial Sequence
  Description of Artificial Sequence: Synthetic oligonucleotide
ggcccccggcccccaggg

SEQ ID NO: 2859 - RNA, 18 nt, Artificial Sequence
  Description of Artificial Sequence: Synthetic oligonucleotide
gcuuggcccccggccccc

SEQ ID NO: 2860 - RNA, 18 nt, Artificial Sequence
  Description of Artificial Sequence: Synthetic oligonucleotide
gccgagcuuggcccccgg

SEQ ID NO: 2861 - RNA, 18 nt, Artificial Sequence
  Description of Artificial Sequence: Synthetic oligonucleotide
uaauggccgagcuuggcc

SEQ ID NO: 2862 - RNA, 18 nt, Artificial Sequence
  Description of Artificial Sequence: Synthetic oligonucleotide
ggccguaauggccgagcu

SEQ ID NO: 2863 - RNA, 18 nt, Artificial Sequence
  Description of Artificial Sequence: Synthetic oligonucleotide
ucucuggccguaauggcc

SEQ ID NO: 2864 - RNA, 18 nt, Artificial Sequence
  Description of Artificial Sequence: Synthetic oligonucleotide
aguagucucuggccguaa

SEQ ID NO: 2865 - RNA, 18 nt, Artificial Sequence
  Description of Artificial Sequence: Synthetic oligonucleotide
cagaaaguagucucuggc

SEQ ID NO: 2866 - RNA, 18 nt, Artificial Sequence
  Description of Artificial Sequence: Synthetic oligonucleotide
gaccccagaaaguagucu

SEQ ID NO: 2867 - RNA, 18 nt, Artificial Sequence
  Description of Artificial Sequence: Synthetic oligonucleotide
accaagaccccagaaagu

SEQ ID NO: 2868 - RNA, 18 nt, Artificial Sequence
  Description of Artificial Sequence: Synthetic oligonucleotide
aagagaccaagaccccag

SEQ ID NO: 2869 - RNA, 18 nt, Artificial Sequence
  Description of Artificial Sequence: Synthetic oligonucleotide
aggaaaagagaccaagac

SEQ ID NO: 2870 - RNA, 18 nt, Artificial Sequence
  Description of Artificial Sequence: Synthetic oligonucleotide
ucacuaggaaaagagacc

SEQ ID NO: 2871 - RNA, 18 nt, Artificial Sequence
  Description of Artificial Sequence: Synthetic oligonucleotide
gaaggucacuaggaaaag

SEQ ID NO: 2872 - RNA, 18 nt, Artificial Sequence
  Description of Artificial Sequence: Synthetic oligonucleotide
gcccugaaggucacuagg

SEQ ID NO: 2873 - RNA, 18 nt, Artificial Sequence
  Description of Artificial Sequence: Synthetic oligonucleotide
gccaggcccugaagguca

SEQ ID NO: 2874 - RNA, 18 nt, Artificial Sequence
  Description of Artificial Sequence: Synthetic oligonucleotide
caguggccaggcccugaa

SEQ ID NO: 2875 - RNA, 18 nt, Artificial Sequence
  Description of Artificial Sequence: Synthetic oligonucleotide
ggccucaguggccaggcc

SEQ ID NO: 2876 - RNA, 18 nt, Artificial Sequence
  Description of Artificial Sequence: Synthetic oligonucleotide
acugaggccucaguggcc

SEQ ID NO: 2877 - RNA, 18 nt, Artificial Sequence
  Description of Artificial Sequence: Synthetic oligonucleotide
gcggcacugaggccucag

SEQ ID NO: 2878 - RNA, 18 nt, Artificial Sequence
  Description of Artificial Sequence: Synthetic oligonucleotide
ccgaggcggcacugaggc

SEQ ID NO: 2879 - RNA, 18 nt, Artificial Sequence
  Description of Artificial Sequence: Synthetic oligonucleotide
ucugaccgaggcggcacu

SEQ ID NO: 2880 - RNA, 18 nt, Artificial Sequence
  Description of Artificial Sequence: Synthetic oligonucleotide
ccagcucugaccgaggcg

SEQ ID NO: 2881 - RNA, 18 nt, Artificial Sequence
  Description of Artificial Sequence: Synthetic oligonucleotide
accgcccagcucugaccg

SEQ ID NO: 2882 - RNA, 18 nt, Artificial Sequence
  Description of Artificial Sequence: Synthetic oligonucleotide
caggcaccgcccagcucu

SEQ ID NO: 2883 - RNA, 18 nt, Artificial Sequence
  Description of Artificial Sequence: Synthetic oligonucleotide
gaaggcaggcaccgccca

SEQ ID NO: 2884 - RNA, 18 nt, Artificial Sequence
  Description of Artificial Sequence: Synthetic oligonucleotide
ccgcggaaggcaggcacc

SEQ ID NO: 2885 - RNA, 18 nt, Artificial Sequence
  Description of Artificial Sequence: Synthetic oligonucleotide
cccacccgcggaaggcag

SEQ ID NO: 2886 - RNA, 18 nt, Artificial Sequence
  Description of Artificial Sequence: Synthetic oligonucleotide
ucccacccacccgcggaa

SEQ ID NO: 2887 - RNA, 18 nt, Artificial Sequence
  Description of Artificial Sequence: Synthetic oligonucleotide
ggcaaucccacccacccg

SEQ ID NO: 2888 - RNA, 18 nt, Artificial Sequence
  Description of Artificial Sequence: Synthetic oligonucleotide
ggccaggcaaucccaccc

SEQ ID NO: 2889 - RNA, 18 nt, Artificial Sequence
  Description of Artificial Sequence: Synthetic oligonucleotide
gugcuggccaggcaaucc

SEQ ID NO: 2890 - RNA, 18 nt, Artificial Sequence
  Description of Artificial Sequence: Synthetic oligonucleotide
aggcugugcuggccaggc

SEQ ID NO: 2891 - RNA, 18 nt, Artificial Sequence
  Description of Artificial Sequence: Synthetic oligonucleotide
auuccaggcugugcuggc

SEQ ID NO: 2892 - RNA, 18 nt, Artificial Sequence
  Description of Artificial Sequence: Synthetic oligonucleotide
ggcagauuccaggcugug

SEQ ID NO: 2893 - RNA, 18 nt, Artificial Sequence
  Description of Artificial Sequence: Synthetic oligonucleotide
cccacggcagauuccagg

SEQ ID NO: 2894 - RNA, 18 nt, Artificial Sequence
  Description of Artificial Sequence: Synthetic oligonucleotide
ucacccccacggcagauu

SEQ ID NO: 2895 - RNA, 18 nt, Artificial Sequence
  Description of Artificial Sequence: Synthetic oligonucleotide
gugggucacccccacggc

SEQ ID NO: 2896 - RNA, 18 nt, Artificial Sequence
  Description of Artificial Sequence: Synthetic oligonucleotide
cgugugugggucaccccc

SEQ ID NO: 2897 - RNA, 18 nt, Artificial Sequence
  Description of Artificial Sequence: Synthetic oligonucleotide
uuaaacguguguggguca

SEQ ID NO: 2898 - RNA, 18 nt, Artificial Sequence
  Description of Artificial Sequence: Synthetic oligonucleotide
gcaaauuaaacgugugug

SEQ ID NO: 2899 - RNA, 18 nt, Artificial Sequence
  Description of Artificial Sequence: Synthetic oligonucleotide
ucagugcaaauuaaacgu

SEQ ID NO: 2900 - RNA, 18 nt, Artificial Sequence
  Description of Artificial Sequence: Synthetic oligonucleotide
caacgucagugcaaauua

SEQ ID NO: 2901 - RNA, 18 nt, Artificial Sequence
  Description of Artificial Sequence: Synthetic oligonucleotide
acaaacaacgucagugca

SEQ ID NO: 2902 - RNA, 18 nt, Artificial Sequence
  Description of Artificial Sequence: Synthetic oligonucleotide
ccaaaacaaacaacguca

SEQ ID NO: 2903 - RNA, 18 nt, Artificial Sequence
  Description of Artificial Sequence: Synthetic oligonucleotide
ugacaccaaaacaaacaa

SEQ ID NO: 2904 - RNA, 18 nt, Artificial Sequence
  Description of Artificial Sequence: Synthetic oligonucleotide
acgcaugacaccaaaaca

SEQ ID NO: 2905 - RNA, 18 nt, Artificial Sequence
  Description of Artificial Sequence: Synthetic oligonucleotide
gcuucacgcaugacacca

SEQ ID NO: 2906 - RNA, 18 nt, Artificial Sequence
  Description of Artificial Sequence: Synthetic oligonucleotide
guaaggcuucacgcauga

SEQ ID NO: 2907 - RNA, 18 nt, Artificial Sequence
  Description of Artificial Sequence: Synthetic oligonucleotide
aacaaguaaggcuucacg

SEQ ID NO: 2908 - RNA, 18 nt, Artificial Sequence
  Description of Artificial Sequence: Synthetic oligonucleotide
cugagaacaaguaaggcu

SEQ ID NO: 2909 - RNA, 18 nt, Artificial Sequence
  Description of Artificial Sequence: Synthetic oligonucleotide
caugacugagaacaagua

SEQ ID NO: 2910 - RNA, 18 nt, Artificial Sequence
  Description of Artificial Sequence: Synthetic oligonucleotide
guaaacaugacugagaac

SEQ ID NO: 2911 - RNA, 18 nt, Artificial Sequence
  Description of Artificial Sequence: Synthetic oligonucleotide
gucugguaaacaugacug

SEQ ID NO: 2912 - RNA, 18 nt, Artificial Sequence
  Description of Artificial Sequence: Synthetic oligonucleotide
aauacgucugguaaacau

SEQ ID NO: 2913 - RNA, 18 nt, Artificial Sequence
  Description of Artificial Sequence: Synthetic oligonucleotide
augauaauacgucuggua

SEQ ID NO: 2914 - RNA, 18 nt, Artificial Sequence
  Description of Artificial Sequence: Synthetic oligonucleotide
aaugcaugauaauacguc

SEQ ID NO: 2915 - RNA, 18 nt, Artificial Sequence
  Description of Artificial Sequence: Synthetic oligonucleotide
acaaaaaugcaugauaau

SEQ ID NO: 2916 - RNA, 18 nt, Artificial Sequence
  Description of Artificial Sequence: Synthetic oligonucleotide
agaaaacaaaaaugcaug

SEQ ID NO: 2917 - RNA, 18 nt, Artificial Sequence
  Description of Artificial Sequence: Synthetic oligonucleotide
gagacagaaaacaaaaau

SEQ ID NO: 2918 - RNA, 18 nt, Artificial Sequence
  Description of Artificial Sequence: Synthetic oligonucleotide
gggaagagacagaaaaca

SEQ ID NO: 2919 - RNA, 18 nt, Artificial Sequence
  Description of Artificial Sequence: Synthetic oligonucleotide
caaagggcaguuagcggg

SEQ ID NO: 2920 - RNA, 18 nt, Artificial Sequence
  Description of Artificial Sequence: Synthetic oligonucleotide
ugccaaagggcaguuagc

SEQ ID NO: 2921 - RNA, 18 nt, Artificial Sequence
  Description of Artificial Sequence: Synthetic oligonucleotide
agccaugccaaagggcag

SEQ ID NO: 2922 - RNA, 18 nt, Artificial Sequence
  Description of Artificial Sequence: Synthetic oligonucleotide
aaaagagccaugccaaag

SEQ ID NO: 2923 - RNA, 18 nt, Artificial Sequence
  Description of Artificial Sequence: Synthetic oligonucleotide
gagcaaaaagagccaugc

SEQ ID NO: 2924 - RNA, 18 nt, Artificial Sequence
  Description of Artificial Sequence: Synthetic oligonucleotide
gagaugagcaaaaagagc

SEQ ID NO: 2925 - RNA, 18 nt, Artificial Sequence
  Description of Artificial Sequence: Synthetic oligonucleotide
cgggugagaugagcaaaa

SEQ ID NO: 2926 - RNA, 18 nt, Artificial Sequence
  Description of Artificial Sequence: Synthetic oligonucleotide
ucccgcgggugagaugag

SEQ ID NO: 2927 - RNA, 18 nt, Artificial Sequence
  Description of Artificial Sequence: Synthetic oligonucleotide
agagaucccgcgggugag

SEQ ID NO: 2928 - RNA, 18 nt, Artificial Sequence
  Description of Artificial Sequence: Synthetic oligonucleotide
gauggagagaucccgcgg

SEQ ID NO: 2929 - RNA, 18 nt, Artificial Sequence
  Description of Artificial Sequence: Synthetic oligonucleotide
gucaggauggagagaucc

SEQ ID NO: 2930 - RNA, 18 nt, Artificial Sequence
  Description of Artificial Sequence: Synthetic oligonucleotide
acagggucaggauggaga

SEQ ID NO: 2931 - RNA, 18 nt, Artificial Sequence
  Description of Artificial Sequence: Synthetic oligonucleotide
aggccacagggucaggau

SEQ ID NO: 2932 - RNA, 18 nt, Artificial Sequence
  Description of Artificial Sequence: Synthetic oligonucleotide
gucccaggccacaggguc

SEQ ID NO: 2933 - RNA, 18 nt, Artificial Sequence
  Description of Artificial Sequence: Synthetic oligonucleotide
gaaaggucccaggccaca

SEQ ID NO: 2934 - RNA, 18 nt, Artificial Sequence
  Description of Artificial Sequence: Synthetic oligonucleotide
aggaggaaaggucccagg

SEQ ID NO: 2935 - RNA, 18 nt, Artificial Sequence
  Description of Artificial Sequence: Synthetic oligonucleotide
gggugaggaggaaagguc

SEQ ID NO: 2936 - RNA, 18 nt, Artificial Sequence
  Description of Artificial Sequence: Synthetic oligonucleotide
gaacaagccaguggaggg

SEQ ID NO: 2937 - RNA, 18 nt, Artificial Sequence
  Description of Artificial Sequence: Synthetic oligonucleotide
gggagaacaagccagugg

SEQ ID NO: 2938 - RNA, 18 nt, Artificial Sequence
  Description of Artificial Sequence: Synthetic oligonucleotide
cccagcucccgggaaggg

SEQ ID NO: 2939 - RNA, 18 nt, Artificial Sequence
  Description of Artificial Sequence: Synthetic oligonucleotide
agcccagcucccgggaag

SEQ ID NO: 2940 - RNA, 18 nt, Artificial Sequence
  Description of Artificial Sequence: Synthetic oligonucleotide
cagagagcccagcucccg

SEQ ID NO: 2941 - RNA, 18 nt, Artificial Sequence
  Description of Artificial Sequence: Synthetic oligonucleotide
cgccccagagagcccagc

SEQ ID NO: 2942 - RNA, 18 nt, Artificial Sequence
  Description of Artificial Sequence: Synthetic oligonucleotide
cccaacgccccagagagc

SEQ ID NO: 2943 - RNA, 18 nt, Artificial Sequence
  Description of Artificial Sequence: Synthetic oligonucleotide
ggagccccaacgccccag

SEQ ID NO: 2944 - RNA, 18 nt, Artificial Sequence
  Description of Artificial Sequence: Synthetic oligonucleotide
gggucuggcuauccucag

SEQ ID NO: 2945 - RNA, 18 nt, Artificial Sequence
  Description of Artificial Sequence: Synthetic oligonucleotide
uuauucaagccuuguuug

SEQ ID NO: 2946 - RNA, 18 nt, Artificial Sequence
  Description of Artificial Sequence: Synthetic oligonucleotide
gagaguuauucaagccuu

SEQ ID NO: 2947 - RNA, 18 nt, Artificial Sequence
  Description of Artificial Sequence: Synthetic oligonucleotide
ggguggagaguuauucaa

SEQ ID NO: 2948 - RNA, 18 nt, Artificial Sequence
  Description of Artificial Sequence: Synthetic oligonucleotide
uucacggguggagaguua

SEQ ID NO: 2949 - RNA, 18 nt, Artificial Sequence
  Description of Artificial Sequence: Synthetic oligonucleotide
auucuuucacggguggag

SEQ ID NO: 2950 - RNA, 18 nt, Artificial Sequence
  Description of Artificial Sequence: Synthetic oligonucleotide
cuugaauucuuucacggg

SEQ ID NO: 2951 - RNA, 18 nt, Artificial Sequence
  Description of Artificial Sequence: Synthetic oligonucleotide
cucuccuugaauucuuuc

SEQ ID NO: 2952 - RNA, 18 nt, Artificial Sequence
  Description of Artificial Sequence: Synthetic oligonucleotide
cagagcucuccuugaauu

SEQ ID NO: 2953 - RNA, 18 nt, Artificial Sequence
  Description of Artificial Sequence: Synthetic oligonucleotide
ggcugcagagcucuccuu

SEQ ID NO: 2954 - RNA, 18 nt, Artificial Sequence
  Description of Artificial Sequence: Synthetic oligonucleotide
gccucggcugcagagcuc

SEQ ID NO: 2955 - RNA, 18 nt, Artificial Sequence
  Description of Artificial Sequence: Synthetic oligonucleotide
ggaaggccucggcugcag

SEQ ID NO: 2956 - RNA, 18 nt, Artificial Sequence
  Description of Artificial Sequence: Synthetic oligonucleotide
gcaccggaaggccucggc

SEQ ID NO: 2957 - RNA, 18 nt, Artificial Sequence
  Description of Artificial Sequence: Synthetic oligonucleotide
cugcggcaccggaaggcc

SEQ ID NO: 2958 - RNA, 18 nt, Artificial Sequence
  Description of Artificial Sequence: Synthetic oligonucleotide
ugaugcugcggcaccgga

SEQ ID NO: 2959 - RNA, 18 nt, Artificial Sequence
  Description of Artificial Sequence: Synthetic oligonucleotide
cacacugaugcugcggca

SEQ ID NO: 2960 - RNA, 18 nt, Artificial Sequence
  Description of Artificial Sequence: Synthetic oligonucleotide
ucagacacacugaugcug

SEQ ID NO: 2961 - RNA, 18 nt, Artificial Sequence
  Description of Artificial Sequence: Synthetic oligonucleotide
cauguucagacacacuga

SEQ ID NO: 2962 - RNA, 18 nt, Artificial Sequence
  Description of Artificial Sequence: Synthetic oligonucleotide
gaccacauguucagacac

SEQ ID NO: 2963 - RNA, 18 nt, Artificial Sequence
  Description of Artificial Sequence: Synthetic oligonucleotide
cugcggaccacauguuca

SEQ ID NO: 2964 - RNA, 18 nt, Artificial Sequence
  Description of Artificial Sequence: Synthetic oligonucleotide
gggucuggcuauccucag

SEQ ID NO: 2965 - RNA, 18 nt, Artificial Sequence
  Description of Artificial Sequence: Synthetic oligonucleotide
auucaagccuuguuuggg

SEQ ID NO: 2966 - RNA, 18 nt, Artificial Sequence
  Description of Artificial Sequence: Synthetic oligonucleotide
aguuauucaagccuuguu

SEQ ID NO: 2967 - RNA, 18 nt, Artificial Sequence
  Description of Artificial Sequence: Synthetic oligonucleotide
uggagaguuauucaagcc

SEQ ID NO: 2968 - RNA, 18 nt, Artificial Sequence
  Description of Artificial Sequence: Synthetic oligonucleotide
acggguggagaguuauuc

SEQ ID NO: 2969 - RNA, 18 nt, Artificial Sequence
  Description of Artificial Sequence: Synthetic oligonucleotide
cuuucacggguggagagu

SEQ ID NO: 2970 - RNA, 18 nt, Artificial Sequence
  Description of Artificial Sequence: Synthetic oligonucleotide
gaauucuuucacgggugg

SEQ ID NO: 2971 - RNA, 18 nt, Artificial Sequence
  Description of Artificial Sequence: Synthetic oligonucleotide
uccuugaauucuuucacg

SEQ ID NO: 2972 - RNA, 18 nt, Artificial Sequence
  Description of Artificial Sequence: Synthetic oligonucleotide
agcucuccuugaauucuu

SEQ ID NO: 2973 - RNA, 18 nt, Artificial Sequence
  Description of Artificial Sequence: Synthetic oligonucleotide
ugcagagcucuccuugaa

SEQ ID NO: 2974 - RNA, 18 nt, Artificial Sequence
  Description of Artificial Sequence: Synthetic oligonucleotide
ucggcugcagagcucucc

SEQ ID NO: 2975 - RNA, 18 nt, Artificial Sequence
  Description of Artificial Sequence: Synthetic oligonucleotide
aggccucggcugcagagc

SEQ ID NO: 2976 - RNA, 18 nt, Artificial Sequence
  Description of Artificial Sequence: Synthetic oligonucleotide
ccggaaggccucggcugc

SEQ ID NO: 2977 - RNA, 18 nt, Artificial Sequence
  Description of Artificial Sequence: Synthetic oligonucleotide
cggcaccggaaggccucg

SEQ ID NO: 2978 - RNA, 18 nt, Artificial Sequence
  Description of Artificial Sequence: Synthetic oligonucleotide
ugcugcggcaccggaagg

SEQ ID NO: 2979 - RNA, 18 nt, Artificial Sequence
  Description of Artificial Sequence: Synthetic oligonucleotide
acugaugcugcggcaccg

SEQ ID NO: 2980 - RNA, 18 nt, Artificial Sequence
  Description of Artificial Sequence: Synthetic oligonucleotide
gacacacugaugcugcgg

SEQ ID NO: 2981 - RNA, 18 nt, Artificial Sequence
  Description of Artificial Sequence: Synthetic oligonucleotide
guucagacacacugaugc

SEQ ID NO: 2982 - RNA, 18 nt, Artificial Sequence
  Description of Artificial Sequence: Synthetic oligonucleotide
cacauguucagacacacu

SEQ ID NO: 2983 - RNA, 18 nt, Artificial Sequence
  Description of Artificial Sequence: Synthetic oligonucleotide
cggaccacauguucagac

SEQ ID NO: 2984 - RNA, 18 nt, Artificial Sequence
  Description of Artificial Sequence: Synthetic oligonucleotide
cccccacccgacaguccc

SEQ ID NO: 2985 - RNA, 18 nt, Artificial Sequence
  Description of Artificial Sequence: Synthetic oligonucleotide
cgugccccccacccgaca

SEQ ID NO: 2986 - RNA, 18 nt, Artificial Sequence
  Description of Artificial Sequence: Synthetic oligonucleotide
ggguccgugccccccacc

SEQ ID NO: 2987 - RNA, 18 nt, Artificial Sequence
  Description of Artificial Sequence: Synthetic oligonucleotide
cuccaggguccgugcccc

SEQ ID NO: 2988 - RNA, 18 nt, Artificial Sequence
  Description of Artificial Sequence: Synthetic oligonucleotide
ccaagcuccaggguccgu

SEQ ID NO: 2989 - RNA, 18 nt, Artificial Sequence
  Description of Artificial Sequence: Synthetic oligonucleotide
gggccaagcuccaggguc

SEQ ID NO: 2990 - RNA, 18 nt, Artificial Sequence
  Description of Artificial Sequence: Synthetic oligonucleotide
cacccaggugcucacggg

SEQ ID NO: 2991 - RNA, 18 nt, Artificial Sequence
  Description of Artificial Sequence: Synthetic oligonucleotide
acugccacccaggugcuc

SEQ ID NO: 2992 - RNA, 18 nt, Artificial Sequence
  Description of Artificial Sequence: Synthetic oligonucleotide
caugcacugccacccagg

SEQ ID NO: 2993 - RNA, 18 nt, Artificial Sequence
  Description of Artificial Sequence: Synthetic oligonucleotide
agccccaugcacugccac

SEQ ID NO: 2994 - RNA, 18 nt, Artificial Sequence
  Description of Artificial Sequence: Synthetic oligonucleotide
caagcagccccaugcacu

SEQ ID NO: 2995 - RNA, 18 nt, Artificial Sequence
  Description of Artificial Sequence: Synthetic oligonucleotide
ucaugcaagcagccccau

SEQ ID NO: 2996 - RNA, 18 nt, Artificial Sequence
  Description of Artificial Sequence: Synthetic oligonucleotide
ugaggucaugcaagcagc

SEQ ID NO: 2997 - RNA, 18 nt, Artificial Sequence
  Description of Artificial Sequence: Synthetic oligonucleotide
gacgaugaggucaugcaa

SEQ ID NO: 2998 - RNA, 18 nt, Artificial Sequence
  Description of Artificial Sequence: Synthetic oligonucleotide
gggcagacgaugagguca

SEQ ID NO: 2999 - RNA, 18 nt, Artificial Sequence
  Description of Artificial Sequence: Synthetic oligonucleotide
gacacgggcagacgauga

SEQ ID NO: 3000 - RNA, 18 nt, Artificial Sequence
  Description of Artificial Sequence: Synthetic oligonucleotide
gggaggacacgggcagac

SEQ ID NO: 3001 - RNA, 18 nt, Artificial Sequence
  Description of Artificial Sequence: Synthetic oligonucleotide
ggccagggaggacacggg

SEQ ID NO: 3002 - RNA, 18 nt, Artificial Sequence
  Description of Artificial Sequence: Synthetic oligonucleotide
gggcuggccagggaggac

SEQ ID NO: 3003 - RNA, 18 nt, Artificial Sequence
  Description of Artificial Sequence: Synthetic oligonucleotide
ccccugggcuggccaggg

SEQ ID NO: 3004 - RNA, 18 nt, Artificial Sequence
  Description of Artificial Sequence: Synthetic oligonucleotide
ggcucccccugggcuggc

SEQ ID NO: 3005 - RNA, 18 nt, Artificial Sequence
  Description of Artificial Sequence: Synthetic oligonucleotide
ucaccggcucccccuggg

SEQ ID NO: 3006 - RNA, 18 nt, Artificial Sequence
  Description of Artificial Sequence: Synthetic oligonucleotide
ccucgucaccggcucccc

SEQ ID NO: 3007 - RNA, 18 nt, Artificial Sequence
  Description of Artificial Sequence: Synthetic oligonucleotide
ccaccccucgucaccggc

SEQ ID NO: 3008 - RNA, 18 nt, Artificial Sequence
  Description of Artificial Sequence: Synthetic oligonucleotide
ccuuuccaccccucguca

SEQ ID NO: 3009 - RNA, 18 nt, Artificial Sequence
  Description of Artificial Sequence: Synthetic oligonucleotide
ugcaaccuuuccaccccu

SEQ ID NO: 3010 - RNA, 18 nt, Artificial Sequence
  Description of Artificial Sequence: Synthetic oligonucleotide
cagaaugcaaccuuucca

SEQ ID NO: 3011 - RNA, 18 nt, Artificial Sequence
  Description of Artificial Sequence: Synthetic oligonucleotide
gggacagaaugcaaccuu

SEQ ID NO: 3012 - RNA, 18 nt, Artificial Sequence
  Description of Artificial Sequence: Synthetic oligonucleotide
agcccgugcucauacggg

SEQ ID NO: 3013 - RNA, 18 nt, Artificial Sequence
  Description of Artificial Sequence: Synthetic oligonucleotide
caaccagcccgugcucau

SEQ ID NO: 3014 - RNA, 18 nt, Artificial Sequence
  Description of Artificial Sequence: Synthetic oligonucleotide
gcgugcaaccagcccgug

SEQ ID NO: 3015 - RNA, 18 nt, Artificial Sequence
  Description of Artificial Sequence: Synthetic oligonucleotide
gggaugcgugcaaccagc

SEQ ID NO: 3016 - RNA, 18 nt, Artificial Sequence
  Description of Artificial Sequence: Synthetic oligonucleotide
cggagcggcaccccgagg

SEQ ID NO: 3017 - RNA, 18 nt, Artificial Sequence
  Description of Artificial Sequence: Synthetic oligonucleotide
ucucucggagcggcaccc

SEQ ID NO: 3018 - RNA, 18 nt, Artificial Sequence
  Description of Artificial Sequence: Synthetic oligonucleotide
cuggcucucucggagcgg

SEQ ID NO: 3019 - RNA, 18 nt, Artificial Sequence
  Description of Artificial Sequence: Synthetic oligonucleotide
cacgccuggcucucucgg

SEQ ID NO: 3020 - RNA, 18 nt, Artificial Sequence
  Description of Artificial Sequence: Synthetic oligonucleotide
cccggcacgccuggcucu

SEQ ID NO: 3021 - RNA, 18 nt, Artificial Sequence
  Description of Artificial Sequence: Synthetic oligonucleotide
ugcugcccggcacgccug

SEQ ID NO: 3022 - RNA, 18 nt, Artificial Sequence
  Description of Artificial Sequence: Synthetic oligonucleotide
gaggcugcugcccggcac

SEQ ID NO: 3023 - RNA, 18 nt, Artificial Sequence
  Description of Artificial Sequence: Synthetic oligonucleotide
gggaggcugcugcccggc

SEQ ID NO: 3024 - RNA, 18 nt, Artificial Sequence
  Description of Artificial Sequence: Synthetic oligonucleotide
cacacugcggcccuuggg

SEQ ID NO: 3025 - RNA, 18 nt, Artificial Sequence
  Description of Artificial Sequence: Synthetic oligonucleotide
caacccacacugcggccc

SEQ ID NO: 3026 - RNA, 18 nt, Artificial Sequence
  Description of Artificial Sequence: Synthetic oligonucleotide
ucccccaacccacacugc

SEQ ID NO: 3027 - RNA, 18 nt, Artificial Sequence
  Description of Artificial Sequence: Synthetic oligonucleotide
gugucucccccaacccac

SEQ ID NO: 3028 - RNA, 18 nt, Artificial Sequence
  Description of Artificial Sequence: Synthetic oligonucleotide
gaguggugucucccccaa

SEQ ID NO: 3029 - RNA, 18 nt, Artificial Sequence
  Description of Artificial Sequence: Synthetic oligonucleotide
accaggaguggugucucc

SEQ ID NO: 3030 - RNA, 18 nt, Artificial Sequence
  Description of Artificial Sequence: Synthetic oligonucleotide
ccaaaaccaggaguggug

SEQ ID NO: 3031 - RNA, 18 nt, Artificial Sequence
  Description of Artificial Sequence: Synthetic oligonucleotide
aaaggccaaaaccaggag

SEQ ID NO: 3032 - RNA, 18 nt, Artificial Sequence
  Description of Artificial Sequence: Synthetic oligonucleotide
uacgaaaaggccaaaacc

SEQ ID NO: 3033 - RNA, 18 nt, Artificial Sequence
  Description of Artificial Sequence: Synthetic oligonucleotide
gagaauacgaaaaggcca

SEQ ID NO: 3034 - RNA, 18 nt, Artificial Sequence
  Description of Artificial Sequence: Synthetic oligonucleotide
uucuagagaauacgaaaa

SEQ ID NO: 3035 - RNA, 18 nt, Artificial Sequence
  Description of Artificial Sequence: Synthetic oligonucleotide
guccauucuagagaauac

SEQ ID NO: 3036 - RNA, 18 nt, Artificial Sequence
  Description of Artificial Sequence: Synthetic oligonucleotide
aaaacguccauucuagag

SEQ ID NO: 3037 - RNA, 18 nt, Artificial Sequence
  Description of Artificial Sequence: Synthetic oligonucleotide
gaagaaaaacguccauuc

SEQ ID NO: 3038 - RNA, 18 nt, Artificial Sequence
  Description of Artificial Sequence: Synthetic oligonucleotide
agcccgaagaaaaacguc

SEQ ID NO: 3039 - RNA, 18 nt, Artificial Sequence
  Description of Artificial Sequence: Synthetic oligonucleotide
aagaaagcccgaagaaaa

SEQ ID NO: 3040 - RNA, 18 nt, Artificial Sequence
  Description of Artificial Sequence: Synthetic oligonucleotide
uugagaagaaagcccgaa

SEQ ID NO: 3041 - RNA, 18 nt, Artificial Sequence
  Description of Artificial Sequence: Synthetic oligonucleotide
ccuuguugagaagaaagc

SEQ ID NO: 3042 - RNA, 18 nt, Artificial Sequence
  Description of Artificial Sequence: Synthetic oligonucleotide
auaaaccuuguugagaag

SEQ ID NO: 3043 - RNA, 18 nt, Artificial Sequence
  Description of Artificial Sequence: Synthetic oligonucleotide
aaaaaauaaaccuuguug

SEQ ID NO: 3044 - RNA, 18 nt, Artificial Sequence
  Description of Artificial Sequence: Synthetic oligonucleotide
acaacaaaaaauaaaccu

SEQ ID NO: 3045 - RNA, 18 nt, Artificial Sequence
  Description of Artificial Sequence: Synthetic oligonucleotide
cagcuacaacaaaaaaua

SEQ ID NO: 3046 - RNA, 18 nt, Artificial Sequence
  Description of Artificial Sequence: Synthetic oligonucleotide
ccuuucagcuacaacaaa

SEQ ID NO: 3047 - RNA, 18 nt, Artificial Sequence
  Description of Artificial Sequence: Synthetic oligonucleotide
uguucccuuucagcuaca

SEQ ID NO: 3048 - RNA, 18 nt, Artificial Sequence
  Description of Artificial Sequence: Synthetic oligonucleotide
ccccuuguucccuuucag

SEQ ID NO: 3049 - RNA, 18 nt, Artificial Sequence
  Description of Artificial Sequence: Synthetic oligonucleotide
aaaugccccuuguucccu

SEQ ID NO: 3050 - RNA, 18 nt, Artificial Sequence
  Description of Artificial Sequence: Synthetic oligonucleotide
uccacaaaugccccuugu

SEQ ID NO: 3051 - RNA, 18 nt, Artificial Sequence
  Description of Artificial Sequence: Synthetic oligonucleotide
cacccuccacaaaugccc

SEQ ID NO: 3052 - RNA, 18 nt, Artificial Sequence
  Description of Artificial Sequence: Synthetic oligonucleotide
cccagcacccuccacaaa

SEQ ID NO: 3053 - RNA, 18 nt, Artificial Sequence
  Description of Artificial Sequence: Synthetic oligonucleotide
cccaccccagcacccucc

SEQ ID NO: 3054 - RNA, 18 nt, Artificial Sequence
  Description of Artificial Sequence: Synthetic oligonucleotide
gcugccccaccccagcac

SEQ ID NO: 3055 - RNA, 18 nt, Artificial Sequence
  Description of Artificial Sequence: Synthetic oligonucleotide
cccaggcugccccacccc

SEQ ID NO: 3056 - RNA, 18 nt, Artificial Sequence
  Description of Artificial Sequence: Synthetic oligonucleotide
gcccucccaggcugcccc

SEQ ID NO: 3057 - RNA, 18 nt, Artificial Sequence
  Description of Artificial Sequence: Synthetic oligonucleotide
cccaggcccucccaggcu

SEQ ID NO: 3058 - RNA, 18 nt, Artificial Sequence
  Description of Artificial Sequence: Synthetic oligonucleotide
ccccacccaggcccuccc

SEQ ID NO: 3059 - RNA, 18 nt, Artificial Sequence
  Description of Artificial Sequence: Synthetic oligonucleotide
cuagcccccacccaggcc

SEQ ID NO: 3060 - RNA, 18 nt, Artificial Sequence
  Description of Artificial Sequence: Synthetic oligonucleotide
ggauccuagcccccaccc

SEQ ID NO: 3061 - RNA, 18 nt, Artificial Sequence
  Description of Artificial Sequence: Synthetic oligonucleotide
cugcaggauccuagcccc

SEQ ID NO: 3062 - RNA, 18 nt, Artificial Sequence
  Description of Artificial Sequence: Synthetic oligonucleotide
augcccugcaggauccua

SEQ ID NO: 3063 - RNA, 18 nt, Artificial Sequence
  Description of Artificial Sequence: Synthetic oligonucleotide
ugcccaugcccugcagga

SEQ ID NO: 3064 - RNA, 18 nt, Artificial Sequence
  Description of Artificial Sequence: Synthetic oligonucleotide
gcccaugcccaugcccug

SEQ ID NO: 3065 - RNA, 18 nt, Artificial Sequence
  Description of Artificial Sequence: Synthetic oligonucleotide
cccaggcccaugcccaug

SEQ ID NO: 3066 - RNA, 18 nt, Artificial Sequence
  Description of Artificial Sequence: Synthetic oligonucleotide
gggcccaggcccaugccc

SEQ ID NO: 3067 - RNA, 18 nt, Artificial Sequence
  Description of Artificial Sequence: Synthetic oligonucleotide
cuaagaccauggccuggg

SEQ ID NO: 3068 - RNA, 18 nt, Artificial Sequence
  Description of Artificial Sequence: Synthetic oligonucleotide
gagaacuaagaccauggc

SEQ ID NO: 3069 - RNA, 18 nt, Artificial Sequence
  Description of Artificial Sequence: Synthetic oligonucleotide
auacaaauuucauagccc

SEQ ID NO: 3070 - RNA, 18 nt, Artificial Sequence
  Description of Artificial Sequence: Synthetic oligonucleotide
uucugauacaaauuucau

SEQ ID NO: 3071 - RNA, 18 nt, Artificial Sequence
  Description of Artificial Sequence: Synthetic oligonucleotide
guucauucugauacaaau

SEQ ID NO: 3072 - RNA, 18 nt, Artificial Sequence
  Description of Artificial Sequence: Synthetic oligonucleotide
ugggaguucauucugaua

SEQ ID NO: 3073 - RNA, 18 nt, Artificial Sequence
  Description of Artificial Sequence: Synthetic oligonucleotide
gcuuaugggaguucauuc

SEQ ID NO: 3074 - RNA, 18 nt, Artificial Sequence
  Description of Artificial Sequence: Synthetic oligonucleotide
aagaggcuuaugggaguu

SEQ ID NO: 3075 - RNA, 18 nt, Artificial Sequence
  Description of Artificial Sequence: Synthetic oligonucleotide
cagggaagaggcuuaugg

SEQ ID NO: 3076 - RNA, 18 nt, Artificial Sequence
  Description of Artificial Sequence: Synthetic oligonucleotide
agugacagggaagaggcu

SEQ ID NO: 3077 - RNA, 18 nt, Artificial Sequence
  Description of Artificial Sequence: Synthetic oligonucleotide
cacccagugacagggaag

SEQ ID NO: 3078 - RNA, 18 nt, Artificial Sequence
  Description of Artificial Sequence: Synthetic oligonucleotide
cuccacacccagugacag

SEQ ID NO: 3079 - RNA, 18 nt, Artificial Sequence
  Description of Artificial Sequence: Synthetic oligonucleotide
cugagcuccacacccagu

SEQ ID NO: 3080 - RNA, 18 nt, Artificial Sequence
  Description of Artificial Sequence: Synthetic oligonucleotide
gcugccugagcuccacac

SEQ ID NO: 3081 - RNA, 18 nt, Artificial Sequence
  Description of Artificial Sequence: Synthetic oligonucleotide
gagcggcugccugagcuc

SEQ ID NO: 3082 - RNA, 18 nt, Artificial Sequence
  Description of Artificial Sequence: Synthetic oligonucleotide
caggcgagcggcugccug

SEQ ID NO: 3083 - RNA, 18 nt, Artificial Sequence
  Description of Artificial Sequence: Synthetic oligonucleotide
ucaggcaggcgagcggcu

SEQ ID NO: 3084 - RNA, 18 nt, Artificial Sequence
  Description of Artificial Sequence: Synthetic oligonucleotide
cacccucaggcaggcgag

SEQ ID NO: 3085 - RNA, 18 nt, Artificial Sequence
  Description of Artificial Sequence: Synthetic oligonucleotide
accgucacccucaggcag

SEQ ID NO: 3086 - RNA, 18 nt, Artificial Sequence
  Description of Artificial Sequence: Synthetic oligonucleotide
cuuccaccgucacccuca

SEQ ID NO: 3087 - RNA, 18 nt, Artificial Sequence
  Description of Artificial Sequence: Synthetic oligonucleotide
guggccuuccaccgucac

SEQ ID NO: 3088 - RNA, 18 nt, Artificial Sequence
  Description of Artificial Sequence: Synthetic oligonucleotide
cccauguggccuuccacc

SEQ ID NO: 3089 - RNA, 18 nt, Artificial Sequence
  Description of Artificial Sequence: Synthetic oligonucleotide
ggauccccauguggccuu

SEQ ID NO: 3090 - RNA, 18 nt, Artificial Sequence
  Description of Artificial Sequence: Synthetic oligonucleotide
gucugggauccccaugug

SEQ ID NO: 3091 - RNA, 18 nt, Artificial Sequence
  Description of Artificial Sequence: Synthetic oligonucleotide
cagaggucugggaucccc

SEQ ID NO: 3092 - RNA, 18 nt, Artificial Sequence
  Description of Artificial Sequence: Synthetic oligonucleotide
gcacacagaggucuggga

SEQ ID NO: 3093 - RNA, 18 nt, Artificial Sequence
  Description of Artificial Sequence: Synthetic oligonucleotide
ggcaagcacacagagguc

SEQ ID NO: 3094 - RNA, 18 nt, Artificial Sequence
  Description of Artificial Sequence: Synthetic oligonucleotide
ccuccggcaagcacacag

SEQ ID NO: 3095 - RNA, 18 nt, Artificial Sequence
  Description of Artificial Sequence: Synthetic oligonucleotide
ggcugccuccggcaagca

SEQ ID NO: 3096 - RNA, 18 nt, Artificial Sequence
  Description of Artificial Sequence: Synthetic oligonucleotide
ccgcaggcugccuccggc

SEQ ID NO: 3097 - RNA, 18 nt, Artificial Sequence
  Description of Artificial Sequence: Synthetic oligonucleotide
ucugcccgcaggcugccu

SEQ ID NO: 3098 - RNA, 18 nt, Artificial Sequence
  Description of Artificial Sequence: Synthetic oligonucleotide
ugcauucugcccgcaggc

SEQ ID NO: 3099 - RNA, 18 nt, Artificial Sequence
  Description of Artificial Sequence: Synthetic oligonucleotide
cagauugcauucugcccg

SEQ ID NO: 3100 - RNA, 18 nt, Artificial Sequence
  Description of Artificial Sequence: Synthetic oligonucleotide
aggcccagauugcauucu

SEQ ID NO: 3101 - RNA, 18 nt, Artificial Sequence
  Description of Artificial Sequence: Synthetic oligonucleotide
cagacaggcccagauugc

SEQ ID NO: 3102 - RNA, 18 nt, Artificial Sequence
  Description of Artificial Sequence: Synthetic oligonucleotide
ccacacagacaggcccag

SEQ ID NO: 3103 - RNA, 18 nt, Artificial Sequence
  Description of Artificial Sequence: Synthetic oligonucleotide
ggaggccacacagacagg

SEQ ID NO: 3104 - RNA, 18 nt, Artificial Sequence
  Description of Artificial Sequence: Synthetic oligonucleotide
gaggcggaggccacacag

SEQ ID NO: 3105 - RNA, 18 nt, Artificial Sequence
  Description of Artificial Sequence: Synthetic oligonucleotide
gcagagaggcggaggcca

SEQ ID NO: 3106 - RNA, 18 nt, Artificial Sequence
  Description of Artificial Sequence: Synthetic oligonucleotide
gucaugcagagaggcgga

SEQ ID NO: 3107 - RNA, 18 nt, Artificial Sequence
  Description of Artificial Sequence: Synthetic oligonucleotide
guguagucaugcagagag

SEQ ID NO: 3108 - RNA, 18 nt, Artificial Sequence
  Description of Artificial Sequence: Synthetic oligonucleotide
aaacgguguagucaugca

SEQ ID NO: 3109 - RNA, 18 nt, Artificial Sequence
  Description of Artificial Sequence: Synthetic oligonucleotide
uggcgaaacgguguaguc

SEQ ID NO: 3110 - RNA, 18 nt, Artificial Sequence
  Description of Artificial Sequence: Synthetic oligonucleotide
ccuccuggcgaaacggug

SEQ ID NO: 3111 - RNA, 18 nt, Artificial Sequence
  Description of Artificial Sequence: Synthetic oligonucleotide
uacggccuccuggcgaaa

SEQ ID NO: 3112 - RNA, 18 nt, Artificial Sequence
  Description of Artificial Sequence: Synthetic oligonucleotide
uagguuacggccuccugg

SEQ ID NO: 3113 - RNA, 18 nt, Artificial Sequence
  Description of Artificial Sequence: Synthetic oligonucleotide
agcacuagguuacggccu

SEQ ID NO: 3114 - RNA, 18 nt, Artificial Sequence
  Description of Artificial Sequence: Synthetic oligonucleotide
acgggagcacuagguuac

SEQ ID NO: 3115 - RNA, 18 nt, Artificial Sequence
  Description of Artificial Sequence: Synthetic oligonucleotide
agcccacgggagcacuag

SEQ ID NO: 3116 - RNA, 18 nt, Artificial Sequence
  Description of Artificial Sequence: Synthetic oligonucleotide
accgaagcccacgggagc

SEQ ID NO: 3117 - RNA, 18 nt, Artificial Sequence
  Description of Artificial Sequence: Synthetic oligonucleotide
cccucaccgaagcccacg

SEQ ID NO: 3118 - RNA, 18 nt, Artificial Sequence
  Description of Artificial Sequence: Synthetic oligonucleotide
caucccccucaccgaagc

SEQ ID NO: 3119 - RNA, 18 nt, Artificial Sequence
  Description of Artificial Sequence: Synthetic oligonucleotide
accgacaucccccucacc

SEQ ID NO: 3120 - RNA, 18 nt, Artificial Sequence
  Description of Artificial Sequence: Synthetic oligonucleotide
uagagaccgacauccccc

SEQ ID NO: 3121 - RNA, 18 nt, Artificial Sequence
  Description of Artificial Sequence: Synthetic oligonucleotide
gaggcuagagaccgacau

SEQ ID NO: 3122 - RNA, 18 nt, Artificial Sequence
  Description of Artificial Sequence: Synthetic oligonucleotide
cucaggaggcuagagacc

SEQ ID NO: 3123 - RNA, 18 nt, Artificial Sequence
  Description of Artificial Sequence: Synthetic oligonucleotide
gcagacucaggaggcuag

SEQ ID NO: 3124 - RNA, 18 nt, Artificial Sequence
  Description of Artificial Sequence: Synthetic oligonucleotide
ucggagcagacucaggag

SEQ ID NO: 3125 - RNA, 18 nt, Artificial Sequence
  Description of Artificial Sequence: Synthetic oligonucleotide
acuggucggagcagacuc

SEQ ID NO: 3126 - RNA, 18 nt, Artificial Sequence
  Description of Artificial Sequence: Synthetic oligonucleotide
ggccuacuggucggagca

SEQ ID NO: 3127 - RNA, 18 nt, Artificial Sequence
  Description of Artificial Sequence: Synthetic oligonucleotide
gaccaggccuacuggucg

SEQ ID NO: 3128 - RNA, 18 nt, Artificial Sequence
  Description of Artificial Sequence: Synthetic oligonucleotide
gggaagaccaggccuacu

SEQ ID NO: 3129 - RNA, 18 nt, Artificial Sequence
  Description of Artificial Sequence: Synthetic oligonucleotide
auugucccagagaacggg

SEQ ID NO: 3130 - RNA, 18 nt, Artificial Sequence
  Description of Artificial Sequence: Synthetic oligonucleotide
ccacauugucccagagaa

SEQ ID NO: 3131 - RNA, 18 nt, Artificial Sequence
  Description of Artificial Sequence: Synthetic oligonucleotide
guggaccacauuguccca

SEQ ID NO: 3132 - RNA, 18 nt, Artificial Sequence
  Description of Artificial Sequence: Synthetic oligonucleotide
aucacguggaccacauug

SEQ ID NO: 3133 - RNA, 18 nt, Artificial Sequence
  Description of Artificial Sequence: Synthetic oligonucleotide
ugagaaucacguggacca

SEQ ID NO: 3134 - RNA, 18 nt, Artificial Sequence
  Description of Artificial Sequence: Synthetic oligonucleotide
cagcuugagaaucacgug

SEQ ID NO: 3135 - RNA, 18 nt, Artificial Sequence
  Description of Artificial Sequence: Synthetic oligonucleotide
agccucagcuugagaauc

SEQ ID NO: 3136 - RNA, 18 nt, Artificial Sequence
  Description of Artificial Sequence: Synthetic oligonucleotide
cagcgagccucagcuuga

SEQ ID NO: 3137 - RNA, 18 nt, Artificial Sequence
  Description of Artificial Sequence: Synthetic oligonucleotide
cggcccagcgagccucag

SEQ ID NO: 3138 - RNA, 18 nt, Artificial Sequence
  Description of Artificial Sequence: Synthetic oligonucleotide
gugggcggcccagcgagc

SEQ ID NO: 3139 - RNA, 18 nt, Artificial Sequence
  Description of Artificial Sequence: Synthetic oligonucleotide
agggcgugggcggcccag

SEQ ID NO: 3140 - RNA, 18 nt, Artificial Sequence
  Description of Artificial Sequence: Synthetic oligonucleotide
ccaacagggcgugggcgg

SEQ ID NO: 3141 - RNA, 18 nt, Artificial Sequence
  Description of Artificial Sequence: Synthetic oligonucleotide
agaccccaacagggcgug

SEQ ID NO: 3142 - RNA, 18 nt, Artificial Sequence
  Description of Artificial Sequence: Synthetic oligonucleotide
cggaaagaccccaacagg

SEQ ID NO: 3143 - RNA, 18 nt, Artificial Sequence
  Description of Artificial Sequence: Synthetic oligonucleotide
ucgcucggaaagacccca

SEQ ID NO: 3144 - RNA, 18 nt, Artificial Sequence
  Description of Artificial Sequence: Synthetic oligonucleotide
ggaccucgcucggaaaga

SEQ ID NO: 3145 - RNA, 18 nt, Artificial Sequence
  Description of Artificial Sequence: Synthetic oligonucleotide
gcugaggaccucgcucgg

SEQ ID NO: 3146 - RNA, 18 nt, Artificial Sequence
  Description of Artificial Sequence: Synthetic oligonucleotide
gcacggcugaggaccucg

SEQ ID NO: 3147 - RNA, 18 nt, Artificial Sequence
  Description of Artificial Sequence: Synthetic oligonucleotide
cgcaugcacggcugagga

SEQ ID NO: 3148 - RNA, 18 nt, Artificial Sequence
  Description of Artificial Sequence: Synthetic oligonucleotide
cucaacgcaugcacggcu

SEQ ID NO: 3149 - RNA, 18 nt, Artificial Sequence
  Description of Artificial Sequence: Synthetic oligonucleotide
caaagcucaacgcaugca

SEQ ID NO: 3150 - RNA, 18 nt, Artificial Sequence
  Description of Artificial Sequence: Synthetic oligonucleotide
agggccaaagcucaacgc

SEQ ID NO: 3151 - RNA, 18 nt, Artificial Sequence
  Description of Artificial Sequence: Synthetic oligonucleotide
caccaagggccaaagcuc

SEQ ID NO: 3152 - RNA, 18 nt, Artificial Sequence
  Description of Artificial Sequence: Synthetic oligonucleotide
ccuaucaccaagggccaa

SEQ ID NO: 3153 - RNA, 18 nt, Artificial Sequence
  Description of Artificial Sequence: Synthetic oligonucleotide
agccaccuaucaccaagg

SEQ ID NO: 3154 - RNA, 18 nt, Artificial Sequence
  Description of Artificial Sequence: Synthetic oligonucleotide
ggccgagccaccuaucac

SEQ ID NO: 3155 - RNA, 18 nt, Artificial Sequence
  Description of Artificial Sequence: Synthetic oligonucleotide
gggcgggccgagccaccu

SEQ ID NO: 3156 - RNA, 18 nt, Artificial Sequence
  Description of Artificial Sequence: Synthetic oligonucleotide
agguagggcgggccgagc

SEQ ID NO: 3157 - RNA, 18 nt, Artificial Sequence
  Description of Artificial Sequence: Synthetic oligonucleotide
gugccagguagggcgggc

SEQ ID NO: 3158 - RNA, 18 nt, Artificial Sequence
  Description of Artificial Sequence: Synthetic oligonucleotide
ucagggugccagguaggg

SEQ ID NO: 3159 - RNA, 18 nt, Artificial Sequence
  Description of Artificial Sequence: Synthetic oligonucleotide
cagggucagggugccagg

SEQ ID NO: 3160 - RNA, 18 nt, Artificial Sequence
  Description of Artificial Sequence: Synthetic oligonucleotide
gugaccagggucagggug

SEQ ID NO: 3161 - RNA, 18 nt, Artificial Sequence
  Description of Artificial Sequence: Synthetic oligonucleotide
gagggacgucuguauccu

SEQ ID NO: 3162 - RNA, 18 nt, Artificial Sequence
  Description of Artificial Sequence: Synthetic oligonucleotide
cuggugagggacgucugu

SEQ ID NO: 3163 - RNA, 18 nt, Artificial Sequence
  Description of Artificial Sequence: Synthetic oligonucleotide
uggcacuggugagggacg

SEQ ID NO: 3164 - RNA, 18 nt, Artificial Sequence
  Description of Artificial Sequence: Synthetic oligonucleotide
caagcuggcacuggugag

SEQ ID NO: 3165 - RNA, 18 nt, Artificial Sequence
  Description of Artificial Sequence: Synthetic oligonucleotide
gaccccaagcuggcacug

SEQ ID NO: 3166 - RNA, 18 nt, Artificial Sequence
  Description of Artificial Sequence: Synthetic oligonucleotide
cugcagaccccaagcugg

SEQ ID NO: 3167 - RNA, 18 nt, Artificial Sequence
  Description of Artificial Sequence: Synthetic oligonucleotide
cucaucugcagaccccaa

SEQ ID NO: 3168 - RNA, 18 nt, Artificial Sequence
  Description of Artificial Sequence: Synthetic oligonucleotide
gaguucucaucugcagac

SEQ ID NO: 3169 - RNA, 18 nt, Artificial Sequence
  Description of Artificial Sequence: Synthetic oligonucleotide
ccacggaguucucaucug

SEQ ID NO: 3170 - RNA, 18 nt, Artificial Sequence
  Description of Artificial Sequence: Synthetic oligonucleotide
cugggccacggaguucuc

SEQ ID NO: 3171 - RNA, 18 nt, Artificial Sequence
  Description of Artificial Sequence: Synthetic oligonucleotide
ucagccugggccacggag

SEQ ID NO: 3172 - RNA, 18 nt, Artificial Sequence
  Description of Artificial Sequence: Synthetic oligonucleotide
uaucgucagccugggcca

SEQ ID NO: 3173 - RNA, 18 nt, Artificial Sequence
  Description of Artificial Sequence: Synthetic oligonucleotide
caggcuaucgucagccug

SEQ ID NO: 3174 - RNA, 18 nt, Artificial Sequence
  Description of Artificial Sequence: Synthetic oligonucleotide
uuuuucaggcuaucguca

SEQ ID NO: 3175 - RNA, 18 nt, Artificial Sequence
  Description of Artificial Sequence: Synthetic oligonucleotide
ggagguuuuucaggcuau

SEQ ID NO: 3176 - RNA, 18 nt, Artificial Sequence
  Description of Artificial Sequence: Synthetic oligonucleotide
cagguggagguuuuucag

SEQ ID NO: 3177 - RNA, 18 nt, Artificial Sequence
  Description of Artificial Sequence: Synthetic oligonucleotide
agcuccagguggagguuu

SEQ ID NO: 3178 - RNA, 18 nt, Artificial Sequence
  Description of Artificial Sequence: Synthetic oligonucleotide
ccgugagcuccaggugga

SEQ ID NO: 3179 - RNA, 18 nt, Artificial Sequence
  Description of Artificial Sequence: Synthetic oligonucleotide
gguuuccgugagcuccag

SEQ ID NO: 3180 - RNA, 18 nt, Artificial Sequence
  Description of Artificial Sequence: Synthetic oligonucleotide
agacagguuuccgugagc

SEQ ID NO: 3181 - RNA, 18 nt, Artificial Sequence
  Description of Artificial Sequence: Synthetic oligonucleotide
uguccagacagguuuccg

SEQ ID NO: 3182 - RNA, 18 nt, Artificial Sequence
  Description of Artificial Sequence: Synthetic oligonucleotide
caucauguccagacaggu

SEQ ID NO: 3183 - RNA, 18 nt, Artificial Sequence
  Description of Artificial Sequence: Synthetic oligonucleotide
cgagccaucauguccaga

SEQ ID NO: 3184 - RNA, 18 nt, Artificial Sequence
  Description of Artificial Sequence: Synthetic oligonucleotide
cguaucgagccaucaugu

SEQ ID NO: 3185 - RNA, 18 nt, Artificial Sequence
  Description of Artificial Sequence: Synthetic oligonucleotide
gaagacguaucgagccau

SEQ ID NO: 3186 - RNA, 18 nt, Artificial Sequence
  Description of Artificial Sequence: Synthetic oligonucleotide
uuggagaagacguaucga

SEQ ID NO: 3187 - RNA, 18 nt, Artificial Sequence
  Description of Artificial Sequence: Synthetic oligonucleotide
ugaaguuggagaagacgu

SEQ ID NO: 3188 - RNA, 18 nt, Artificial Sequence
  Description of Artificial Sequence: Synthetic oligonucleotide
agccgugaaguuggagaa

SEQ ID NO: 3189 - RNA, 18 nt, Artificial Sequence
  Description of Artificial Sequence: Synthetic oligonucleotide
gggacagccgugaaguug

SEQ ID NO: 3190 - RNA, 18 nt, Artificial Sequence
  Description of Artificial Sequence: Synthetic oligonucleotide
ucuucgggacagccguga

SEQ ID NO: 3191 - RNA, 18 nt, Artificial Sequence
  Description of Artificial Sequence: Synthetic oligonucleotide
gagugcuuccacugcgug

SEQ ID NO: 3192 - RNA, 18 nt, Artificial Sequence
  Description of Artificial Sequence: Synthetic oligonucleotide
uuccagagugcuuccacu

SEQ ID NO: 3193 - RNA, 18 nt, Artificial Sequence
  Description of Artificial Sequence: Synthetic oligonucleotide
ccgccuuccagagugcuu

SEQ ID NO: 3194 - RNA, 18 nt, Artificial Sequence
  Description of Artificial Sequence: Synthetic oligonucleotide
cgcgaccgccuuccagag

SEQ ID NO: 3195 - RNA, 18 nt, Artificial Sequence
  Description of Artificial Sequence: Synthetic oligonucleotide
agauccgcgaccgccuuc

SEQ ID NO: 3196 - RNA, 18 nt, Artificial Sequence
  Description of Artificial Sequence: Synthetic oligonucleotide
gcaacagauccgcgaccg

SEQ ID NO: 3197 - RNA, 18 nt, Artificial Sequence
  Description of Artificial Sequence: Synthetic oligonucleotide
cggcugcaacagauccgc

SEQ ID NO: 3198 - RNA, 18 nt, Artificial Sequence
  Description of Artificial Sequence: Synthetic oligonucleotide
cgcuccggcugcaacaga

SEQ ID NO: 3199 - RNA, 18 nt, Artificial Sequence
  Description of Artificial Sequence: Synthetic oligonucleotide
gcggccgcuccggcugca

SEQ ID NO: 3200 - RNA, 18 nt, Artificial Sequence
  Description of Artificial Sequence: Synthetic oligonucleotide
cuccagcggccgcuccgg

SEQ ID NO: 3201 - RNA, 18 nt, Artificial Sequence
  Description of Artificial Sequence: Synthetic oligonucleotide
cgggccuccagcggccgc

SEQ ID NO: 3202 - RNA, 18 nt, Artificial Sequence
  Description of Artificial Sequence: Synthetic oligonucleotide
cgugccgggccuccagcg

SEQ ID NO: 3203 - RNA, 18 nt, Artificial Sequence
  Description of Artificial Sequence: Synthetic oligonucleotide
caccgcgugccgggccuc

SEQ ID NO: 3204 - RNA, 18 nt, Artificial Sequence
  Description of Artificial Sequence: Synthetic oligonucleotide
gccagcaccgcgugccgg

SEQ ID NO: 3205 - RNA, 18 nt, Artificial Sequence
  Description of Artificial Sequence: Synthetic oligonucleotide
gcagagccagcaccgcgu

SEQ ID NO: 3206 - RNA, 18 nt, Artificial Sequence
  Description of Artificial Sequence: Synthetic oligonucleotide
cuucagcagagccagcac

SEQ ID NO: 3207 - RNA, 18 nt, Artificial Sequence
  Description of Artificial Sequence: Synthetic oligonucleotide
auggccuucagcagagcc

SEQ ID NO: 3208 - RNA, 18 nt, Artificial Sequence
  Description of Artificial Sequence: Synthetic oligonucleotide
gcacgauggccuucagca

SEQ ID NO: 3209 - RNA, 18 nt, Artificial Sequence
  Description of Artificial Sequence: Synthetic oligonucleotide
ccccugcacgauggccuu

SEQ ID NO: 3210 - RNA, 18 nt, Artificial Sequence
  Description of Artificial Sequence: Synthetic oligonucleotide
cccagcgucgcccugggc

SEQ ID NO: 3211 - RNA, 18 nt, Artificial Sequence
  Description of Artificial Sequence: Synthetic oligonucleotide
cccaucccagcgucgccc

SEQ ID NO: 3212 - RNA, 18 nt, Artificial Sequence
  Description of Artificial Sequence: Synthetic oligonucleotide
cgucacccaucccagcgu

SEQ ID NO: 3213 - RNA, 18 nt, Artificial Sequence
  Description of Artificial Sequence: Synthetic oligonucleotide
ccugacgucacccauccc

SEQ ID NO: 3214 - RNA, 18 nt, Artificial Sequence
  Description of Artificial Sequence: Synthetic oligonucleotide
ggcagccugacgucaccc

SEQ ID NO: 3215 - RNA, 18 nt, Artificial Sequence
  Description of Artificial Sequence: Synthetic oligonucleotide
cagugggcagccugacgu

SEQ ID NO: 3216 - RNA, 18 nt, Artificial Sequence
  Description of Artificial Sequence: Synthetic oligonucleotide
acagucagugggcagccu

SEQ ID NO: 3217 - RNA, 18 nt, Artificial Sequence
  Description of Artificial Sequence: Synthetic oligonucleotide
acaggacagucagugggc

SEQ ID NO: 3218 - RNA, 18 nt, Artificial Sequence
  Description of Artificial Sequence: Synthetic oligonucleotide
cagggacaggacagucag

SEQ ID NO: 3219 - RNA, 18 nt, Artificial Sequence
  Description of Artificial Sequence: Synthetic oligonucleotide
cccagcagggacaggaca

SEQ ID NO: 3220 - RNA, 18 nt, Artificial Sequence
  Description of Artificial Sequence: Synthetic oligonucleotide
cacggcccagcagggaca

SEQ ID NO: 3221 - RNA, 18 nt, Artificial Sequence
  Description of Artificial Sequence: Synthetic oligonucleotide
ccaaacacggcccagcag

SEQ ID NO: 3222 - RNA, 18 nt, Artificial Sequence
  Description of Artificial Sequence: Synthetic oligonucleotide
ggaguccaaacacggccc

SEQ ID NO: 3223 - RNA, 18 nt, Artificial Sequence
  Description of Artificial Sequence: Synthetic oligonucleotide
aggcaggaguccaaacac

SEQ ID NO: 3224 - RNA, 18 nt, Artificial Sequence
  Description of Artificial Sequence: Synthetic oligonucleotide
caccgaggcaggagucca

SEQ ID NO: 3225 - RNA, 18 nt, Artificial Sequence
  Description of Artificial Sequence: Synthetic oligonucleotide
caacucaccgaggcagga

SEQ ID NO: 3226 - RNA, 18 nt, Artificial Sequence
  Description of Artificial Sequence: Synthetic oligonucleotide
cccagcaacucaccgagg

SEQ ID NO: 3227 - RNA, 18 nt, Artificial Sequence
  Description of Artificial Sequence: Synthetic oligonucleotide
cugugcccagcaacucac

SEQ ID NO: 3228 - RNA, 18 nt, Artificial Sequence
  Description of Artificial Sequence: Synthetic oligonucleotide
agacccugugcccagcaa

SEQ ID NO: 3229 - RNA, 18 nt, Artificial Sequence
  Description of Artificial Sequence: Synthetic oligonucleotide
ccccuagacccugugccc

SEQ ID NO: 3230 - RNA, 18 nt, Artificial Sequence
  Description of Artificial Sequence: Synthetic oligonucleotide
aucagccccuagacccug

SEQ ID NO: 3231 - RNA, 18 nt, Artificial Sequence
  Description of Artificial Sequence: Synthetic oligonucleotide
agcccaucagccccuaga

SEQ ID NO: 3232 - RNA, 18 nt, Artificial Sequence
  Description of Artificial Sequence: Synthetic oligonucleotide
uccagagcccaucagccc

SEQ ID NO: 3233 - RNA, 18 nt, Artificial Sequence
  Description of Artificial Sequence: Synthetic oligonucleotide
ccagcuccagagcccauc

SEQ ID NO: 3234 - RNA, 18 nt, Artificial Sequence
  Description of Artificial Sequence: Synthetic oligonucleotide
gccauccagcuccagagc

SEQ ID NO: 3235 - RNA, 18 nt, Artificial Sequence
  Description of Artificial Sequence: Synthetic oligonucleotide
cacaggccauccagcucc

SEQ ID NO: 3236 - RNA, 18 nt, Artificial Sequence
  Description of Artificial Sequence: Synthetic oligonucleotide
gaccccacaggccaucca

SEQ ID NO: 3237 - RNA, 18 nt, Artificial Sequence
  Description of Artificial Sequence: Synthetic oligonucleotide
caggagaccccacaggcc

SEQ ID NO: 3238 - RNA, 18 nt, Artificial Sequence
  Description of Artificial Sequence: Synthetic oligonucleotide
gacaccaggagaccccac

SEQ ID NO: 3239 - RNA, 18 nt, Artificial Sequence
  Description of Artificial Sequence: Synthetic oligonucleotide
cucaugacaccaggagac

SEQ ID NO: 3240 - RNA, 18 nt, Artificial Sequence
  Description of Artificial Sequence: Synthetic oligonucleotide
cagaccucaugacaccag

SEQ ID NO: 3241 - RNA, 18 nt, Artificial Sequence
  Description of Artificial Sequence: Synthetic oligonucleotide
ucacacagaccucaugac

SEQ ID NO: 3242 - RNA, 18 nt, Artificial Sequence
  Description of Artificial Sequence: Synthetic oligonucleotide
uacggucacacagaccuc

SEQ ID NO: 3243 - RNA, 18 nt, Artificial Sequence
  Description of Artificial Sequence: Synthetic oligonucleotide
gugccuacggucacacag

SEQ ID NO: 3244 - RNA, 18 nt, Artificial Sequence
  Description of Artificial Sequence: Synthetic oligonucleotide
aggcagugccuacgguca

SEQ ID NO: 3245 - RNA, 18 nt, Artificial Sequence
  Description of Artificial Sequence: Synthetic oligonucleotide
cgaggaggcagugccuac

SEQ ID NO: 3246 - RNA, 18 nt, Artificial Sequence
  Description of Artificial Sequence: Synthetic oligonucleotide
acaggcgaggaggcagug

SEQ ID NO: 3247 - RNA, 18 nt, Artificial Sequence
  Description of Artificial Sequence: Synthetic oligonucleotide
uguuuacaggcgaggagg

SEQ ID NO: 3248 - RNA, 18 nt, Artificial Sequence
  Description of Artificial Sequence: Synthetic oligonucleotide
ccaucuguuuacaggcga

SEQ ID NO: 3249 - RNA, 18 nt, Artificial Sequence
  Description of Artificial Sequence: Synthetic oligonucleotide
agugaccaucuguuuaca

SEQ ID NO: 3250 - RNA, 18 nt, Artificial Sequence
  Description of Artificial Sequence: Synthetic oligonucleotide
ggugcagugaccaucugu

SEQ ID NO: 3251 - RNA, 18 nt, Artificial Sequence
  Description of Artificial Sequence: Synthetic oligonucleotide
aggaaggugcagugacca

SEQ ID NO: 3252 - RNA, 18 nt, Artificial Sequence
  Description of Artificial Sequence: Synthetic oligonucleotide
auaagaggaaggugcagu

SEQ ID NO: 3253 - RNA, 18 nt, Artificial Sequence
  Description of Artificial Sequence: Synthetic oligonucleotide
aucccauaagaggaaggu

SEQ ID NO: 3254 - RNA, 18 nt, Artificial Sequence
  Description of Artificial Sequence: Synthetic oligonucleotide
agaacaucccauaagagg

SEQ ID NO: 3255 - RNA, 18 nt, Artificial Sequence
  Description of Artificial Sequence: Synthetic oligonucleotide
uccccagaacaucccaua

SEQ ID NO: 3256 - RNA, 18 nt, Artificial Sequence
  Description of Artificial Sequence: Synthetic oligonucleotide
uaugauccccagaacauc

SEQ ID NO: 3257 - RNA, 18 nt, Artificial Sequence
  Description of Artificial Sequence: Synthetic oligonucleotide
ccucauaugauccccaga

SEQ ID NO: 3258 - RNA, 18 nt, Artificial Sequence
  Description of Artificial Sequence: Synthetic oligonucleotide
aacugccucauaugaucc

SEQ ID NO: 3259 - RNA, 18 nt, Artificial Sequence
  Description of Artificial Sequence: Synthetic oligonucleotide
gcgagaacugccucauau

SEQ ID NO: 3260 - RNA, 18 nt, Artificial Sequence
  Description of Artificial Sequence: Synthetic oligonucleotide
acucugcgagaacugccu

SEQ ID NO: 3261 - RNA, 18 nt, Artificial Sequence
  Description of Artificial Sequence: Synthetic oligonucleotide
ucagcacucugcgagaac

SEQ ID NO: 3262 - RNA, 18 nt, Artificial Sequence
  Description of Artificial Sequence: Synthetic oligonucleotide
cgaucucagcacucugcg

SEQ ID NO: 3263 - RNA, 18 nt, Artificial Sequence
  Description of Artificial Sequence: Synthetic oligonucleotide
agguacgaucucagcacu

SEQ ID NO: 3264 - RNA, 18 nt, Artificial Sequence
  Description of Artificial Sequence: Synthetic oligonucleotide
cugccagguacgaucuca

SEQ ID NO: 3265 - RNA, 18 nt, Artificial Sequence
  Description of Artificial Sequence: Synthetic oligonucleotide
accagcugccagguacga

SEQ ID NO: 3266 - RNA, 18 nt, Artificial Sequence
  Description of Artificial Sequence: Synthetic oligonucleotide
cccacaccagcugccagg

SEQ ID NO: 3267 - RNA, 18 nt, Artificial Sequence
  Description of Artificial Sequence: Synthetic oligonucleotide
guagccccacaccagcug

SEQ ID NO: 3268 - RNA, 18 nt, Artificial Sequence
  Description of Artificial Sequence: Synthetic oligonucleotide
acaccguagccccacacc

SEQ ID NO: 3269 - RNA, 18 nt, Artificial Sequence
  Description of Artificial Sequence: Synthetic oligonucleotide
aaacaacaccguagcccc

SEQ ID NO: 3270 - RNA, 18 nt, Artificial Sequence
  Description of Artificial Sequence: Synthetic oligonucleotide
gggcaaaacaacaccgua

SEQ ID NO: 3271 - RNA, 18 nt, Artificial Sequence
  Description of Artificial Sequence: Synthetic oligonucleotide
ugcaagggcaaaacaaca

SEQ ID NO: 3272 - RNA, 18 nt, Artificial Sequence
  Description of Artificial Sequence: Synthetic oligonucleotide
aagggugcaagggcaaaa

SEQ ID NO: 3273 - RNA, 18 nt, Artificial Sequence
  Description of Artificial Sequence: Synthetic oligonucleotide
cccgaaagggugcaaggg

SEQ ID NO: 3274 - RNA, 18 nt, Artificial Sequence
  Description of Artificial Sequence: Synthetic oligonucleotide
guggccccgaaagggugc

SEQ ID NO: 3275 - RNA, 18 nt, Artificial Sequence
  Description of Artificial Sequence: Synthetic oligonucleotide
gggaguggccccgaaagg

SEQ ID NO: 3276 - RNA, 18 nt, Artificial Sequence
  Description of Artificial Sequence: Synthetic oligonucleotide
ggaaugcagugagcaggg

SEQ ID NO: 3277 - RNA, 18 nt, Artificial Sequence
  Description of Artificial Sequence: Synthetic oligonucleotide
cagauggaaugcagugag

SEQ ID NO: 3278 - RNA, 18 nt, Artificial Sequence
  Description of Artificial Sequence: Synthetic oligonucleotide
cagcacagauggaaugca

SEQ ID NO: 3279 - RNA, 18 nt, Artificial Sequence
  Description of Artificial Sequence: Synthetic oligonucleotide
aagaccagcacagaugga

SEQ ID NO: 3280 - RNA, 18 nt, Artificial Sequence
  Description of Artificial Sequence: Synthetic oligonucleotide
cagccaagaccagcacag

SEQ ID NO: 3281 - RNA, 18 nt, Artificial Sequence
  Description of Artificial Sequence: Synthetic oligonucleotide
agggucagccaagaccag

SEQ ID NO: 3282 - RNA, 18 nt, Artificial Sequence
  Description of Artificial Sequence: Synthetic oligonucleotide
uguucagggucagccaag

SEQ ID NO: 3283 - RNA, 18 nt, Artificial Sequence
  Description of Artificial Sequence: Synthetic oligonucleotide
cuggguguucagggucag

SEQ ID NO: 3284 - RNA, 18 nt, Artificial Sequence
  Description of Artificial Sequence: Synthetic oligonucleotide
gaggccuggguguucagg

SEQ ID NO: 3285 - RNA, 18 nt, Artificial Sequence
  Description of Artificial Sequence: Synthetic oligonucleotide
accaagaggccugggugu

SEQ ID NO: 3286 - RNA, 18 nt, Artificial Sequence
  Description of Artificial Sequence: Synthetic oligonucleotide
ggaacaccaagaggccug

SEQ ID NO: 3287 - RNA, 18 nt, Artificial Sequence
  Description of Artificial Sequence: Synthetic oligonucleotide
aggcaggaacaccaagag

SEQ ID NO: 3288 - RNA, 18 nt, Artificial Sequence
  Description of Artificial Sequence: Synthetic oligonucleotide
gggaggcaggaacaccaa

SEQ ID NO: 3289 - RNA, 18 nt, Artificial Sequence
  Description of Artificial Sequence: Synthetic oligonucleotide
agaaguggccgaccaggg

SEQ ID NO: 3290 - RNA, 18 nt, Artificial Sequence
  Description of Artificial Sequence: Synthetic oligonucleotide
ggaguagaaguggccgac

SEQ ID NO: 3291 - RNA, 18 nt, Artificial Sequence
  Description of Artificial Sequence: Synthetic oligonucleotide
augaaggaguagaagugg

SEQ ID NO: 3292 - RNA, 18 nt, Artificial Sequence
  Description of Artificial Sequence: Synthetic oligonucleotide
gggacaugaaggaguaga

SEQ ID NO: 3293 - RNA, 18 nt, Artificial Sequence
  Description of Artificial Sequence: Synthetic oligonucleotide
gaacaccaagaggccugg

SEQ ID NO: 3294 - RNA, 18 nt, Artificial Sequence
  Description of Artificial Sequence: Synthetic oligonucleotide
ggcaggaacaccaagagg

SEQ ID NO: 3295 - RNA, 18 nt, Artificial Sequence
  Description of Artificial Sequence: Synthetic oligonucleotide
agaaguggccgaccaggg

SEQ ID NO: 3296 - RNA, 18 nt, Artificial Sequence
  Description of Artificial Sequence: Synthetic oligonucleotide
ggaguagaaguggccgac

SEQ ID NO: 3297 - RNA, 18 nt, Artificial Sequence
  Description of Artificial Sequence: Synthetic oligonucleotide
augaaggaguagaagugg

SEQ ID NO: 3298 - RNA, 18 nt, Artificial Sequence
  Description of Artificial Sequence: Synthetic oligonucleotide
gggacaugaaggaguaga

SEQ ID NO: 3299 - RNA, 18 nt, Artificial Sequence
  Description of Artificial Sequence: Synthetic oligonucleotide
cagcugggacaugaagga

SEQ ID NO: 3300 - RNA, 18 nt, Artificial Sequence
  Description of Artificial Sequence: Synthetic oligonucleotide
cugagcagcugggacaug

SEQ ID NO: 3301 - RNA, 18 nt, Artificial Sequence
  Description of Artificial Sequence: Synthetic oligonucleotide
cccuucugagcagcuggg

SEQ ID NO: 3302 - RNA, 18 nt, Artificial Sequence
  Description of Artificial Sequence: Synthetic oligonucleotide
gacggcccuucugagcag

SEQ ID NO: 3303 - RNA, 18 nt, Artificial Sequence
  Description of Artificial Sequence: Synthetic oligonucleotide
gaguggacggcccuucug

SEQ ID NO: 3304 - RNA, 18 nt, Artificial Sequence
  Description of Artificial Sequence: Synthetic oligonucleotide
ugugagaguggacggccc

SEQ ID NO: 3305 - RNA, 18 nt, Artificial Sequence
  Description of Artificial Sequence: Synthetic oligonucleotide
gagccugugagaguggac

SEQ ID NO: 3306 - RNA, 18 nt, Artificial Sequence
  Description of Artificial Sequence: Synthetic oligonucleotide
caggagagccugugagag

SEQ ID NO: 3307 - RNA, 18 nt, Artificial Sequence
  Description of Artificial Sequence: Synthetic oligonucleotide
aaacccaggagagccugu

SEQ ID NO: 3308 - RNA, 18 nt, Artificial Sequence
  Description of Artificial Sequence: Synthetic oligonucleotide
ggacaaggccugaguggg

SEQ ID NO: 3309 - RNA, 18 nt, Artificial Sequence
  Description of Artificial Sequence: Synthetic oligonucleotide
acugaggacaaggccuga

SEQ ID NO: 3310 - RNA, 18 nt, Artificial Sequence
  Description of Artificial Sequence: Synthetic oligonucleotide
cagagacugaggacaagg

SEQ ID NO: 3311 - RNA, 18 nt, Artificial Sequence
  Description of Artificial Sequence: Synthetic oligonucleotide
gugcucagagacugagga

SEQ ID NO: 3312 - RNA, 18 nt, Artificial Sequence
  Description of Artificial Sequence: Synthetic oligonucleotide
gccuugugcucagagacu

SEQ ID NO: 3313 - RNA, 18 nt, Artificial Sequence
  Description of Artificial Sequence: Synthetic oligonucleotide
agacagccuugugcucag

SEQ ID NO: 3314 - RNA, 18 nt, Artificial Sequence
  Description of Artificial Sequence: Synthetic oligonucleotide
agggcagacagccuugug

SEQ ID NO: 3315 - RNA, 18 nt, Artificial Sequence
  Description of Artificial Sequence: Synthetic oligonucleotide
ggugcagggcagacagcc

SEQ ID NO: 3316 - RNA, 18 nt, Artificial Sequence
  Description of Artificial Sequence: Synthetic oligonucleotide
cacucggugcagggcaga

SEQ ID NO: 3317 - RNA, 18 nt, Artificial Sequence
  Description of Artificial Sequence: Synthetic oligonucleotide
cccugcacucggugcagg

SEQ ID NO: 3318 - RNA, 18 nt, Artificial Sequence
  Description of Artificial Sequence: Synthetic oligonucleotide
ccgaccccugcacucggu

SEQ ID NO: 3319 - RNA, 18 nt, Artificial Sequence
  Description of Artificial Sequence: Synthetic oligonucleotide
ccugcccgaccccugcac

SEQ ID NO: 3320 - RNA, 18 nt, Artificial Sequence
  Description of Artificial Sequence: Synthetic oligonucleotide
cagcuccugcccgacccc

SEQ ID NO: 3321 - RNA, 18 nt, Artificial Sequence
  Description of Artificial Sequence: Synthetic oligonucleotide
ugacacagcuccugcccg

SEQ ID NO: 3322 - RNA, 18 nt, Artificial Sequence
  Description of Artificial Sequence: Synthetic oligonucleotide
ggguggcgcagagcaggg

SEQ ID NO: 3323 - RNA, 18 nt, Artificial Sequence
  Description of Artificial Sequence: Synthetic oligonucleotide
acagcggguggcgcagag

SEQ ID NO: 3324 - RNA, 18 nt, Artificial Sequence
  Description of Artificial Sequence: Synthetic oligonucleotide
cuggcacagcggguggcg

SEQ ID NO: 3325 - RNA, 18 nt, Artificial Sequence
  Description of Artificial Sequence: Synthetic oligonucleotide
gggaccuggcacagcggg

SEQ ID NO: 3326 - RNA, 18 nt, Artificial Sequence
  Description of Artificial Sequence: Synthetic oligonucleotide
gugucgggaccuggcaca

SEQ ID NO: 3327 - RNA, 18 nt, Artificial Sequence
  Description of Artificial Sequence: Synthetic oligonucleotide
gcugugugucgggaccug

SEQ ID NO: 3328 - RNA, 18 nt, Artificial Sequence
  Description of Artificial Sequence: Synthetic oligonucleotide
caacugcugugugucggg

SEQ ID NO: 3329 - RNA, 18 nt, Artificial Sequence
  Description of Artificial Sequence: Synthetic oligonucleotide
gggagcaacugcugugug

SEQ ID NO: 3330 - RNA, 18 nt, Artificial Sequence
  Description of Artificial Sequence: Synthetic oligonucleotide
cgcagagcggcguauggg

SEQ ID NO: 3331 - RNA, 18 nt, Artificial Sequence
  Description of Artificial Sequence: Synthetic oligonucleotide
gaccgcagagcggcguau

SEQ ID NO: 3332 - RNA, 18 nt, Artificial Sequence
  Description of Artificial Sequence: Synthetic oligonucleotide
cggccgaccgcagagcgg

SEQ ID NO: 3333 - RNA, 18 nt, Artificial Sequence
  Description of Artificial Sequence: Synthetic oligonucleotide
ugcaccggccgaccgcag

SEQ ID NO: 3334 - RNA, 18 nt, Artificial Sequence
  Description of Artificial Sequence: Synthetic oligonucleotide
ccggaugcaccggccgac

SEQ ID NO: 3335 - RNA, 18 nt, Artificial Sequence
  Description of Artificial Sequence: Synthetic oligonucleotide
gcauuguacagggcaggg

SEQ ID NO: 3336 - RNA, 18 nt, Artificial Sequence
  Description of Artificial Sequence: Synthetic oligonucleotide
caucagcauuguacaggg

SEQ ID NO: 3337 - RNA, 18 nt, Artificial Sequence
  Description of Artificial Sequence: Synthetic oligonucleotide
ugcagcaucagcauugua

SEQ ID NO: 3338 - RNA, 18 nt, Artificial Sequence
  Description of Artificial Sequence: Synthetic oligonucleotide
aggucugcagcaucagca

SEQ ID NO: 3339 - RNA, 18 nt, Artificial Sequence
  Description of Artificial Sequence: Synthetic oligonucleotide
gagacaggucugcagcau

SEQ ID NO: 3340 - RNA, 18 nt, Artificial Sequence
  Description of Artificial Sequence: Synthetic oligonucleotide
ugcaagagacaggucugc

SEQ ID NO: 3341 - RNA, 18 nt, Artificial Sequence
  Description of Artificial Sequence: Synthetic oligonucleotide
cgcccugcaagagacagg

SEQ ID NO: 3342 - RNA, 18 nt, Artificial Sequence
  Description of Artificial Sequence: Synthetic oligonucleotide
agaggcgcccugcaagag

SEQ ID NO: 3343 - RNA, 18 nt, Artificial Sequence
  Description of Artificial Sequence: Synthetic oligonucleotide
cccacagaggcgcccugc

SEQ ID NO: 3344 - RNA, 18 nt, Artificial Sequence
  Description of Artificial Sequence: Synthetic oligonucleotide
uccuucccacagaggcgc

SEQ ID NO: 3345 - RNA, 18 nt, Artificial Sequence
  Description of Artificial Sequence: Synthetic oligonucleotide
cccucuccuucccacaga

SEQ ID NO: 3346 - RNA, 18 nt, Artificial Sequence
  Description of Artificial Sequence: Synthetic oligonucleotide
uggaccccucuccuuccc

SEQ ID NO: 3347 - RNA, 18 nt, Artificial Sequence
  Description of Artificial Sequence: Synthetic oligonucleotide
agcccuggaccccucucc

SEQ ID NO: 3348 - RNA, 18 nt, Artificial Sequence
  Description of Artificial Sequence: Synthetic oligonucleotide
acuccagcccuggacccc

SEQ ID NO: 3349 - RNA, 18 nt, Artificial Sequence
  Description of Artificial Sequence: Synthetic oligonucleotide
cccggacuccagcccugg

SEQ ID NO: 3350 - RNA, 18 nt, Artificial Sequence
  Description of Artificial Sequence: Synthetic oligonucleotide
gggcacccggacuccagc

SEQ ID NO: 3351 - RNA, 18 nt, Artificial Sequence
  Description of Artificial Sequence: Synthetic oligonucleotide
agucccugaagugcaggg

SEQ ID NO: 3352 - RNA, 18 nt, Artificial Sequence
  Description of Artificial Sequence: Synthetic oligonucleotide
aagucccugaagugcagg

SEQ ID NO: 3353 - RNA, 18 nt, Artificial Sequence
  Description of Artificial Sequence: Synthetic oligonucleotide
ccaagaagucccugaagu

SEQ ID NO: 3354 - RNA, 18 nt, Artificial Sequence
  Description of Artificial Sequence: Synthetic oligonucleotide
ggcugccaagaagucccu

SEQ ID NO: 3355 - RNA, 18 nt, Artificial Sequence
  Description of Artificial Sequence: Synthetic oligonucleotide
cacacggcugccaagaag

SEQ ID NO: 3356 - RNA, 18 nt, Artificial Sequence
  Description of Artificial Sequence: Synthetic oligonucleotide
ucgcccacacggcugcca

SEQ ID NO: 3357 - RNA, 18 nt, Artificial Sequence
  Description of Artificial Sequence: Synthetic oligonucleotide
cagcgucgcccacacggc

SEQ ID NO: 3358 - RNA, 18 nt, Artificial Sequence
  Description of Artificial Sequence: Synthetic oligonucleotide
ccugccagcgucgcccac

SEQ ID NO: 3359 - RNA, 18 nt, Artificial Sequence
  Description of Artificial Sequence: Synthetic oligonucleotide
cagagccugccagcgucg

SEQ ID NO: 3360 - RNA, 18 nt, Artificial Sequence
  Description of Artificial Sequence: Synthetic oligonucleotide
aucagcagagccugccag

SEQ ID NO: 3361 - RNA, 18 nt, Artificial Sequence
  Description of Artificial Sequence: Synthetic oligonucleotide
acaggaucagcagagccu

SEQ ID NO: 3362 - RNA, 18 nt, Artificial Sequence
  Description of Artificial Sequence: Synthetic oligonucleotide
ggacccccaaacgcucgc

SEQ ID NO: 3363 - RNA, 18 nt, Artificial Sequence
  Description of Artificial Sequence: Synthetic oligonucleotide
ucugaggacccccaaacg

SEQ ID NO: 3364 - RNA, 18 nt, Artificial Sequence
  Description of Artificial Sequence: Synthetic oligonucleotide
agggcucugaggaccccc

SEQ ID NO: 3365 - RNA, 18 nt, Artificial Sequence
  Description of Artificial Sequence: Synthetic oligonucleotide
agaagagggcucugagga

SEQ ID NO: 3366 - RNA, 18 nt, Artificial Sequence
  Description of Artificial Sequence: Synthetic oligonucleotide
cuuaaagaagagggcucu

SEQ ID NO: 3367 - RNA, 18 nt, Artificial Sequence
  Description of Artificial Sequence: Synthetic oligonucleotide
augaccuuaaagaagagg

SEQ ID NO: 3368 - RNA, 18 nt, Artificial Sequence
  Description of Artificial Sequence: Synthetic oligonucleotide
ccuugaugaccuuaaaga

SEQ ID NO: 3369 - RNA, 18 nt, Artificial Sequence
  Description of Artificial Sequence: Synthetic oligonucleotide
guaauccuugaugaccuu

SEQ ID NO: 3370 - RNA, 18 nt, Artificial Sequence
  Description of Artificial Sequence: Synthetic oligonucleotide
gaaggguaauccuugaug

SEQ ID NO: 3371 - RNA, 18 nt, Artificial Sequence
  Description of Artificial Sequence: Synthetic oligonucleotide
cguuggaaggguaauccu

SEQ ID NO: 3372 - RNA, 18 nt, Artificial Sequence
  Description of Artificial Sequence: Synthetic oligonucleotide
gucuucguuggaagggua

SEQ ID NO: 3373 - RNA, 18 nt, Artificial Sequence
  Description of Artificial Sequence: Synthetic oligonucleotide
ugaaggucuucguuggaa

SEQ ID NO: 3374 - RNA, 18 nt, Artificial Sequence
  Description of Artificial Sequence: Synthetic oligonucleotide
uuucgugaaggucuucgu

SEQ ID NO: 3375 - RNA, 18 nt, Artificial Sequence
  Description of Artificial Sequence: Synthetic oligonucleotide
cagccuuucgugaagguc

SEQ ID NO: 3376 - RNA, 18 nt, Artificial Sequence
  Description of Artificial Sequence: Synthetic oligonucleotide
accuccagccuuucguga

SEQ ID NO: 3377 - RNA, 18 nt, Artificial Sequence
  Description of Artificial Sequence: Synthetic oligonucleotide
ugaaaaccuccagccuuu

SEQ ID NO: 3378 - RNA, 18 nt, Artificial Sequence
  Description of Artificial Sequence: Synthetic oligonucleotide
ggccuugaaaaccuccag

SEQ ID NO: 3379 - RNA, 18 nt, Artificial Sequence
  Description of Artificial Sequence: Synthetic oligonucleotide
gugagggccuugaaaacc

SEQ ID NO: 3380 - RNA, 18 nt, Artificial Sequence
  Description of Artificial Sequence: Synthetic oligonucleotide
ugucugugagggccuuga

SEQ ID NO: 3381 - RNA, 18 nt, Artificial Sequence
  Description of Artificial Sequence: Synthetic oligonucleotide
cccauugucugugagggc

SEQ ID NO: 3382 - RNA, 18 nt, Artificial Sequence
  Description of Artificial Sequence: Synthetic oligonucleotide
ugucucccauugucugug

SEQ ID NO: 3383 - RNA, 18 nt, Artificial Sequence
  Description of Artificial Sequence: Synthetic oligonucleotide
ugaugugucucccauugu

SEQ ID NO: 3384 - RNA, 18 nt, Artificial Sequence
  Description of Artificial Sequence: Synthetic oligonucleotide
guaggugaugugucuccc

SEQ ID NO: 3385 - RNA, 18 nt, Artificial Sequence
  Description of Artificial Sequence: Synthetic oligonucleotide
uccaaguaggugaugugu

SEQ ID NO: 3386 - RNA, 18 nt, Artificial Sequence
  Description of Artificial Sequence: Synthetic oligonucleotide
cuuccuccaaguagguga

SEQ ID NO: 3387 - RNA, 18 nt, Artificial Sequence
  Description of Artificial Sequence: Synthetic oligonucleotide
cagcucuuccuccaagua

SEQ ID NO: 3388 - RNA, 18 nt, Artificial Sequence
  Description of Artificial Sequence: Synthetic oligonucleotide
ucaucagccagcuggugu

SEQ ID NO: 3389 - RNA, 18 nt, Artificial Sequence
  Description of Artificial Sequence: Synthetic oligonucleotide
caggcucaucagccagcu

SEQ ID NO: 3390 - RNA, 18 nt, Artificial Sequence
  Description of Artificial Sequence: Synthetic oligonucleotide
uucuccaggcucaucagc

SEQ ID NO: 3391 - RNA, 18 nt, Artificial Sequence
  Description of Artificial Sequence: Synthetic oligonucleotide
gcggguucuccaggcuca

SEQ ID NO: 3392 - RNA, 18 nt, Artificial Sequence
  Description of Artificial Sequence: Synthetic oligonucleotide
gcugagcggguucuccag

SEQ ID NO: 3393 - RNA, 18 nt, Artificial Sequence
  Description of Artificial Sequence: Synthetic oligonucleotide
aaagggcugagcggguuc

SEQ ID NO: 3394 - RNA, 18 nt, Artificial Sequence
  Description of Artificial Sequence: Synthetic oligonucleotide
aggagaaagggcugagcg

SEQ ID NO: 3395 - RNA, 18 nt, Artificial Sequence
  Description of Artificial Sequence: Synthetic oligonucleotide
guccgaggagaaagggcu

SEQ ID NO: 3396 - RNA, 18 nt, Artificial Sequence
  Description of Artificial Sequence: Synthetic oligonucleotide
uugauguccgaggagaaa

SEQ ID NO: 3397 - RNA, 18 nt, Artificial Sequence
  Description of Artificial Sequence: Synthetic oligonucleotide
uguuguugauguccgagg

SEQ ID NO: 3398 - RNA, 18 nt, Artificial Sequence
  Description of Artificial Sequence: Synthetic oligonucleotide
gggcauguuguugauguc

SEQ ID NO: 3399 - RNA, 18 nt, Artificial Sequence
  Description of Artificial Sequence: Synthetic oligonucleotide
uagacagcuccugcaggg

SEQ ID NO: 3400 - RNA, 18 nt, Artificial Sequence
  Description of Artificial Sequence: Synthetic oligonucleotide
gcguuagacagcuccugc

SEQ ID NO: 3401 - RNA, 18 nt, Artificial Sequence
  Description of Artificial Sequence: Synthetic oligonucleotide
ugagggcguuagacagcu

SEQ ID NO: 3402 - RNA, 18 nt, Artificial Sequence
  Description of Artificial Sequence: Synthetic oligonucleotide
cgccaugagggcguuaga

SEQ ID NO: 3403 - RNA, 18 nt, Artificial Sequence
  Description of Artificial Sequence: Synthetic oligonucleotide
ucagccgccaugagggcg

SEQ ID NO: 3404 - RNA, 18 nt, Artificial Sequence
  Description of Artificial Sequence: Synthetic oligonucleotide
agcgcucagccgccauga

SEQ ID NO: 3405 - RNA, 18 nt, Artificial Sequence
  Description of Artificial Sequence: Synthetic oligonucleotide
cuugaagcgcucagccgc

SEQ ID NO: 3406 - RNA, 18 nt, Artificial Sequence
  Description of Artificial Sequence: Synthetic oligonucleotide
ugcuccuugaagcgcuca

SEQ ID NO: 3407 - RNA, 18 nt, Artificial Sequence
  Description of Artificial Sequence: Synthetic oligonucleotide
cccggugcuccuugaagc

SEQ ID NO: 3408 - RNA, 18 nt, Artificial Sequence
  Description of Artificial Sequence: Synthetic oligonucleotide
ugugucccggugcuccuu

SEQ ID NO: 3409 - RNA, 18 nt, Artificial Sequence
  Description of Artificial Sequence: Synthetic oligonucleotide
agggcugugucccggugc

SEQ ID NO: 3410 - RNA, 18 nt, Artificial Sequence
  Description of Artificial Sequence: Synthetic oligonucleotide
uguacagggcuguguccc

SEQ ID NO: 3411 - RNA, 18 nt, Artificial Sequence
  Description of Artificial Sequence: Synthetic oligonucleotide
ugacuuguacagggcugu

SEQ ID NO: 3412 - RNA, 18 nt, Artificial Sequence
  Description of Artificial Sequence: Synthetic oligonucleotide
gacagugacuuguacagg

SEQ ID NO: 3413 - RNA, 18 nt, Artificial Sequence
  Description of Artificial Sequence: Synthetic oligonucleotide
gcaccgacagugacuugu

SEQ ID NO: 3414 - RNA, 18 nt, Artificial Sequence
  Description of Artificial Sequence: Synthetic oligonucleotide
ugccggcaccgacaguga

SEQ ID NO: 3415 - RNA, 18 nt, Artificial Sequence
  Description of Artificial Sequence: Synthetic oligonucleotide
cuggcugccggcaccgac

SEQ ID NO: 3416 - RNA, 18 nt, Artificial Sequence
  Description of Artificial Sequence: Synthetic oligonucleotide
ccgugcuggcugccggca

SEQ ID NO: 3417 - RNA, 18 nt, Artificial Sequence
  Description of Artificial Sequence: Synthetic oligonucleotide
uuuggccgugcuggcugc

SEQ ID NO: 3418 - RNA, 18 nt, Artificial Sequence
  Description of Artificial Sequence: Synthetic oligonucleotide
gagcgaggcagaggaggg

SEQ ID NO: 3419 - RNA, 18 nt, Artificial Sequence
  Description of Artificial Sequence: Synthetic oligonucleotide
uguuggagcgaggcagag

SEQ ID NO: 3420 - RNA, 18 nt, Artificial Sequence
  Description of Artificial Sequence: Synthetic oligonucleotide
ccaaggcccgccaugcca

SEQ ID NO: 3421 - RNA, 18 nt, Artificial Sequence
  Description of Artificial Sequence: Synthetic oligonucleotide
ccgugccaaggcccgcca

SEQ ID NO: 3422 - RNA, 18 nt, Artificial Sequence
  Description of Artificial Sequence: Synthetic oligonucleotide
agagcccgugccaaggcc

SEQ ID NO: 3423 - RNA, 18 nt, Artificial Sequence
  Description of Artificial Sequence: Synthetic oligonucleotide
ggagcagagcccgugcca

SEQ ID NO: 3424 - RNA, 18 nt, Artificial Sequence
  Description of Artificial Sequence: Synthetic oligonucleotide
cagugggagcagagcccg

SEQ ID NO: 3425 - RNA, 18 nt, Artificial Sequence
  Description of Artificial Sequence: Synthetic oligonucleotide
caggccagugggagcaga

SEQ ID NO: 3426 - RNA, 18 nt, Artificial Sequence
  Description of Artificial Sequence: Synthetic oligonucleotide
agcaccaggccaguggga

SEQ ID NO: 3427 - RNA, 18 nt, Artificial Sequence
  Description of Artificial Sequence: Synthetic oligonucleotide
ccgggagcaccaggccag

SEQ ID NO: 3428 - RNA, 18 nt, Artificial Sequence
  Description of Artificial Sequence: Synthetic oligonucleotide
cgucaccgggagcaccag

SEQ ID NO: 3429 - RNA, 18 nt, Artificial Sequence
  Description of Artificial Sequence: Synthetic oligonucleotide
auugccgucaccgggagc

SEQ ID NO: 3430 - RNA, 18 nt, Artificial Sequence
  Description of Artificial Sequence: Synthetic oligonucleotide
gccacauugccgucaccg

SEQ ID NO: 3431 - RNA, 18 nt, Artificial Sequence
  Description of Artificial Sequence: Synthetic oligonucleotide
gaggagccacauugccgu

SEQ ID NO: 3432 - RNA, 18 nt, Artificial Sequence
  Description of Artificial Sequence: Synthetic oligonucleotide
gcagagaggagccacauu

SEQ ID NO: 3433 - RNA, 18 nt, Artificial Sequence
  Description of Artificial Sequence: Synthetic oligonucleotide
ccucagcagagaggagcc

SEQ ID NO: 3434 - RNA, 18 nt, Artificial Sequence
  Description of Artificial Sequence: Synthetic oligonucleotide
ggcgcccucagcagagag

SEQ ID NO: 3435 - RNA, 18 nt, Artificial Sequence
  Description of Artificial Sequence: Synthetic oligonucleotide
gugugggcgcccucagca

SEQ ID NO: 3436 - RNA, 18 nt, Artificial Sequence
  Description of Artificial Sequence: Synthetic oligonucleotide
cagccgugugggcgcccu

SEQ ID NO: 3437 - RNA, 18 nt, Artificial Sequence
  Description of Artificial Sequence: Synthetic oligonucleotide
acucccagccgugugggc

SEQ ID NO: 3438 - RNA, 18 nt, Artificial Sequence
  Description of Artificial Sequence: Synthetic oligonucleotide
ggaccacucccagccgug

SEQ ID NO: 3439 - RNA, 18 nt, Artificial Sequence
  Description of Artificial Sequence: Synthetic oligonucleotide
gccagggaccacucccag

SEQ ID NO: 3440 - RNA, 18 nt, Artificial Sequence
  Description of Artificial Sequence: Synthetic oligonucleotide
ggcaggccagggaccacu

SEQ ID NO: 3441 - RNA, 18 nt, Artificial Sequence
  Description of Artificial Sequence: Synthetic oligonucleotide
gcugaggcaggccaggga

SEQ ID NO: 3442 - RNA, 18 nt, Artificial Sequence
  Description of Artificial Sequence: Synthetic oligonucleotide
auggugcugaggcaggcc

SEQ ID NO: 3443 - RNA, 18 nt, Artificial Sequence
  Description of Artificial Sequence: Synthetic oligonucleotide
gaacaauggugcugaggc

SEQ ID NO: 3444 - RNA, 18 nt, Artificial Sequence
  Description of Artificial Sequence: Synthetic oligonucleotide
ccggagaacaauggugcu

SEQ ID NO: 3445 - RNA, 18 nt, Artificial Sequence
  Description of Artificial Sequence: Synthetic oligonucleotide
aaacaccggagaacaaug

SEQ ID NO: 3446 - RNA, 18 nt, Artificial Sequence
  Description of Artificial Sequence: Synthetic oligonucleotide
cucccaaacaccggagaa

SEQ ID NO: 3447 - RNA, 18 nt, Artificial Sequence
  Description of Artificial Sequence: Synthetic oligonucleotide
gccuccucccaaacaccg

SEQ ID NO: 3448 - RNA, 18 nt, Artificial Sequence
  Description of Artificial Sequence: Synthetic oligonucleotide
ggucagccuccucccaaa

SEQ ID NO: 3449 - RNA, 18 nt, Artificial Sequence
  Description of Artificial Sequence: Synthetic oligonucleotide
ccacgggucagccuccuc

SEQ ID NO: 3450 - RNA, 18 nt, Artificial Sequence
  Description of Artificial Sequence: Synthetic oligonucleotide
accucccacgggucagcc

SEQ ID NO: 3451 - RNA, 18 nt, Artificial Sequence
  Description of Artificial Sequence: Synthetic oligonucleotide
cagacaccucccacgggu

SEQ ID NO: 3452 - RNA, 18 nt, Artificial Sequence
  Description of Artificial Sequence: Synthetic oligonucleotide
cagggcagacaccuccca

SEQ ID NO: 3453 - RNA, 18 nt, Artificial Sequence
  Description of Artificial Sequence: Synthetic oligonucleotide
cugagcagggcagacacc

SEQ ID NO: 3454 - RNA, 18 nt, Artificial Sequence
  Description of Artificial Sequence: Synthetic oligonucleotide
gcuuccugagcagggcag

SEQ ID NO: 3455 - RNA, 18 nt, Artificial Sequence
  Description of Artificial Sequence: Synthetic oligonucleotide
ccccagcuuccugagcag

SEQ ID NO: 3456 - RNA, 18 nt, Artificial Sequence
  Description of Artificial Sequence: Synthetic oligonucleotide
gccagccccagcuuccug

SEQ ID NO: 3457 - RNA, 18 nt, Artificial Sequence
  Description of Artificial Sequence: Synthetic oligonucleotide
aagcugccagccccagcu

SEQ ID NO: 3458 - RNA, 18 nt, Artificial Sequence
  Description of Artificial Sequence: Synthetic oligonucleotide
uucugaagcugccagccc

SEQ ID NO: 3459 - RNA, 18 nt, Artificial Sequence
  Description of Artificial Sequence: Synthetic oligonucleotide
acugcuucugaagcugcc

SEQ ID NO: 3460 - RNA, 18 nt, Artificial Sequence
  Description of Artificial Sequence: Synthetic oligonucleotide
ccccuacugcuucugaag

SEQ ID NO: 3461 - RNA, 18 nt, Artificial Sequence
  Description of Artificial Sequence: Synthetic oligonucleotide
cagggccccuacugcuuc

SEQ ID NO: 3462 - RNA, 18 nt, Artificial Sequence
  Description of Artificial Sequence: Synthetic oligonucleotide
cuccacagggccccuacu

SEQ ID NO: 3463 - RNA, 18 nt, Artificial Sequence
  Description of Artificial Sequence: Synthetic oligonucleotide
agaggcuccacagggccc

SEQ ID NO: 3464 - RNA, 18 nt, Artificial Sequence
  Description of Artificial Sequence: Synthetic oligonucleotide
ugggcagaggcuccacag

SEQ ID NO: 3465 - RNA, 18 nt, Artificial Sequence
  Description of Artificial Sequence: Synthetic oligonucleotide
gaugcugggcagaggcuc

SEQ ID NO: 3466 - RNA, 18 nt, Artificial Sequence
  Description of Artificial Sequence: Synthetic oligonucleotide
cggaggaugcugggcaga

SEQ ID NO: 3467 - RNA, 18 nt, Artificial Sequence
  Description of Artificial Sequence: Synthetic oligonucleotide
ccccacggaggaugcugg

SEQ ID NO: 3468 - RNA, 18 nt, Artificial Sequence
  Description of Artificial Sequence: Synthetic oligonucleotide
ggacuccccacggaggau

SEQ ID NO: 3469 - RNA, 18 nt, Artificial Sequence
  Description of Artificial Sequence: Synthetic oligonucleotide
gugcuggacuccccacgg

SEQ ID NO: 3470 - RNA, 18 nt, Artificial Sequence
  Description of Artificial Sequence: Synthetic oligonucleotide
ccgcagugcuggacuccc

SEQ ID NO: 3471 - RNA, 18 nt, Artificial Sequence
  Description of Artificial Sequence: Synthetic oligonucleotide
ggagcccgcagugcugga

SEQ ID NO: 3472 - RNA, 18 nt, Artificial Sequence
  Description of Artificial Sequence: Synthetic oligonucleotide
cuccuggagcccgcagug

SEQ ID NO: 3473 - RNA, 18 nt, Artificial Sequence
  Description of Artificial Sequence: Synthetic oligonucleotide
agagccuccuggagcccg

SEQ ID NO: 3474 - RNA, 18 nt, Artificial Sequence
  Description of Artificial Sequence: Synthetic oligonucleotide
gccgcagagccuccugga

SEQ ID NO: 3475 - RNA, 18 nt, Artificial Sequence
  Description of Artificial Sequence: Synthetic oligonucleotide
aggcugccgcagagccuc

SEQ ID NO: 3476 - RNA, 18 nt, Artificial Sequence
  Description of Artificial Sequence: Synthetic oligonucleotide
gagggaggcugccgcaga

SEQ ID NO: 3477 - RNA, 18 nt, Artificial Sequence
  Description of Artificial Sequence: Synthetic oligonucleotide
gcagggagggaggcugcc

SEQ ID NO: 3478 - RNA, 18 nt, Artificial Sequence
  Description of Artificial Sequence: Synthetic oligonucleotide
cccaggcagggagggagg

SEQ ID NO: 3479 - RNA, 18 nt, Artificial Sequence
  Description of Artificial Sequence: Synthetic oligonucleotide
cugggcccaggcagggag

SEQ ID NO: 3480 - RNA, 18 nt, Artificial Sequence
  Description of Artificial Sequence: Synthetic oligonucleotide
caaaccugggcccaggca

SEQ ID NO: 3481 - RNA, 18 nt, Artificial Sequence
  Description of Artificial Sequence: Synthetic oligonucleotide
guguccaaaccugggccc

SEQ ID NO: 3482 - RNA, 18 nt, Artificial Sequence
  Description of Artificial Sequence: Synthetic oligonucleotide
cucagguguccaaaccug

SEQ ID NO: 3483 - RNA, 18 nt, Artificial Sequence
  Description of Artificial Sequence: Synthetic oligonucleotide
gcgggcucagguguccaa

SEQ ID NO: 3484 - RNA, 18 nt, Artificial Sequence
  Description of Artificial Sequence: Synthetic oligonucleotide
cgcaggcgggcucaggug

SEQ ID NO: 3485 - RNA, 18 nt, Artificial Sequence
  Description of Artificial Sequence: Synthetic oligonucleotide
gagugcgcaggcgggcuc

SEQ ID NO: 3486 - RNA, 18 nt, Artificial Sequence
  Description of Artificial Sequence: Synthetic oligonucleotide
gcccagagugcgcaggcg

SEQ ID NO: 3487 - RNA, 18 nt, Artificial Sequence
  Description of Artificial Sequence: Synthetic oligonucleotide
gggcccagagugcgcagg

SEQ ID NO: 3488 - RNA, 18 nt, Artificial Sequence
  Description of Artificial Sequence: Synthetic oligonucleotide
agcacggugccgaguggg

SEQ ID NO: 3489 - RNA, 18 nt, Artificial Sequence
  Description of Artificial Sequence: Synthetic oligonucleotide
cgagaagcacggugccga

SEQ ID NO: 3490 - RNA, 18 nt, Artificial Sequence
  Description of Artificial Sequence: Synthetic oligonucleotide
ccuggcgagaagcacggu

SEQ ID NO: 3491 - RNA, 18 nt, Artificial Sequence
  Description of Artificial Sequence: Synthetic oligonucleotide
gagggccuggcgagaagc

SEQ ID NO: 3492 - RNA, 18 nt, Artificial Sequence
  Description of Artificial Sequence: Synthetic oligonucleotide
agccagagggccuggcga

SEQ ID NO: 3493 - RNA, 18 nt, Artificial Sequence
  Description of Artificial Sequence: Synthetic oligonucleotide
ggaagagccagagggccu

SEQ ID NO: 3494 - RNA, 18 nt, Artificial Sequence
  Description of Artificial Sequence: Synthetic oligonucleotide
cacagggaagagccagag

SEQ ID NO: 3495 - RNA, 18 nt, Artificial Sequence
  Description of Artificial Sequence: Synthetic oligonucleotide
gcagccacagggaagagc

SEQ ID NO: 3496 - RNA, 18 nt, Artificial Sequence
  Description of Artificial Sequence: Synthetic oligonucleotide
caucugcagccacaggga

SEQ ID NO: 3497 - RNA, 18 nt, Artificial Sequence
  Description of Artificial Sequence: Synthetic oligonucleotide
agugccaucugcagccac

SEQ ID NO: 3498 - RNA, 18 nt, Artificial Sequence
  Description of Artificial Sequence: Synthetic oligonucleotide
cgcuaagugccaucugca

SEQ ID NO: 3499 - RNA, 18 nt, Artificial Sequence
  Description of Artificial Sequence: Synthetic oligonucleotide
uaggccgcuaagugccau

SEQ ID NO: 3500 - RNA, 18 nt, Artificial Sequence
  Description of Artificial Sequence: Synthetic oligonucleotide
cguccuaggccgcuaagu

SEQ ID NO: 3501 - RNA, 18 nt, Artificial Sequence
  Description of Artificial Sequence: Synthetic oligonucleotide
auagacguccuaggccgc

SEQ ID NO: 3502 - RNA, 18 nt, Artificial Sequence
  Description of Artificial Sequence: Synthetic oligonucleotide
cgugaauagacguccuag

SEQ ID NO: 3503 - RNA, 18 nt, Artificial Sequence
  Description of Artificial Sequence: Synthetic oligonucleotide
ccucccgugaauagacgu

SEQ ID NO: 3504 - RNA, 18 nt, Artificial Sequence
  Description of Artificial Sequence: Synthetic oligonucleotide
ucccuccucccgugaaua

SEQ ID NO: 3505 - RNA, 18 nt, Artificial Sequence
  Description of Artificial Sequence: Synthetic oligonucleotide
gugccucccuccucccgu

SEQ ID NO: 3506 - RNA, 18 nt, Artificial Sequence
  Description of Artificial Sequence: Synthetic oligonucleotide
gggcagugccucccuccu

SEQ ID NO: 3507 - RNA, 18 nt, Artificial Sequence
  Description of Artificial Sequence: Synthetic oligonucleotide
gaggagggcagugccucc

SEQ ID NO: 3508 - RNA, 18 nt, Artificial Sequence
  Description of Artificial Sequence: Synthetic oligonucleotide
gaccugaggagggcagug

SEQ ID NO: 3509 - RNA, 18 nt, Artificial Sequence
  Description of Artificial Sequence: Synthetic oligonucleotide
gggcagaccugaggaggg

SEQ ID NO: 3510 - RNA, 18 nt, Artificial Sequence
  Description of Artificial Sequence: Synthetic oligonucleotide
ugcuugggcagaccugag

SEQ ID NO: 3511 - RNA, 18 nt, Artificial Sequence
  Description of Artificial Sequence: Synthetic oligonucleotide
caagcugcuugggcagac

SEQ ID NO: 3512 - RNA, 18 nt, Artificial Sequence
  Description of Artificial Sequence: Synthetic oligonucleotide
agcuacaagcugcuuggg

SEQ ID NO: 3513 - RNA, 18 nt, Artificial Sequence
  Description of Artificial Sequence: Synthetic oligonucleotide
gugcuagcuacaagcugc

SEQ ID NO: 3514 - RNA, 18 nt, Artificial Sequence
  Description of Artificial Sequence: Synthetic oligonucleotide
gcccagugcuagcuacaa

SEQ ID NO: 3515 - RNA, 18 nt, Artificial Sequence
  Description of Artificial Sequence: Synthetic oligonucleotide
gggcccagugcuagcuac

SEQ ID NO: 3516 - RNA, 18 nt, Artificial Sequence
  Description of Artificial Sequence: Synthetic oligonucleotide
caaagcagcauuuccugu

SEQ ID NO: 3517 - RNA, 18 nt, Artificial Sequence
  Description of Artificial Sequence: Synthetic oligonucleotide
ggucccaaagcagcauuu

SEQ ID NO: 3518 - RNA, 18 nt, Artificial Sequence
  Description of Artificial Sequence: Synthetic oligonucleotide
ugggaggucccaaagcag

SEQ ID NO: 3519 - RNA, 18 nt, Artificial Sequence
  Description of Artificial Sequence: Synthetic oligonucleotide
gagggugggaggucccaa

SEQ ID NO: 3520 - RNA, 18 nt, Artificial Sequence
  Description of Artificial Sequence: Synthetic oligonucleotide
ggagagagggugggaggu

SEQ ID NO: 3521 - RNA, 18 nt, Artificial Sequence
  Description of Artificial Sequence: Synthetic oligonucleotide
gcuaaggagagagggugg

SEQ ID NO: 3522 - RNA, 18 nt, Artificial Sequence
  Description of Artificial Sequence: Synthetic oligonucleotide
gggacgcuaaggagagag

SEQ ID NO: 3523 - RNA, 18 nt, Artificial Sequence
  Description of Artificial Sequence: Synthetic oligonucleotide
gccagacccacagcuggg

SEQ ID NO: 3524 - RNA, 18 nt, Artificial Sequence
  Description of Artificial Sequence: Synthetic oligonucleotide
agccagacccacagcugg

SEQ ID NO: 3525 - RNA, 18 nt, Artificial Sequence
  Description of Artificial Sequence: Synthetic oligonucleotide
cuccaagccagacccaca

SEQ ID NO: 3526 - RNA, 18 nt, Artificial Sequence
  Description of Artificial Sequence: Synthetic oligonucleotide
uccaacuccaagccagac

SEQ ID NO: 3527 - RNA, 18 nt, Artificial Sequence
  Description of Artificial Sequence: Synthetic oligonucleotide
cacccuccaacuccaagc

SEQ ID NO: 3528 - RNA, 18 nt, Artificial Sequence
  Description of Artificial Sequence: Synthetic oligonucleotide
aggcucacccuccaacuc

SEQ ID NO: 3529 - RNA, 18 nt, Artificial Sequence
  Description of Artificial Sequence: Synthetic oligonucleotide
agcagaggcucacccucc

SEQ ID NO: 3530 - RNA, 18 nt, Artificial Sequence
  Description of Artificial Sequence: Synthetic oligonucleotide
ccaagagcagaggcucac

SEQ ID NO: 3531 - RNA, 18 nt, Artificial Sequence
  Description of Artificial Sequence: Synthetic oligonucleotide
ugcucccaagagcagagg

SEQ ID NO: 3532 - RNA, 18 nt, Artificial Sequence
  Description of Artificial Sequence: Synthetic oligonucleotide
cagacugcucccaagagc

SEQ ID NO: 3533 - RNA, 18 nt, Artificial Sequence
  Description of Artificial Sequence: Synthetic oligonucleotide
gcaaacagacugcuccca

SEQ ID NO: 3534 - RNA, 18 nt, Artificial Sequence
  Description of Artificial Sequence: Synthetic oligonucleotide
uguuugcaaacagacugc

SEQ ID NO: 3535 - RNA, 18 nt, Artificial Sequence
  Description of Artificial Sequence: Synthetic oligonucleotide
gucccuguuugcaaacag

SEQ ID NO: 3536 - RNA, 18 nt, Artificial Sequence
  Description of Artificial Sequence: Synthetic oligonucleotide
gggaagucccuguuugca

SEQ ID NO: 3537 - RNA, 18 nt, Artificial Sequence
  Description of Artificial Sequence: Synthetic oligonucleotide
gagacuccgugacguggg

SEQ ID NO: 3538 - RNA, 18 nt, Artificial Sequence
  Description of Artificial Sequence: Synthetic oligonucleotide
ugcggagacuccgugacg

SEQ ID NO: 3539 - RNA, 18 nt, Artificial Sequence
  Description of Artificial Sequence: Synthetic oligonucleotide
agagcugcggagacuccg

SEQ ID NO: 3540 - RNA, 18 nt, Artificial Sequence
  Description of Artificial Sequence: Synthetic oligonucleotide
cgaggagagcugcggaga

SEQ ID NO: 3541 - RNA, 18 nt, Artificial Sequence
  Description of Artificial Sequence: Synthetic oligonucleotide
guaaccgaggagagcugc

SEQ ID NO: 3542 - RNA, 18 nt, Artificial Sequence
  Description of Artificial Sequence: Synthetic oligonucleotide
cccucguaaccgaggaga

SEQ ID NO: 3543 - RNA, 18 nt, Artificial Sequence
  Description of Artificial Sequence: Synthetic oligonucleotide
accagcccucguaaccga

SEQ ID NO: 3544 - RNA, 18 nt, Artificial Sequence
  Description of Artificial Sequence: Synthetic oligonucleotide
cugaaaccagcccucgua

SEQ ID NO: 3545 - RNA, 18 nt, Artificial Sequence
  Description of Artificial Sequence: Synthetic oligonucleotide
ggagccugaaaccagccc

SEQ ID NO: 3546 - RNA, 18 nt, Artificial Sequence
  Description of Artificial Sequence: Synthetic oligonucleotide
gagcgggagccugaaacc

SEQ ID NO: 3547 - RNA, 18 nt, Artificial Sequence
  Description of Artificial Sequence: Synthetic oligonucleotide
uaaaagagcgggagccug

SEQ ID NO: 3548 - RNA, 18 nt, Artificial Sequence
  Description of Artificial Sequence: Synthetic oligonucleotide
agcucuaaaagagcggga

SEQ ID NO: 3549 - RNA, 18 nt, Artificial Sequence
  Description of Artificial Sequence: Synthetic oligonucleotide
gccucagcucuaaaagag

SEQ ID NO: 3550 - RNA, 18 nt, Artificial Sequence
  Description of Artificial Sequence: Synthetic oligonucleotide
gacgggccucagcucuaa

SEQ ID NO: 3551 - RNA, 18 nt, Artificial Sequence
  Description of Artificial Sequence: Synthetic oligonucleotide
cgcccgacgggccucagc

SEQ ID NO: 3552 - RNA, 18 nt, Artificial Sequence
  Description of Artificial Sequence: Synthetic oligonucleotide
cucuccgcccgacgggcc

SEQ ID NO: 3553 - RNA, 18 nt, Artificial Sequence
  Description of Artificial Sequence: Synthetic oligonucleotide
agacgcucuccgcccgac

SEQ ID NO: 3554 - RNA, 18 nt, Artificial Sequence
  Description of Artificial Sequence: Synthetic oligonucleotide
gggcaagacgcucuccgc

SEQ ID NO: 3555 - RNA, 18 nt, Artificial Sequence
  Description of Artificial Sequence: Synthetic oligonucleotide
gccuccagguaggcaggg

SEQ ID NO: 3556 - RNA, 18 nt, Artificial Sequence
  Description of Artificial Sequence: Synthetic oligonucleotide
gugccuccagguaggcag

SEQ ID NO: 3557 - RNA, 18 nt, Artificial Sequence
  Description of Artificial Sequence: Synthetic oligonucleotide
ccccugugccuccaggua

SEQ ID NO: 3558 - RNA, 18 nt, Artificial Sequence
  Description of Artificial Sequence: Synthetic oligonucleotide
agccaccccugugccucc

SEQ ID NO: 3559 - RNA, 18 nt, Artificial Sequence
  Description of Artificial Sequence: Synthetic oligonucleotide
ccagcagccaccccugug

SEQ ID NO: 3560 - RNA, 18 nt, Artificial Sequence
  Description of Artificial Sequence: Synthetic oligonucleotide
guccaccagcagccaccc

SEQ ID NO: 3561 - RNA, 18 nt, Artificial Sequence
  Description of Artificial Sequence: Synthetic oligonucleotide
cuaguguccaccagcagc

SEQ ID NO: 3562 - RNA, 18 nt, Artificial Sequence
  Description of Artificial Sequence: Synthetic oligonucleotide
ccacccuaguguccacca

SEQ ID NO: 3563 - RNA, 18 nt, Artificial Sequence
  Description of Artificial Sequence: Synthetic oligonucleotide
ucugcccacccuaguguc

SEQ ID NO: 3564 - RNA, 18 nt, Artificial Sequence
  Description of Artificial Sequence: Synthetic oligonucleotide
ucggcucugcccacccua

SEQ ID NO: 3565 - RNA, 18 nt, Artificial Sequence
  Description of Artificial Sequence: Synthetic oligonucleotide
ggcaaucggcucugccca

SEQ ID NO: 3566 - RNA, 18 nt, Artificial Sequence
  Description of Artificial Sequence: Synthetic oligonucleotide
gggcaggcaaucggcucu

SEQ ID NO: 3567 - RNA, 18 nt, Artificial Sequence
  Description of Artificial Sequence: Synthetic oligonucleotide
ggguugggcaggcaaucg

SEQ ID NO: 3568 - RNA, 18 nt, Artificial Sequence
  Description of Artificial Sequence: Synthetic oligonucleotide
ccugcaugagugcccggg

SEQ ID NO: 3569 - RNA, 18 nt, Artificial Sequence
  Description of Artificial Sequence: Synthetic oligonucleotide
uccugcaugagugcccgg

SEQ ID NO: 3570 - RNA, 18 nt, Artificial Sequence
  Description of Artificial Sequence: Synthetic oligonucleotide
gccucuccugcaugagug

SEQ ID NO: 3571 - RNA, 18 nt, Artificial Sequence
  Description of Artificial Sequence: Synthetic oligonucleotide
cacaggccucuccugcau

SEQ ID NO: 3572 - RNA, 18 nt, Artificial Sequence
  Description of Artificial Sequence: Synthetic oligonucleotide
cccgacacaggccucucc

SEQ ID NO: 3573 - RNA, 18 nt, Artificial Sequence
  Description of Artificial Sequence: Synthetic oligonucleotide
gugaccccgacacaggcc

SEQ ID NO: 3574 - RNA, 18 nt, Artificial Sequence
  Description of Artificial Sequence: Synthetic oligonucleotide
ugcacgugaccccgacac

SEQ ID NO: 3575 - RNA, 18 nt, Artificial Sequence
  Description of Artificial Sequence: Synthetic oligonucleotide
aggccugcacgugacccc

SEQ ID NO: 3576 - RNA, 18 nt, Artificial Sequence
  Description of Artificial Sequence: Synthetic oligonucleotide
ugggaaggccugcacgug

SEQ ID NO: 3577 - RNA, 18 nt, Artificial Sequence
  Description of Artificial Sequence: Synthetic oligonucleotide
gacgcugggaaggccugc

SEQ ID NO: 3578 - RNA, 18 nt, Artificial Sequence
  Description of Artificial Sequence: Synthetic oligonucleotide
gggaggacgcugggaagg

SEQ ID NO: 3579 - RNA, 18 nt, Artificial Sequence
  Description of Artificial Sequence: Synthetic oligonucleotide
gggcagggaggacgcugg

SEQ ID NO: 3580 - RNA, 18 nt, Artificial Sequence
  Description of Artificial Sequence: Synthetic oligonucleotide
cgagcgggcagggaggac

SEQ ID NO: 3581 - RNA, 18 nt, Artificial Sequence
  Description of Artificial Sequence: Synthetic oligonucleotide
uccaccgagcgggcaggg

SEQ ID NO: 3582 - RNA, 18 nt, Artificial Sequence
  Description of Artificial Sequence: Synthetic oligonucleotide
ugccauccaccgagcggg

SEQ ID NO: 3583 - RNA, 18 nt, Artificial Sequence
  Description of Artificial Sequence: Synthetic oligonucleotide
acugcugccauccaccga

SEQ ID NO: 3584 - RNA, 18 nt, Artificial Sequence
  Description of Artificial Sequence: Synthetic oligonucleotide
ugcuuacugcugccaucc

SEQ ID NO: 3585 - RNA, 18 nt, Artificial Sequence
  Description of Artificial Sequence: Synthetic oligonucleotide
ggcucugcuuacugcugc

SEQ ID NO: 3586 - RNA, 18 nt, Artificial Sequence
  Description of Artificial Sequence: Synthetic oligonucleotide
cccagggcucugcuuacu

SEQ ID NO: 3587 - RNA, 18 nt, Artificial Sequence
  Description of Artificial Sequence: Synthetic oligonucleotide
gccuccccagggcucugc

SEQ ID NO: 3588 - RNA, 18 nt, Artificial Sequence
  Description of Artificial Sequence: Synthetic oligonucleotide
ugcgagccuccccagggc

SEQ ID NO: 3589 - RNA, 18 nt, Artificial Sequence
  Description of Artificial Sequence: Synthetic oligonucleotide
agcccugcgagccucccc

SEQ ID NO: 3590 - RNA, 18 nt, Artificial Sequence
  Description of Artificial Sequence: Synthetic oligonucleotide
acagcagcccugcgagcc

SEQ ID NO: 3591 - RNA, 18 nt, Artificial Sequence
  Description of Artificial Sequence: Synthetic oligonucleotide
gagggacagcagcccugc

SEQ ID NO: 3592 - RNA, 18 nt, Artificial Sequence
  Description of Artificial Sequence: Synthetic oligonucleotide
gaccagagggacagcagc

SEQ ID NO: 3593 - RNA, 18 nt, Artificial Sequence
  Description of Artificial Sequence: Synthetic oligonucleotide
cuccugaccagagggaca

SEQ ID NO: 3594 - RNA, 18 nt, Artificial Sequence
  Description of Artificial Sequence: Synthetic oligonucleotide
gccuucuccugaccagag

SEQ ID NO: 3595 - RNA, 18 nt, Artificial Sequence
  Description of Artificial Sequence: Synthetic oligonucleotide
aaccagccuucuccugac

SEQ ID NO: 3596 - RNA, 18 nt, Artificial Sequence
  Description of Artificial Sequence: Synthetic oligonucleotide
ccgagaaccagccuucuc

SEQ ID NO: 3597 - RNA, 18 nt, Artificial Sequence
  Description of Artificial Sequence: Synthetic oligonucleotide
ggccuccgagaaccagcc

SEQ ID NO: 3598 - RNA, 18 nt, Artificial Sequence
  Description of Artificial Sequence: Synthetic oligonucleotide
gacguggccuccgagaac

SEQ ID NO: 3599 - RNA, 18 nt, Artificial Sequence
  Description of Artificial Sequence: Synthetic oligonucleotide
gcccugacguggccuccg

SEQ ID NO: 3600 - RNA, 18 nt, Artificial Sequence
  Description of Artificial Sequence: Synthetic oligonucleotide
cccuggcccugacguggc

SEQ ID NO: 3601 - RNA, 18 nt, Artificial Sequence
  Description of Artificial Sequence: Synthetic oligonucleotide
ccaggcccuggcccugac

SEQ ID NO: 3602 - RNA, 18 nt, Artificial Sequence
  Description of Artificial Sequence: Synthetic oligonucleotide
cugggccaggcccuggcc

SEQ ID NO: 3603 - RNA, 18 nt, Artificial Sequence
  Description of Artificial Sequence: Synthetic oligonucleotide
uccaugaccacggcggag

SEQ ID NO: 3604 - RNA, 18 nt, Artificial Sequence
  Description of Artificial Sequence: Synthetic oligonucleotide
ccuccuccaugaccacgg

SEQ ID NO: 3605 - RNA, 18 nt, Artificial Sequence
  Description of Artificial Sequence: Synthetic oligonucleotide
acuucccuccuccaugac

SEQ ID NO: 3606 - RNA, 18 nt, Artificial Sequence
  Description of Artificial Sequence: Synthetic oligonucleotide
cccggacuucccuccucc

SEQ ID NO: 3607 - RNA, 18 nt, Artificial Sequence
  Description of Artificial Sequence: Synthetic oligonucleotide
ccucgcccggacuucccu

SEQ ID NO: 3608 - RNA, 18 nt, Artificial Sequence
  Description of Artificial Sequence: Synthetic oligonucleotide
aggaaccucgcccggacu

SEQ ID NO: 3609 - RNA, 18 nt, Artificial Sequence
  Description of Artificial Sequence: Synthetic oligonucleotide
agcacaggaaccucgccc

SEQ ID NO: 3610 - RNA, 18 nt, Artificial Sequence
  Description of Artificial Sequence: Synthetic oligonucleotide
ccaccagcacaggaaccu

SEQ ID NO: 3611 - RNA, 18 nt, Artificial Sequence
  Description of Artificial Sequence: Synthetic oligonucleotide
gggcuccaccagcacagg

SEQ ID NO: 3612 - RNA, 18 nt, Artificial Sequence
  Description of Artificial Sequence: Synthetic oligonucleotide
ucaacguccuccaacccu

SEQ ID NO: 3613 - RNA, 18 nt, Artificial Sequence
  Description of Artificial Sequence: Synthetic oligonucleotide
cugccucaacguccucca

SEQ ID NO: 3614 - RNA, 18 nt, Artificial Sequence
  Description of Artificial Sequence: Synthetic oligonucleotide
uagcgcugccucaacguc

SEQ ID NO: 3615 - RNA, 18 nt, Artificial Sequence
  Description of Artificial Sequence: Synthetic oligonucleotide
augccuagcgcugccuca

SEQ ID NO: 3616 - RNA, 18 nt, Artificial Sequence
  Description of Artificial Sequence: Synthetic oligonucleotide
uguccaugccuagcgcug

SEQ ID NO: 3617 - RNA, 18 nt, Artificial Sequence
  Description of Artificial Sequence: Synthetic oligonucleotide
gcgccuguccaugccuag

SEQ ID NO: 3618 - RNA, 18 nt, Artificial Sequence
  Description of Artificial Sequence: Synthetic oligonucleotide
uccgugcgccuguccaug

SEQ ID NO: 3619 - RNA, 18 nt, Artificial Sequence
  Description of Artificial Sequence: Synthetic oligonucleotide
aggcauccgugcgccugu

SEQ ID NO: 3620 - RNA, 18 nt, Artificial Sequence
  Description of Artificial Sequence: Synthetic oligonucleotide
gcuguaggcauccgugcg

SEQ ID NO: 3621 - RNA, 18 nt, Artificial Sequence
  Description of Artificial Sequence: Synthetic oligonucleotide
ucaucagccagcuggugu

SEQ ID NO: 3622 - RNA, 18 nt, Artificial Sequence
  Description of Artificial Sequence: Synthetic oligonucleotide
caggcucaucagccagcu

SEQ ID NO: 3623 - RNA, 18 nt, Artificial Sequence
  Description of Artificial Sequence: Synthetic oligonucleotide
uucuccaggcucaucagc

SEQ ID NO: 3624 - RNA, 18 nt, Artificial Sequence
  Description of Artificial Sequence: Synthetic oligonucleotide
gcggguucuccaggcuca

SEQ ID NO: 3625 - RNA, 18 nt, Artificial Sequence
  Description of Artificial Sequence: Synthetic oligonucleotide
gcugagcggguucuccag

SEQ ID NO: 3626 - RNA, 18 nt, Artificial Sequence
  Description of Artificial Sequence: Synthetic oligonucleotide
aaagggcugagcggguuc

SEQ ID NO: 3627 - RNA, 18 nt, Artificial Sequence
  Description of Artificial Sequence: Synthetic oligonucleotide
aggagaaagggcugagcg

SEQ ID NO: 3628 - RNA, 18 nt, Artificial Sequence
  Description of Artificial Sequence: Synthetic oligonucleotide
guccgaggagaaagggcu

SEQ ID NO: 3629 - RNA, 18 nt, Artificial Sequence
  Description of Artificial Sequence: Synthetic oligonucleotide
uugauguccgaggagaaa

SEQ ID NO: 3630 - RNA, 18 nt, Artificial Sequence
  Description of Artificial Sequence: Synthetic oligonucleotide
uguuguugauguccgagg

SEQ ID NO: 3631 - RNA, 18 nt, Artificial Sequence
  Description of Artificial Sequence: Synthetic oligonucleotide
gggcauguuguugauguc

SEQ ID NO: 3632 - RNA, 18 nt, Artificial Sequence
  Description of Artificial Sequence: Synthetic oligonucleotide
uagacagcuccugcaggg

SEQ ID NO: 3633 - RNA, 18 nt, Artificial Sequence
  Description of Artificial Sequence: Synthetic oligonucleotide
gcguuagacagcuccugc

SEQ ID NO: 3634 - RNA, 18 nt, Artificial Sequence
  Description of Artificial Sequence: Synthetic oligonucleotide
ugagggcguuagacagcu

SEQ ID NO: 3635 - RNA, 18 nt, Artificial Sequence
  Description of Artificial Sequence: Synthetic oligonucleotide
cgccaugagggcguuaga

SEQ ID NO: 3636 - RNA, 18 nt, Artificial Sequence
  Description of Artificial Sequence: Synthetic oligonucleotide
ucagccgccaugagggcg

SEQ ID NO: 3637 - RNA, 18 nt, Artificial Sequence
  Description of Artificial Sequence: Synthetic oligonucleotide
agcgcucagccgccauga

SEQ ID NO: 3638 - RNA, 18 nt, Artificial Sequence
  Description of Artificial Sequence: Synthetic oligonucleotide
cuugaagcgcucagccgc

SEQ ID NO: 3639 - RNA, 18 nt, Artificial Sequence
  Description of Artificial Sequence: Synthetic oligonucleotide
ugcuccuugaagcgcuca

SEQ ID NO: 3640 - RNA, 18 nt, Artificial Sequence
  Description of Artificial Sequence: Synthetic oligonucleotide
cccggugcuccuugaagc

SEQ ID NO: 3641 - RNA, 18 nt, Artificial Sequence
  Description of Artificial Sequence: Synthetic oligonucleotide
ugugucccggugcuccuu

SEQ ID NO: 3642 - RNA, 18 nt, Artificial Sequence
  Description of Artificial Sequence: Synthetic oligonucleotide
agggcugugucccggugc

SEQ ID NO: 3643 - RNA, 18 nt, Artificial Sequence
  Description of Artificial Sequence: Synthetic oligonucleotide
uguacagggcuguguccc

SEQ ID NO: 3644 - RNA, 18 nt, Artificial Sequence
  Description of Artificial Sequence: Synthetic oligonucleotide
ugacuuguacagggcugu

SEQ ID NO: 3645 - RNA, 18 nt, Artificial Sequence
  Description of Artificial Sequence: Synthetic oligonucleotide
gacagugacuuguacagg

SEQ ID NO: 3646 - RNA, 18 nt, Artificial Sequence
  Description of Artificial Sequence: Synthetic oligonucleotide
gcaccgacagugacuugu

SEQ ID NO: 3647 - RNA, 18 nt, Artificial Sequence
  Description of Artificial Sequence: Synthetic oligonucleotide
ugccggcaccgacaguga

SEQ ID NO: 3648 - RNA, 18 nt, Artificial Sequence
  Description of Artificial Sequence: Synthetic oligonucleotide
cuggcugccggcaccgac

SEQ ID NO: 3649 - RNA, 18 nt, Artificial Sequence
  Description of Artificial Sequence: Synthetic oligonucleotide
ccgugcuggcugccggca

SEQ ID NO: 3650 - RNA, 18 nt, Artificial Sequence
  Description of Artificial Sequence: Synthetic oligonucleotide
uuuggccgugcuggcugc

SEQ ID NO: 3651 - RNA, 18 nt, Artificial Sequence
  Description of Artificial Sequence: Synthetic oligonucleotide
gagcgaggcagaggaggg

SEQ ID NO: 3652 - RNA, 18 nt, Artificial Sequence
  Description of Artificial Sequence: Synthetic oligonucleotide
uguuggagcgaggcagag

SEQ ID NO: 3653 - RNA, 18 nt, Artificial Sequence
  Description of Artificial Sequence: Synthetic oligonucleotide
ccaaggcccgccaugcca

SEQ ID NO: 3654 - RNA, 18 nt, Artificial Sequence
  Description of Artificial Sequence: Synthetic oligonucleotide
ccgugccaaggcccgcca

SEQ ID NO: 3655 - RNA, 18 nt, Artificial Sequence
  Description of Artificial Sequence: Synthetic oligonucleotide
agagcccgugccaaggcc

SEQ ID NO: 3656 - RNA, 18 nt, Artificial Sequence
  Description of Artificial Sequence: Synthetic oligonucleotide
ggagcagagcccgugcca

SEQ ID NO: 3657 - RNA, 18 nt, Artificial Sequence
  Description of Artificial Sequence: Synthetic oligonucleotide
cagugggagcagagcccg

SEQ ID NO: 3658 - RNA, 18 nt, Artificial Sequence
  Description of Artificial Sequence: Synthetic oligonucleotide
caggccagugggagcaga

SEQ ID NO: 3659 - RNA, 18 nt, Artificial Sequence
  Description of Artificial Sequence: Synthetic oligonucleotide
agcaccaggccaguggga

SEQ ID NO: 3660 - RNA, 18 nt, Artificial Sequence
  Description of Artificial Sequence: Synthetic oligonucleotide
ccgggagcaccaggccag

SEQ ID NO: 3661 - RNA, 18 nt, Artificial Sequence
  Description of Artificial Sequence: Synthetic oligonucleotide
cgucaccgggagcaccag

SEQ ID NO: 3662 - RNA, 18 nt, Artificial Sequence
  Description of Artificial Sequence: Synthetic oligonucleotide
auugccgucaccgggagc

SEQ ID NO: 3663 - RNA, 18 nt, Artificial Sequence
  Description of Artificial Sequence: Synthetic oligonucleotide
gccacauugccgucaccg

SEQ ID NO: 3664 - RNA, 18 nt, Artificial Sequence
  Description of Artificial Sequence: Synthetic oligonucleotide
gaggagccacauugccgu

SEQ ID NO: 3665 - RNA, 18 nt, Artificial Sequence
  Description of Artificial Sequence: Synthetic oligonucleotide
gcagagaggagccacauu

SEQ ID NO: 3666 - RNA, 18 nt, Artificial Sequence
  Description of Artificial Sequence: Synthetic oligonucleotide
ccucagcagagaggagcc

SEQ ID NO: 3667 - RNA, 18 nt, Artificial Sequence
  Description of Artificial Sequence: Synthetic oligonucleotide
ggcgcccucagcagagag

SEQ ID NO: 3668 - RNA, 18 nt, Artificial Sequence
  Description of Artificial Sequence: Synthetic oligonucleotide
gugugggcgcccucagca

SEQ ID NO: 3669 - RNA, 18 nt, Artificial Sequence
  Description of Artificial Sequence: Synthetic oligonucleotide
cagccgugugggcgcccu

SEQ ID NO: 3670 - RNA, 18 nt, Artificial Sequence
  Description of Artificial Sequence: Synthetic oligonucleotide
acucccagccgugugggc

SEQ ID NO: 3671 - RNA, 18 nt, Artificial Sequence
  Description of Artificial Sequence: Synthetic oligonucleotide
ggaccacucccagccgug

SEQ ID NO: 3672 - RNA, 18 nt, Artificial Sequence
  Description of Artificial Sequence: Synthetic oligonucleotide
gccagggaccacucccag

SEQ ID NO: 3673 - RNA, 18 nt, Artificial Sequence
  Description of Artificial Sequence: Synthetic oligonucleotide
ggcaggccagggaccacu

SEQ ID NO: 3674 - RNA, 18 nt, Artificial Sequence
  Description of Artificial Sequence: Synthetic oligonucleotide
gcugaggcaggccaggga

SEQ ID NO: 3675 - RNA, 18 nt, Artificial Sequence
  Description of Artificial Sequence: Synthetic oligonucleotide
auggugcugaggcaggcc

SEQ ID NO: 3676 - RNA, 18 nt, Artificial Sequence
  Description of Artificial Sequence: Synthetic oligonucleotide
gaacaauggugcugaggc

SEQ ID NO: 3677 - RNA, 18 nt, Artificial Sequence
  Description of Artificial Sequence: Synthetic oligonucleotide
ccggagaacaauggugcu

SEQ ID NO: 3678 - RNA, 18 nt, Artificial Sequence
  Description of Artificial Sequence: Synthetic oligonucleotide
aaacaccggagaacaaug

SEQ ID NO: 3679 - RNA, 18 nt, Artificial Sequence
  Description of Artificial Sequence: Synthetic oligonucleotide
cucccaaacaccggagaa

SEQ ID NO: 3680 - RNA, 18 nt, Artificial Sequence
  Description of Artificial Sequence: Synthetic oligonucleotide
gccuccucccaaacaccg

SEQ ID NO: 3681 - RNA, 18 nt, Artificial Sequence
  Description of Artificial Sequence: Synthetic oligonucleotide
ggucagccuccucccaaa

SEQ ID NO: 3682 - RNA, 18 nt, Artificial Sequence
  Description of Artificial Sequence: Synthetic oligonucleotide
ccacgggucagccuccuc

SEQ ID NO: 3683 - RNA, 18 nt, Artificial Sequence
  Description of Artificial Sequence: Synthetic oligonucleotide
accucccacgggucagcc

SEQ ID NO: 3684 - RNA, 18 nt, Artificial Sequence
  Description of Artificial Sequence: Synthetic oligonucleotide
cagacaccucccacgggu

SEQ ID NO: 3685 - RNA, 18 nt, Artificial Sequence
  Description of Artificial Sequence: Synthetic oligonucleotide
cagggcagacaccuccca

SEQ ID NO: 3686 - RNA, 18 nt, Artificial Sequence
  Description of Artificial Sequence: Synthetic oligonucleotide
cugagcagggcagacacc

SEQ ID NO: 3687 - RNA, 18 nt, Artificial Sequence
  Description of Artificial Sequence: Synthetic oligonucleotide
gcuuccugagcagggcag

SEQ ID NO: 3688 - RNA, 18 nt, Artificial Sequence
  Description of Artificial Sequence: Synthetic oligonucleotide
ccccagcuuccugagcag

SEQ ID NO: 3689 - RNA, 18 nt, Artificial Sequence
  Description of Artificial Sequence: Synthetic oligonucleotide
gccagccccagcuuccug

SEQ ID NO: 3690 - RNA, 18 nt, Artificial Sequence
  Description of Artificial Sequence: Synthetic oligonucleotide
aagcugccagccccagcu

SEQ ID NO: 3691 - RNA, 18 nt, Artificial Sequence
  Description of Artificial Sequence: Synthetic oligonucleotide
uucugaagcugccagccc

SEQ ID NO: 3692 - RNA, 18 nt, Artificial Sequence
  Description of Artificial Sequence: Synthetic oligonucleotide
acugcuucugaagcugcc

SEQ ID NO: 3693 - RNA, 18 nt, Artificial Sequence
  Description of Artificial Sequence: Synthetic oligonucleotide
ccccuacugcuucugaag

SEQ ID NO: 3694 - RNA, 18 nt, Artificial Sequence
  Description of Artificial Sequence: Synthetic oligonucleotide
cagggccccuacugcuuc

SEQ ID NO: 3695 - RNA, 18 nt, Artificial Sequence
  Description of Artificial Sequence: Synthetic oligonucleotide
cuccacagggccccuacu

SEQ ID NO: 3696 - RNA, 18 nt, Artificial Sequence
  Description of Artificial Sequence: Synthetic oligonucleotide
agaggcuccacagggccc

SEQ ID NO: 3697 - RNA, 18 nt, Artificial Sequence
  Description of Artificial Sequence: Synthetic oligonucleotide
ugggcagaggcuccacag

SEQ ID NO: 3698 - RNA, 18 nt, Artificial Sequence
  Description of Artificial Sequence: Synthetic oligonucleotide
gaugcugggcagaggcuc

SEQ ID NO: 3699 - RNA, 18 nt, Artificial Sequence
  Description of Artificial Sequence: Synthetic oligonucleotide
cggaggaugcugggcaga

SEQ ID NO: 3700 - RNA, 18 nt, Artificial Sequence
  Description of Artificial Sequence: Synthetic oligonucleotide
ccccacggaggaugcugg

SEQ ID NO: 3701 - RNA, 18 nt, Artificial Sequence
  Description of Artificial Sequence: Synthetic oligonucleotide
ggacuccccacggaggau

SEQ ID NO: 3702 - RNA, 18 nt, Artificial Sequence
  Description of Artificial Sequence: Synthetic oligonucleotide
gugcuggacuccccacgg

SEQ ID NO: 3703 - RNA, 18 nt, Artificial Sequence
  Description of Artificial Sequence: Synthetic oligonucleotide
ccgcagugcuggacuccc

SEQ ID NO: 3704 - RNA, 18 nt, Artificial Sequence
  Description of Artificial Sequence: Synthetic oligonucleotide
ggagcccgcagugcugga

SEQ ID NO: 3705 - RNA, 18 nt, Artificial Sequence
  Description of Artificial Sequence: Synthetic oligonucleotide
cuccuggagcccgcagug

SEQ ID NO: 3706 - RNA, 18 nt, Artificial Sequence
  Description of Artificial Sequence: Synthetic oligonucleotide
agagccuccuggagcccg

SEQ ID NO: 3707 - RNA, 18 nt, Artificial Sequence
  Description of Artificial Sequence: Synthetic oligonucleotide
gccgcagagccuccugga

SEQ ID NO: 3708 - RNA, 18 nt, Artificial Sequence
  Description of Artificial Sequence: Synthetic oligonucleotide
aggcugccgcagagccuc

SEQ ID NO: 3709 - RNA, 18 nt, Artificial Sequence
  Description of Artificial Sequence: Synthetic oligonucleotide
gagggaggcugccgcaga

SEQ ID NO: 3710 - RNA, 18 nt, Artificial Sequence
  Description of Artificial Sequence: Synthetic oligonucleotide
gcagggagggaggcugcc

SEQ ID NO: 3711 - RNA, 18 nt, Artificial Sequence
  Description of Artificial Sequence: Synthetic oligonucleotide
cccaggcagggagggagg

SEQ ID NO: 3712 - RNA, 18 nt, Artificial Sequence
  Description of Artificial Sequence: Synthetic oligonucleotide
cugggcccaggcagggag

SEQ ID NO: 3713 - RNA, 18 nt, Artificial Sequence
  Description of Artificial Sequence: Synthetic oligonucleotide
caaaccugggcccaggca

SEQ ID NO: 3714 - RNA, 18 nt, Artificial Sequence
  Description of Artificial Sequence: Synthetic oligonucleotide
guguccaaaccugggccc

SEQ ID NO: 3715 - RNA, 18 nt, Artificial Sequence
  Description of Artificial Sequence: Synthetic oligonucleotide
cucagguguccaaaccug

SEQ ID NO: 3716 - RNA, 18 nt, Artificial Sequence
  Description of Artificial Sequence: Synthetic oligonucleotide
gcgggcucagguguccaa

SEQ ID NO: 3717 - RNA, 18 nt, Artificial Sequence
  Description of Artificial Sequence: Synthetic oligonucleotide
cgcaggcgggcucaggug

SEQ ID NO: 3718 - RNA, 18 nt, Artificial Sequence
  Description of Artificial Sequence: Synthetic oligonucleotide
gagugcgcaggcgggcuc

SEQ ID NO: 3719 - RNA, 18 nt, Artificial Sequence
  Description of Artificial Sequence: Synthetic oligonucleotide
gggagggaggcugccgca

SEQ ID NO: 3720 - RNA, 18 nt, Artificial Sequence
  Description of Artificial Sequence: Synthetic oligonucleotide
aggcagggagggaggcug

SEQ ID NO: 3721 - RNA, 18 nt, Artificial Sequence
  Description of Artificial Sequence: Synthetic oligonucleotide
ggcccaggcagggaggga

SEQ ID NO: 3722 - RNA, 18 nt, Artificial Sequence
  Description of Artificial Sequence: Synthetic oligonucleotide
accugggcccaggcaggg

SEQ ID NO: 3723 - RNA, 18 nt, Artificial Sequence
  Description of Artificial Sequence: Synthetic oligonucleotide
uccaaaccugggcccagg

SEQ ID NO: 3724 - RNA, 18 nt, Artificial Sequence
  Description of Artificial Sequence: Synthetic oligonucleotide
agguguccaaaccugggc

SEQ ID NO: 3725 - RNA, 18 nt, Artificial Sequence
  Description of Artificial Sequence: Synthetic oligonucleotide
ggcucagguguccaaacc

SEQ ID NO: 3726 - RNA, 18 nt, Artificial Sequence
  Description of Artificial Sequence: Synthetic oligonucleotide
aggcgggcucaggugucc

SEQ ID NO: 3727 - RNA, 18 nt, Artificial Sequence
  Description of Artificial Sequence: Synthetic oligonucleotide
ugcgcaggcgggcucagg

SEQ ID NO: 3728 - RNA, 18 nt, Artificial Sequence
  Description of Artificial Sequence: Synthetic oligonucleotide
cagagugcgcaggcgggc

SEQ ID NO: 3729 - RNA, 18 nt, Artificial Sequence
  Description of Artificial Sequence: Synthetic oligonucleotide
gggcccagagugcgcagg

SEQ ID NO: 3730 - RNA, 18 nt, Artificial Sequence
  Description of Artificial Sequence: Synthetic oligonucleotide
agcacggugccgaguggg

SEQ ID NO: 3731 - RNA, 18 nt, Artificial Sequence
  Description of Artificial Sequence: Synthetic oligonucleotide
gaagcacggugccgagug

SEQ ID NO: 3732 - RNA, 18 nt, Artificial Sequence
  Description of Artificial Sequence: Synthetic oligonucleotide
ggcgagaagcacggugcc

SEQ ID NO: 3733 - RNA, 18 nt, Artificial Sequence
  Description of Artificial Sequence: Synthetic oligonucleotide
ggccuggcgagaagcacg

SEQ ID NO: 3734 - RNA, 18 nt, Artificial Sequence
  Description of Artificial Sequence: Synthetic oligonucleotide
cagagggccuggcgagaa

SEQ ID NO: 3735 - RNA, 18 nt, Artificial Sequence
  Description of Artificial Sequence: Synthetic oligonucleotide
agagccagagggccuggc

SEQ ID NO: 3736 - RNA, 18 nt, Artificial Sequence
  Description of Artificial Sequence: Synthetic oligonucleotide
agggaagagccagagggc

SEQ ID NO: 3737 - RNA, 18 nt, Artificial Sequence
  Description of Artificial Sequence: Synthetic oligonucleotide
gccacagggaagagccag

SEQ ID NO: 3738 - RNA, 18 nt, Artificial Sequence
  Description of Artificial Sequence: Synthetic oligonucleotide
cugcagccacagggaaga

SEQ ID NO: 3739 - RNA, 18 nt, Artificial Sequence
  Description of Artificial Sequence: Synthetic oligonucleotide
gccaucugcagccacagg

SEQ ID NO: 3740 - RNA, 18 nt, Artificial Sequence
  Description of Artificial Sequence: Synthetic oligonucleotide
uaagugccaucugcagcc

SEQ ID NO: 3741 - RNA, 18 nt, Artificial Sequence
  Description of Artificial Sequence: Synthetic oligonucleotide
gccgcuaagugccaucug

SEQ ID NO: 3742 - RNA, 18 nt, Artificial Sequence
  Description of Artificial Sequence: Synthetic oligonucleotide
ccuaggccgcuaagugcc

SEQ ID NO: 3743 - RNA, 18 nt, Artificial Sequence
  Description of Artificial Sequence: Synthetic oligonucleotide
gacguccuaggccgcuaa

SEQ ID NO: 3744 - RNA, 18 nt, Artificial Sequence
  Description of Artificial Sequence: Synthetic oligonucleotide
gaauagacguccuaggcc

SEQ ID NO: 3745 - RNA, 18 nt, Artificial Sequence
  Description of Artificial Sequence: Synthetic oligonucleotide
cccgugaauagacguccu

SEQ ID NO: 3746 - RNA, 18 nt, Artificial Sequence
  Description of Artificial Sequence: Synthetic oligonucleotide
cuccucccgugaauagac

SEQ ID NO: 3747 - RNA, 18 nt, Artificial Sequence
  Description of Artificial Sequence: Synthetic oligonucleotide
ccucccuccucccgugaa

SEQ ID NO: 3748 - RNA, 18 nt, Artificial Sequence
  Description of Artificial Sequence: Synthetic oligonucleotide
cagugccucccuccuccc

SEQ ID NO: 3749 - RNA, 18 nt, Artificial Sequence
  Description of Artificial Sequence: Synthetic oligonucleotide
gagggcagugccucccuc

SEQ ID NO: 3750 - RNA, 18 nt, Artificial Sequence
  Description of Artificial Sequence: Synthetic oligonucleotide
cugaggagggcagugccu

SEQ ID NO: 3751 - RNA, 18 nt, Artificial Sequence
  Description of Artificial Sequence: Synthetic oligonucleotide
cagaccugaggagggcag

SEQ ID NO: 3752 - RNA, 18 nt, Artificial Sequence
  Description of Artificial Sequence: Synthetic oligonucleotide
uugggcagaccugaggag

SEQ ID NO: 3753 - RNA, 18 nt, Artificial Sequence
  Description of Artificial Sequence: Synthetic oligonucleotide
gcugcuugggcagaccug

SEQ ID NO: 3754 - RNA, 18 nt, Artificial Sequence
  Description of Artificial Sequence: Synthetic oligonucleotide
uacaagcugcuugggcag

SEQ ID NO: 3755 - RNA, 18 nt, Artificial Sequence
  Description of Artificial Sequence: Synthetic oligonucleotide
cuagcuacaagcugcuug

SEQ ID NO: 3756 - RNA, 18 nt, Artificial Sequence
  Description of Artificial Sequence: Synthetic oligonucleotide
cagugcuagcuacaagcu

SEQ ID NO: 3757 - RNA, 18 nt, Artificial Sequence
  Description of Artificial Sequence: Synthetic oligonucleotide
gggcccagugcuagcuac

SEQ ID NO: 3758 - RNA, 18 nt, Artificial Sequence
  Description of Artificial Sequence: Synthetic oligonucleotide
ggccagcggccggcaggg

SEQ ID NO: 3759 - RNA, 18 nt, Artificial Sequence
  Description of Artificial Sequence: Synthetic oligonucleotide
gggccagcggccggcagg

SEQ ID NO: 3760 - RNA, 18 nt, Artificial Sequence
  Description of Artificial Sequence: Synthetic oligonucleotide
gggcagggccagcggccg

SEQ ID NO: 3761 - RNA, 18 nt, Artificial Sequence
  Description of Artificial Sequence: Synthetic oligonucleotide
agagagggcagggccagc

SEQ ID NO: 3762 - RNA, 18 nt, Artificial Sequence
  Description of Artificial Sequence: Synthetic oligonucleotide
agaggagagagggcaggg

SEQ ID NO: 3763 - RNA, 18 nt, Artificial Sequence
  Description of Artificial Sequence: Synthetic oligonucleotide
ccugcagaggagagaggg

SEQ ID NO: 3764 - RNA, 18 nt, Artificial Sequence
  Description of Artificial Sequence: Synthetic oligonucleotide
ccgugccugcagaggaga

SEQ ID NO: 3765 - RNA, 18 nt, Artificial Sequence
  Description of Artificial Sequence: Synthetic oligonucleotide
aggccccgugccugcaga

SEQ ID NO: 3766 - RNA, 18 nt, Artificial Sequence
  Description of Artificial Sequence: Synthetic oligonucleotide
agcacaggccccgugccu

SEQ ID NO: 3767 - RNA, 18 nt, Artificial Sequence
  Description of Artificial Sequence: Synthetic oligonucleotide
cagagagcacaggccccg

SEQ ID NO: 3768 - RNA, 18 nt, Artificial Sequence
  Description of Artificial Sequence: Synthetic oligonucleotide
ucgagcagagagcacagg

SEQ ID NO: 3769 - RNA, 18 nt, Artificial Sequence
  Description of Artificial Sequence: Synthetic oligonucleotide
acaggucgagcagagagc

SEQ ID NO: 3770 - RNA, 18 nt, Artificial Sequence
  Description of Artificial Sequence: Synthetic oligonucleotide
uacacacaggucgagcag

SEQ ID NO: 3771 - RNA, 18 nt, Artificial Sequence
  Description of Artificial Sequence: Synthetic oligonucleotide
acgucagcaggaggaggg

SEQ ID NO: 3772 - RNA, 18 nt, Artificial Sequence
  Description of Artificial Sequence: Synthetic oligonucleotide
cggccacgucagcaggag

SEQ ID NO: 3773 - RNA, 18 nt, Artificial Sequence
  Description of Artificial Sequence: Synthetic oligonucleotide
gugugcggccacgucagc

SEQ ID NO: 3774 - RNA, 18 nt, Artificial Sequence
  Description of Artificial Sequence: Synthetic oligonucleotide
agggaggagaaagaggcc

SEQ ID NO: 3775 - RNA, 18 nt, Artificial Sequence
  Description of Artificial Sequence: Synthetic oligonucleotide
gguacagggaggagaaag

SEQ ID NO: 3776 - RNA, 18 nt, Artificial Sequence
  Description of Artificial Sequence: Synthetic oligonucleotide
ggacugguacagggagga

SEQ ID NO: 3777 - RNA, 18 nt, Artificial Sequence
  Description of Artificial Sequence: Synthetic oligonucleotide
cagcuggacugguacagg

SEQ ID NO: 3778 - RNA, 18 nt, Artificial Sequence
  Description of Artificial Sequence: Synthetic oligonucleotide
cuuggcagcuggacuggu

SEQ ID NO: 3779 - RNA, 18 nt, Artificial Sequence
  Description of Artificial Sequence: Synthetic oligonucleotide
cuguccuuggcagcugga

SEQ ID NO: 3780 - RNA, 18 nt, Artificial Sequence
  Description of Artificial Sequence: Synthetic oligonucleotide
ugcagcuguccuuggcag

SEQ ID NO: 3781 - RNA, 18 nt, Artificial Sequence
  Description of Artificial Sequence: Synthetic oligonucleotide
uccugugcagcuguccuu

SEQ ID NO: 3782 - RNA, 18 nt, Artificial Sequence
  Description of Artificial Sequence: Synthetic oligonucleotide
aacgcuccugugcagcug

SEQ ID NO: 3783 - RNA, 18 nt, Artificial Sequence
  Description of Artificial Sequence: Synthetic oligonucleotide
caggaaacgcuccugugc

SEQ ID NO: 3784 - RNA, 18 nt, Artificial Sequence
  Description of Artificial Sequence: Synthetic oligonucleotide
cugcccaggaaacgcucc

SEQ ID NO: 3785 - RNA, 18 nt, Artificial Sequence
  Description of Artificial Sequence: Synthetic oligonucleotide
acagggaggagaaagagg

SEQ ID NO: 3786 - RNA, 18 nt, Artificial Sequence
  Description of Artificial Sequence: Synthetic oligonucleotide
cugguacagggaggagaa

SEQ ID NO: 3787 - RNA, 18 nt, Artificial Sequence
  Description of Artificial Sequence: Synthetic oligonucleotide
cuggacugguacagggag

SEQ ID NO: 3788 - RNA, 18 nt, Artificial Sequence
  Description of Artificial Sequence: Synthetic oligonucleotide
ggcagcuggacugguaca

SEQ ID NO: 3789 - RNA, 18 nt, Artificial Sequence
  Description of Artificial Sequence: Synthetic oligonucleotide
uccuuggcagcuggacug

SEQ ID NO: 3790 - RNA, 18 nt, Artificial Sequence
  Description of Artificial Sequence: Synthetic oligonucleotide
agcuguccuuggcagcug

SEQ ID NO: 3791 - RNA, 18 nt, Artificial Sequence
  Description of Artificial Sequence: Synthetic oligonucleotide
ugugcagcuguccuuggc

SEQ ID NO: 3792 - RNA, 18 nt, Artificial Sequence
  Description of Artificial Sequence: Synthetic oligonucleotide
gcuccugugcagcugucc

SEQ ID NO: 3793 - RNA, 18 nt, Artificial Sequence
  Description of Artificial Sequence: Synthetic oligonucleotide
gaaacgcuccugugcagc

SEQ ID NO: 3794 - RNA, 18 nt, Artificial Sequence
  Description of Artificial Sequence: Synthetic oligonucleotide
cccaggaaacgcuccugu

SEQ ID NO: 3795 - RNA, 18 nt, Artificial Sequence
  Description of Artificial Sequence: Synthetic oligonucleotide
cgcuucccucugagaggc

SEQ ID NO: 3796 - RNA, 18 nt, Artificial Sequence
  Description of Artificial Sequence: Synthetic oligonucleotide
ccaaccgcuucccucuga

SEQ ID NO: 3797 - RNA, 18 nt, Artificial Sequence
  Description of Artificial Sequence: Synthetic oligonucleotide
ugcagccaaccgcuuccc

SEQ ID NO: 3798 - RNA, 18 nt, Artificial Sequence
  Description of Artificial Sequence: Synthetic oligonucleotide
cgcucugcagccaaccgc

SEQ ID NO: 3799 - RNA, 18 nt, Artificial Sequence
  Description of Artificial Sequence: Synthetic oligonucleotide
aguggcgcucugcagcca

SEQ ID NO: 3800 - RNA, 18 nt, Artificial Sequence
  Description of Artificial Sequence: Synthetic oligonucleotide
ggcagaguggcgcucugc

SEQ ID NO: 3801 - RNA, 18 nt, Artificial Sequence
  Description of Artificial Sequence: Synthetic oligonucleotide
uaugaggcagaguggcgc

SEQ ID NO: 3802 - RNA, 18 nt, Artificial Sequence
  Description of Artificial Sequence: Synthetic oligonucleotide
gcaccuaugaggcagagu

SEQ ID NO: 3803 - RNA, 18 nt, Artificial Sequence
  Description of Artificial Sequence: Synthetic oligonucleotide
gcacagcaccuaugaggc

SEQ ID NO: 3804 - RNA, 18 nt, Artificial Sequence
  Description of Artificial Sequence: Synthetic oligonucleotide
gacgagcacagcaccuau

SEQ ID NO: 3805 - RNA, 18 nt, Artificial Sequence
  Description of Artificial Sequence: Synthetic oligonucleotide
gaggcgacgagcacagca

SEQ ID NO: 3806 - RNA, 18 nt, Artificial Sequence
  Description of Artificial Sequence: Synthetic oligonucleotide
cggaugaggcgacgagca

SEQ ID NO: 3807 - RNA, 18 nt, Artificial Sequence
  Description of Artificial Sequence: Synthetic oligonucleotide
gugggcggaugaggcgac

SEQ ID NO: 3808 - RNA, 18 nt, Artificial Sequence
  Description of Artificial Sequence: Synthetic oligonucleotide
gggugggcggaugaggcg

SEQ ID NO: 3809 - RNA, 18 nt, Artificial Sequence
  Description of Artificial Sequence: Synthetic oligonucleotide
aggcagacggaccauggg

SEQ ID NO: 3810 - RNA, 18 nt, Artificial Sequence
  Description of Artificial Sequence: Synthetic oligonucleotide
aauggaggcagacggacc

SEQ ID NO: 3811 - RNA, 18 nt, Artificial Sequence
  Description of Artificial Sequence: Synthetic oligonucleotide
agggcaauggaggcagac

SEQ ID NO: 3812 - RNA, 18 nt, Artificial Sequence
  Description of Artificial Sequence: Synthetic oligonucleotide
uccccagggcaauggagg

SEQ ID NO: 3813 - RNA, 18 nt, Artificial Sequence
  Description of Artificial Sequence: Synthetic oligonucleotide
ccugcuccccagggcaau

SEQ ID NO: 3814 - RNA, 18 nt, Artificial Sequence
  Description of Artificial Sequence: Synthetic oligonucleotide
cgggaccugcuccccagg

SEQ ID NO: 3815 - RNA, 18 nt, Artificial Sequence
  Description of Artificial Sequence: Synthetic oligonucleotide
cgagucgggaccugcucc

SEQ ID NO: 3816 - RNA, 18 nt, Artificial Sequence
  Description of Artificial Sequence: Synthetic oligonucleotide
ucaugcgagucgggaccu

SEQ ID NO: 3817 - RNA, 18 nt, Artificial Sequence
  Description of Artificial Sequence: Synthetic oligonucleotide
cguccucaugcgagucgg

SEQ ID NO: 3818 - RNA, 18 nt, Artificial Sequence
  Description of Artificial Sequence: Synthetic oligonucleotide
acagacguccucaugcga

SEQ ID NO: 3819 - RNA, 18 nt, Artificial Sequence
  Description of Artificial Sequence: Synthetic oligonucleotide
ucugcacagacguccuca

SEQ ID NO: 3820 - RNA, 18 nt, Artificial Sequence
  Description of Artificial Sequence: Synthetic oligonucleotide
gacauucugcacagacgu

SEQ ID NO: 3821 - RNA, 18 nt, Artificial Sequence
  Description of Artificial Sequence: Synthetic oligonucleotide
ccaaagacauucugcaca

SEQ ID NO: 3822 - RNA, 18 nt, Artificial Sequence
  Description of Artificial Sequence: Synthetic oligonucleotide
ccaagccaaagacauucu

SEQ ID NO: 3823 - RNA, 18 nt, Artificial Sequence
  Description of Artificial Sequence: Synthetic oligonucleotide
gcuggccaagccaaagac

SEQ ID NO: 3824 - RNA, 18 nt, Artificial Sequence
  Description of Artificial Sequence: Synthetic oligonucleotide
aucccgcuggccaagcca

SEQ ID NO: 3825 - RNA, 18 nt, Artificial Sequence
  Description of Artificial Sequence: Synthetic oligonucleotide
gggaucccgcuggccaag

SEQ ID NO: 3826 - RNA, 18 nt, Artificial Sequence
  Description of Artificial Sequence: Synthetic oligonucleotide
aagggaccaagucaaggg

SEQ ID NO: 3827 - RNA, 18 nt, Artificial Sequence
  Description of Artificial Sequence: Synthetic oligonucleotide
ccacaaagggaccaaguc

SEQ ID NO: 3828 - RNA, 18 nt, Artificial Sequence
  Description of Artificial Sequence: Synthetic oligonucleotide
cucagccacaaagggacc

SEQ ID NO: 3829 - RNA, 18 nt, Artificial Sequence
  Description of Artificial Sequence: Synthetic oligonucleotide
cagggcucagccacaaag

SEQ ID NO: 3830 - RNA, 18 nt, Artificial Sequence
  Description of Artificial Sequence: Synthetic oligonucleotide
gggaacagggcucagcca

SEQ ID NO: 3831 - RNA, 18 nt, Artificial Sequence
  Description of Artificial Sequence: Synthetic oligonucleotide
agcgugggaacagggcuc

SEQ ID NO: 3832 - RNA, 18 nt, Artificial Sequence
  Description of Artificial Sequence: Synthetic oligonucleotide
cgcacagcgugggaacag

SEQ ID NO: 3833 - RNA, 18 nt, Artificial Sequence
  Description of Artificial Sequence: Synthetic oligonucleotide
gugcucgcacagcguggg

SEQ ID NO: 3834 - RNA, 18 nt, Artificial Sequence
  Description of Artificial Sequence: Synthetic oligonucleotide
cgggagugcucgcacagc

SEQ ID NO: 3835 - RNA, 18 nt, Artificial Sequence
  Description of Artificial Sequence: Synthetic oligonucleotide
ugggccgggagugcucgc

SEQ ID NO: 3836 - RNA, 18 nt, Artificial Sequence
  Description of Artificial Sequence: Synthetic oligonucleotide
gaagcugggccgggagug

SEQ ID NO: 3837 - RNA, 18 nt, Artificial Sequence
  Description of Artificial Sequence: Synthetic oligonucleotide
ggccugaagcugggccgg

SEQ ID NO: 3838 - RNA, 18 nt, Artificial Sequence
  Description of Artificial Sequence: Synthetic oligonucleotide
ccucaggccugaagcugg

SEQ ID NO: 3839 - RNA, 18 nt, Artificial Sequence
  Description of Artificial Sequence: Synthetic oligonucleotide
ccaccccucaggccugaa

SEQ ID NO: 3840 - RNA, 18 nt, Artificial Sequence
  Description of Artificial Sequence: Synthetic oligonucleotide
cacccccaccccucaggc

SEQ ID NO: 3841 - RNA, 18 nt, Artificial Sequence
  Description of Artificial Sequence: Synthetic oligonucleotide
caggccacccccaccccu

SEQ ID NO: 3842 - RNA, 18 nt, Artificial Sequence
  Description of Artificial Sequence: Synthetic oligonucleotide
agacucaggccaccccca

SEQ ID NO: 3843 - RNA, 18 nt, Artificial Sequence
  Description of Artificial Sequence: Synthetic oligonucleotide
cauggagacucaggccac

SEQ ID NO: 3844 - RNA, 18 nt, Artificial Sequence
  Description of Artificial Sequence: Synthetic oligonucleotide
gucaccauggagacucag

SEQ ID NO: 3845 - RNA, 18 nt, Artificial Sequence
  Description of Artificial Sequence: Synthetic oligonucleotide
cugaugucaccauggaga

SEQ ID NO: 3846 - RNA, 18 nt, Artificial Sequence
  Description of Artificial Sequence: Synthetic oligonucleotide
cucagcugaugucaccau

SEQ ID NO: 3847 - RNA, 18 nt, Artificial Sequence
  Description of Artificial Sequence: Synthetic oligonucleotide
ugcagcucagcugauguc

SEQ ID NO: 3848 - RNA, 18 nt, Artificial Sequence
  Description of Artificial Sequence: Synthetic oligonucleotide
gagucugcagcucagcug

SEQ ID NO: 3849 - RNA, 18 nt, Artificial Sequence
  Description of Artificial Sequence: Synthetic oligonucleotide
caucagagucugcagcuc

SEQ ID NO: 3850 - RNA, 18 nt, Artificial Sequence
  Description of Artificial Sequence: Synthetic oligonucleotide
ccacccaucagagucugc

SEQ ID NO: 3851 - RNA, 18 nt, Artificial Sequence
  Description of Artificial Sequence: Synthetic oligonucleotide
agcugccacccaucagag

SEQ ID NO: 3852 - RNA, 18 nt, Artificial Sequence
  Description of Artificial Sequence: Synthetic oligonucleotide
uaaacagcugccacccau

SEQ ID NO: 3853 - RNA, 18 nt, Artificial Sequence
  Description of Artificial Sequence: Synthetic oligonucleotide
cccccuaaacagcugcca

SEQ ID NO: 3854 - RNA, 18 nt, Artificial Sequence
  Description of Artificial Sequence: Synthetic oligonucleotide
ggcuucccccuaaacagc

SEQ ID NO: 3855 - RNA, 18 nt, Artificial Sequence
  Description of Artificial Sequence: Synthetic oligonucleotide
gggugggcuucccccuaa

SEQ ID NO: 3856 - RNA, 18 nt, Artificial Sequence
  Description of Artificial Sequence: Synthetic oligonucleotide
cccgcucggugcaggccc

SEQ ID NO: 3857 - RNA, 18 nt, Artificial Sequence
  Description of Artificial Sequence: Synthetic oligonucleotide
caaggcccgcucggugca

SEQ ID NO: 3858 - RNA, 18 nt, Artificial Sequence
  Description of Artificial Sequence: Synthetic oligonucleotide
cagggcaaggcccgcucg

SEQ ID NO: 3859 - RNA, 18 nt, Artificial Sequence
  Description of Artificial Sequence: Synthetic oligonucleotide
aaggccagggcaaggccc

SEQ ID NO: 3860 - RNA, 18 nt, Artificial Sequence
  Description of Artificial Sequence: Synthetic oligonucleotide
caccaaaggccagggcaa

SEQ ID NO: 3861 - RNA, 18 nt, Artificial Sequence
  Description of Artificial Sequence: Synthetic oligonucleotide
ggagccaccaaaggccag

SEQ ID NO: 3862 - RNA, 18 nt, Artificial Sequence
  Description of Artificial Sequence: Synthetic oligonucleotide
gggagccaccaaaggcca

SEQ ID NO: 3863 - RNA, 18 nt, Artificial Sequence
  Description of Artificial Sequence: Synthetic oligonucleotide
ggguuccagaggccaggg

SEQ ID NO: 3864 - RNA, 18 nt, Artificial Sequence
  Description of Artificial Sequence: Synthetic oligonucleotide
ucuguggguuccagaggc

SEQ ID NO: 3865 - RNA, 18 nt, Artificial Sequence
  Description of Artificial Sequence: Synthetic oligonucleotide
ccccaucuguggguucca

SEQ ID NO: 3866 - RNA, 18 nt, Artificial Sequence
  Description of Artificial Sequence: Synthetic oligonucleotide
ggcagccccaucuguggg

SEQ ID NO: 3867 - RNA, 18 nt, Artificial Sequence
  Description of Artificial Sequence: Synthetic oligonucleotide
cuugaggcagccccaucu

SEQ ID NO: 3868 - RNA, 18 nt, Artificial Sequence
  Description of Artificial Sequence: Synthetic oligonucleotide
ugggacuugaggcagccc

SEQ ID NO: 3869 - RNA, 18 nt, Artificial Sequence
  Description of Artificial Sequence: Synthetic oligonucleotide
caaccugggacuugaggc

SEQ ID NO: 3870 - RNA, 18 nt, Artificial Sequence
  Description of Artificial Sequence: Synthetic oligonucleotide
cuggucaaccugggacuu

SEQ ID NO: 3871 - RNA, 18 nt, Artificial Sequence
  Description of Artificial Sequence: Synthetic oligonucleotide
ggccccuggucaaccugg

SEQ ID NO: 3872 - RNA, 18 nt, Artificial Sequence
  Description of Artificial Sequence: Synthetic oligonucleotide
ugcagggccccuggucaa

SEQ ID NO: 3873 - RNA, 18 nt, Artificial Sequence
  Description of Artificial Sequence: Synthetic oligonucleotide
cggucugcagggccccug

SEQ ID NO: 3874 - RNA, 18 nt, Artificial Sequence
  Description of Artificial Sequence: Synthetic oligonucleotide
gaggucggucugcagggc

SEQ ID NO: 3875 - RNA, 18 nt, Artificial Sequence
  Description of Artificial Sequence: Synthetic oligonucleotide
aggcagaggucggucugc

SEQ ID NO: 3876 - RNA, 18 nt, Artificial Sequence
  Description of Artificial Sequence: Synthetic oligonucleotide
gcaacaggcagaggucgg

SEQ ID NO: 3877 - RNA, 18 nt, Artificial Sequence
  Description of Artificial Sequence: Synthetic oligonucleotide
gggcaacaggcagagguc

SEQ ID NO: 3878 - RNA, 18 nt, Artificial Sequence
  Description of Artificial Sequence: Synthetic oligonucleotide
uccccaccagggcuuggg

SEQ ID NO: 3879 - RNA, 18 nt, Artificial Sequence
  Description of Artificial Sequence: Synthetic oligonucleotide
agcacuccccaccagggc

SEQ ID NO: 3880 - RNA, 18 nt, Artificial Sequence
  Description of Artificial Sequence: Synthetic oligonucleotide
gucacagcacuccccacc

SEQ ID NO: 3881 - RNA, 18 nt, Artificial Sequence
  Description of Artificial Sequence: Synthetic oligonucleotide
ugcaggucacagcacucc

SEQ ID NO: 3882 - RNA, 18 nt, Artificial Sequence
  Description of Artificial Sequence: Synthetic oligonucleotide
caccaugcaggucacagc

SEQ ID NO: 3883 - RNA, 18 nt, Artificial Sequence
  Description of Artificial Sequence: Synthetic oligonucleotide
gggagcaccaugcagguc

SEQ ID NO: 3884 - RNA, 18 nt, Artificial Sequence
  Description of Artificial Sequence: Synthetic oligonucleotide
caaagcagcauuuccugu

SEQ ID NO: 3885 - RNA, 18 nt, Artificial Sequence
  Description of Artificial Sequence: Synthetic oligonucleotide
ggucccaaagcagcauuu

SEQ ID NO: 3886 - RNA, 18 nt, Artificial Sequence
  Description of Artificial Sequence: Synthetic oligonucleotide
ugggaggucccaaagcag

SEQ ID NO: 3887 - RNA, 18 nt, Artificial Sequence
  Description of Artificial Sequence: Synthetic oligonucleotide
gagggugggaggucccaa

SEQ ID NO: 3888 - RNA, 18 nt, Artificial Sequence
  Description of Artificial Sequence: Synthetic oligonucleotide
ggagagagggugggaggu

SEQ ID NO: 3889 - RNA, 18 nt, Artificial Sequence
  Description of Artificial Sequence: Synthetic oligonucleotide
gcuaaggagagagggugg

SEQ ID NO: 3890 - RNA, 18 nt, Artificial Sequence
  Description of Artificial Sequence: Synthetic oligonucleotide
gggacgcuaaggagagag

SEQ ID NO: 3891 - RNA, 18 nt, Artificial Sequence
  Description of Artificial Sequence: Synthetic oligonucleotide
gccagacccacagcuggg

SEQ ID NO: 3892 - RNA, 18 nt, Artificial Sequence
  Description of Artificial Sequence: Synthetic oligonucleotide
agccagacccacagcugg

SEQ ID NO: 3893 - RNA, 18 nt, Artificial Sequence
  Description of Artificial Sequence: Synthetic oligonucleotide
cuccaagccagacccaca

SEQ ID NO: 3894 - RNA, 18 nt, Artificial Sequence
  Description of Artificial Sequence: Synthetic oligonucleotide
uccaacuccaagccagac

SEQ ID NO: 3895 - RNA, 18 nt, Artificial Sequence
  Description of Artificial Sequence: Synthetic oligonucleotide
cacccuccaacuccaagc

SEQ ID NO: 3896 - RNA, 18 nt, Artificial Sequence
  Description of Artificial Sequence: Synthetic oligonucleotide
aggcucacccuccaacuc

SEQ ID NO: 3897 - RNA, 18 nt, Artificial Sequence
  Description of Artificial Sequence: Synthetic oligonucleotide
agcagaggcucacccucc

SEQ ID NO: 3898 - RNA, 18 nt, Artificial Sequence
  Description of Artificial Sequence: Synthetic oligonucleotide
ccaagagcagaggcucac

SEQ ID NO: 3899 - RNA, 18 nt, Artificial Sequence
  Description of Artificial Sequence: Synthetic oligonucleotide
ugcucccaagagcagagg

SEQ ID NO: 3900 - RNA, 18 nt, Artificial Sequence
  Description of Artificial Sequence: Synthetic oligonucleotide
cagacugcucccaagagc

SEQ ID NO: 3901 - RNA, 18 nt, Artificial Sequence
  Description of Artificial Sequence: Synthetic oligonucleotide
gcaaacagacugcuccca

SEQ ID NO: 3902 - RNA, 18 nt, Artificial Sequence
  Description of Artificial Sequence: Synthetic oligonucleotide
uguuugcaaacagacugc

SEQ ID NO: 3903 - RNA, 18 nt, Artificial Sequence
  Description of Artificial Sequence: Synthetic oligonucleotide
gucccuguuugcaaacag

SEQ ID NO: 3904 - RNA, 18 nt, Artificial Sequence
  Description of Artificial Sequence: Synthetic oligonucleotide
gggaagucccuguuugca

SEQ ID NO: 3905 - RNA, 18 nt, Artificial Sequence
  Description of Artificial Sequence: Synthetic oligonucleotide
gagacuccgugacguggg

SEQ ID NO: 3906 - RNA, 18 nt, Artificial Sequence
  Description of Artificial Sequence: Synthetic oligonucleotide
ugcggagacuccgugacg

SEQ ID NO: 3907 - RNA, 18 nt, Artificial Sequence
  Description of Artificial Sequence: Synthetic oligonucleotide
agagcugcggagacuccg

SEQ ID NO: 3908 - RNA, 18 nt, Artificial Sequence
  Description of Artificial Sequence: Synthetic oligonucleotide
cgaggagagcugcggaga

SEQ ID NO: 3909 - RNA, 18 nt, Artificial Sequence
  Description of Artificial Sequence: Synthetic oligonucleotide
guaaccgaggagagcugc

SEQ ID NO: 3910 - RNA, 18 nt, Artificial Sequence
  Description of Artificial Sequence: Synthetic oligonucleotide
cccucguaaccgaggaga

SEQ ID NO: 3911 - RNA, 18 nt, Artificial Sequence
  Description of Artificial Sequence: Synthetic oligonucleotide
accagcccucguaaccga

SEQ ID NO: 3912 - RNA, 18 nt, Artificial Sequence
  Description of Artificial Sequence: Synthetic oligonucleotide
cugaaaccagcccucgua

SEQ ID NO: 3913 - RNA, 18 nt, Artificial Sequence
  Description of Artificial Sequence: Synthetic oligonucleotide
ggagccugaaaccagccc

SEQ ID NO: 3914 - RNA, 18 nt, Artificial Sequence
  Description of Artificial Sequence: Synthetic oligonucleotide
gagcgggagccugaaacc

SEQ ID NO: 3915 - RNA, 18 nt, Artificial Sequence
  Description of Artificial Sequence: Synthetic oligonucleotide
uaaaagagcgggagccug

SEQ ID NO: 3916 - RNA, 18 nt, Artificial Sequence
  Description of Artificial Sequence: Synthetic oligonucleotide
agcucuaaaagagcggga

SEQ ID NO: 3917 - RNA, 18 nt, Artificial Sequence
  Description of Artificial Sequence: Synthetic oligonucleotide
gccucagcucuaaaagag

SEQ ID NO: 3918 - RNA, 18 nt, Artificial Sequence
  Description of Artificial Sequence: Synthetic oligonucleotide
gacgggccucagcucuaa

SEQ ID NO: 3919 - RNA, 18 nt, Artificial Sequence
  Description of Artificial Sequence: Synthetic oligonucleotide
cgcccgacgggccucagc

SEQ ID NO: 3920 - RNA, 18 nt, Artificial Sequence
  Description of Artificial Sequence: Synthetic oligonucleotide
cucuccgcccgacgggcc

SEQ ID NO: 3921 - RNA, 18 nt, Artificial Sequence
  Description of Artificial Sequence: Synthetic oligonucleotide
agacgcucuccgcccgac

SEQ ID NO: 3922 - RNA, 18 nt, Artificial Sequence
  Description of Artificial Sequence: Synthetic oligonucleotide
gggcaagacgcucuccgc

SEQ ID NO: 3923 - RNA, 18 nt, Artificial Sequence
  Description of Artificial Sequence: Synthetic oligonucleotide
gccuccagguaggcaggg

SEQ ID NO: 3924 - RNA, 18 nt, Artificial Sequence
  Description of Artificial Sequence: Synthetic oligonucleotide
gugccuccagguaggcag

SEQ ID NO: 3925 - RNA, 18 nt, Artificial Sequence
  Description of Artificial Sequence: Synthetic oligonucleotide
ccccugugccuccaggua

SEQ ID NO: 3926 - RNA, 18 nt, Artificial Sequence
  Description of Artificial Sequence: Synthetic oligonucleotide
agccaccccugugccucc

SEQ ID NO: 3927 - RNA, 18 nt, Artificial Sequence
  Description of Artificial Sequence: Synthetic oligonucleotide
ccagcagccaccccugug

SEQ ID NO: 3928 - RNA, 18 nt, Artificial Sequence
  Description of Artificial Sequence: Synthetic oligonucleotide
guccaccagcagccaccc

SEQ ID NO: 3929 - RNA, 18 nt, Artificial Sequence
  Description of Artificial Sequence: Synthetic oligonucleotide
cuaguguccaccagcagc

SEQ ID NO: 3930 - RNA, 18 nt, Artificial Sequence
  Description of Artificial Sequence: Synthetic oligonucleotide
ccacccuaguguccacca

SEQ ID NO: 3931 - RNA, 18 nt, Artificial Sequence
  Description of Artificial Sequence: Synthetic oligonucleotide
ucugcccacccuaguguc

SEQ ID NO: 3932 - RNA, 18 nt, Artificial Sequence
  Description of Artificial Sequence: Synthetic oligonucleotide
ucggcucugcccacccua

SEQ ID NO: 3933 - RNA, 18 nt, Artificial Sequence
  Description of Artificial Sequence: Synthetic oligonucleotide
ggcaaucggcucugccca

SEQ ID NO: 3934 - RNA, 18 nt, Artificial Sequence
  Description of Artificial Sequence: Synthetic oligonucleotide
gggcaggcaaucggcucu

SEQ ID NO: 3935 - RNA, 18 nt, Artificial Sequence
  Description of Artificial Sequence: Synthetic oligonucleotide
ggguugggcaggcaaucg

SEQ ID NO: 3936 - RNA, 18 nt, Artificial Sequence
  Description of Artificial Sequence: Synthetic oligonucleotide
ccugcaugagugcccggg

SEQ ID NO: 3937 - RNA, 18 nt, Artificial Sequence
  Description of Artificial Sequence: Synthetic oligonucleotide
uccugcaugagugcccgg

SEQ ID NO: 3938 - RNA, 18 nt, Artificial Sequence
  Description of Artificial Sequence: Synthetic oligonucleotide
gccucuccugcaugagug

SEQ ID NO: 3939 - RNA, 18 nt, Artificial Sequence
  Description of Artificial Sequence: Synthetic oligonucleotide
cacaggccucuccugcau

SEQ ID NO: 3940 - RNA, 18 nt, Artificial Sequence
  Description of Artificial Sequence: Synthetic oligonucleotide
cccgacacaggccucucc

SEQ ID NO: 3941 - RNA, 18 nt, Artificial Sequence
  Description of Artificial Sequence: Synthetic oligonucleotide
gugaccccgacacaggcc

SEQ ID NO: 3942 - RNA, 18 nt, Artificial Sequence
  Description of Artificial Sequence: Synthetic oligonucleotide
ugcacgugaccccgacac

SEQ ID NO: 3943 - RNA, 18 nt, Artificial Sequence
  Description of Artificial Sequence: Synthetic oligonucleotide
aggccugcacgugacccc

SEQ ID NO: 3944 - RNA, 18 nt, Artificial Sequence
  Description of Artificial Sequence: Synthetic oligonucleotide
ugggaaggccugcacgug

SEQ ID NO: 3945 - RNA, 18 nt, Artificial Sequence
  Description of Artificial Sequence: Synthetic oligonucleotide
gacgcugggaaggccugc

SEQ ID NO: 3946 - RNA, 18 nt, Artificial Sequence
  Description of Artificial Sequence: Synthetic oligonucleotide
gggaggacgcugggaagg

SEQ ID NO: 3947 - RNA, 18 nt, Artificial Sequence
  Description of Artificial Sequence: Synthetic oligonucleotide
gggcagggaggacgcugg

SEQ ID NO: 3948 - RNA, 18 nt, Artificial Sequence
  Description of Artificial Sequence: Synthetic oligonucleotide
cgagcgggcagggaggac

SEQ ID NO: 3949 - RNA, 18 nt, Artificial Sequence
  Description of Artificial Sequence: Synthetic oligonucleotide
uccaccgagcgggcaggg

SEQ ID NO: 3950 - RNA, 18 nt, Artificial Sequence
  Description of Artificial Sequence: Synthetic oligonucleotide
ugccauccaccgagcggg

SEQ ID NO: 3951 - RNA, 18 nt, Artificial Sequence
  Description of Artificial Sequence: Synthetic oligonucleotide
acugcugccauccaccga

SEQ ID NO: 3952 - RNA, 18 nt, Artificial Sequence
  Description of Artificial Sequence: Synthetic oligonucleotide
ugcuuacugcugccaucc

SEQ ID NO: 3953 - RNA, 18 nt, Artificial Sequence
  Description of Artificial Sequence: Synthetic oligonucleotide
ggcucugcuuacugcugc

SEQ ID NO: 3954 - RNA, 18 nt, Artificial Sequence
  Description of Artificial Sequence: Synthetic oligonucleotide
cccagggcucugcuuacu

SEQ ID NO: 3955 - RNA, 18 nt, Artificial Sequence
  Description of Artificial Sequence: Synthetic oligonucleotide
gccuccccagggcucugc

SEQ ID NO: 3956 - RNA, 18 nt, Artificial Sequence
  Description of Artificial Sequence: Synthetic oligonucleotide
ugcgagccuccccagggc

SEQ ID NO: 3957 - RNA, 18 nt, Artificial Sequence
  Description of Artificial Sequence: Synthetic oligonucleotide
agcccugcgagccucccc

SEQ ID NO: 3958 - RNA, 18 nt, Artificial Sequence
  Description of Artificial Sequence: Synthetic oligonucleotide
acagcagcccugcgagcc

SEQ ID NO: 3959 - RNA, 18 nt, Artificial Sequence
  Description of Artificial Sequence: Synthetic oligonucleotide
gagggacagcagcccugc

SEQ ID NO: 3960 - RNA, 18 nt, Artificial Sequence
  Description of Artificial Sequence: Synthetic oligonucleotide
gaccagagggacagcagc

SEQ ID NO: 3961 - RNA, 18 nt, Artificial Sequence
  Description of Artificial Sequence: Synthetic oligonucleotide
cuccugaccagagggaca

SEQ ID NO: 3962 - RNA, 18 nt, Artificial Sequence
  Description of Artificial Sequence: Synthetic oligonucleotide
gccuucuccugaccagag

SEQ ID NO: 3963 - RNA, 18 nt, Artificial Sequence
  Description of Artificial Sequence: Synthetic oligonucleotide
aaccagccuucuccugac

SEQ ID NO: 3964 - RNA, 18 nt, Artificial Sequence
  Description of Artificial Sequence: Synthetic oligonucleotide
ccgagaaccagccuucuc

SEQ ID NO: 3965 - RNA, 18 nt, Artificial Sequence
  Description of Artificial Sequence: Synthetic oligonucleotide
ggccuccgagaaccagcc

SEQ ID NO: 3966 - RNA, 18 nt, Artificial Sequence
  Description of Artificial Sequence: Synthetic oligonucleotide
gacguggccuccgagaac

SEQ ID NO: 3967 - RNA, 18 nt, Artificial Sequence
  Description of Artificial Sequence: Synthetic oligonucleotide
gcccugacguggccuccg

SEQ ID NO: 3968 - RNA, 18 nt, Artificial Sequence
  Description of Artificial Sequence: Synthetic oligonucleotide
cccuggcccugacguggc

SEQ ID NO: 3969 - RNA, 18 nt, Artificial Sequence
  Description of Artificial Sequence: Synthetic oligonucleotide
ccaggcccuggcccugac

SEQ ID NO: 3970 - RNA, 18 nt, Artificial Sequence
  Description of Artificial Sequence: Synthetic oligonucleotide
cugggccaggcccuggcc

SEQ ID NO: 3971 - RNA, 18 nt, Artificial Sequence
  Description of Artificial Sequence: Synthetic oligonucleotide
uccaugaccacggcggag

SEQ ID NO: 3972 - RNA, 18 nt, Artificial Sequence
  Description of Artificial Sequence: Synthetic oligonucleotide
ccuccuccaugaccacgg

SEQ ID NO: 3973 - RNA, 18 nt, Artificial Sequence
  Description of Artificial Sequence: Synthetic oligonucleotide
acuucccuccuccaugac

SEQ ID NO: 3974 - RNA, 18 nt, Artificial Sequence
  Description of Artificial Sequence: Synthetic oligonucleotide
cccggacuucccuccucc

SEQ ID NO: 3975 - RNA, 18 nt, Artificial Sequence
  Description of Artificial Sequence: Synthetic oligonucleotide
ccucgcccggacuucccu

SEQ ID NO: 3976 - RNA, 18 nt, Artificial Sequence
  Description of Artificial Sequence: Synthetic oligonucleotide
aggaaccucgcccggacu

SEQ ID NO: 3977 - RNA, 18 nt, Artificial Sequence
  Description of Artificial Sequence: Synthetic oligonucleotide
agcacaggaaccucgccc

SEQ ID NO: 3978 - RNA, 18 nt, Artificial Sequence
  Description of Artificial Sequence: Synthetic oligonucleotide
ccaccagcacaggaaccu

SEQ ID NO: 3979 - RNA, 18 nt, Artificial Sequence
  Description of Artificial Sequence: Synthetic oligonucleotide
gggcuccaccagcacagg

SEQ ID NO: 3980 - RNA, 18 nt, Artificial Sequence
  Description of Artificial Sequence: Synthetic oligonucleotide
ucaacguccuccaacccu

SEQ ID NO: 3981 - RNA, 18 nt, Artificial Sequence
  Description of Artificial Sequence: Synthetic oligonucleotide
cugccucaacguccucca

SEQ ID NO: 3982 - RNA, 18 nt, Artificial Sequence
  Description of Artificial Sequence: Synthetic oligonucleotide
uagcgcugccucaacguc

SEQ ID NO: 3983 - RNA, 18 nt, Artificial Sequence
  Description of Artificial Sequence: Synthetic oligonucleotide
augccuagcgcugccuca

SEQ ID NO: 3984 - RNA, 18 nt, Artificial Sequence
  Description of Artificial Sequence: Synthetic oligonucleotide
uguccaugccuagcgcug

SEQ ID NO: 3985 - RNA, 18 nt, Artificial Sequence
  Description of Artificial Sequence: Synthetic oligonucleotide
gcgccuguccaugccuag

SEQ ID NO: 3986 - RNA, 18 nt, Artificial Sequence
  Description of Artificial Sequence: Synthetic oligonucleotide
uccgugcgccuguccaug

SEQ ID NO: 3987 - RNA, 18 nt, Artificial Sequence
  Description of Artificial Sequence: Synthetic oligonucleotide
aggcauccgugcgccugu

SEQ ID NO: 3988 - RNA, 18 nt, Artificial Sequence
  Description of Artificial Sequence: Synthetic oligonucleotide
gcuguaggcauccgugcg

SEQ ID NO: 3989 - RNA, 18 nt, Artificial Sequence
  Description of Artificial Sequence: Synthetic oligonucleotide
agaggacauuggaccgca

SEQ ID NO: 3990 - RNA, 18 nt, Artificial Sequence
  Description of Artificial Sequence: Synthetic oligonucleotide
agacaagaggacauugga

SEQ ID NO: 3991 - RNA, 18 nt, Artificial Sequence
  Description of Artificial Sequence: Synthetic oligonucleotide
ucaaaagacaagaggaca

SEQ ID NO: 3992 - RNA, 18 nt, Artificial Sequence
  Description of Artificial Sequence: Synthetic oligonucleotide
ugucaucaaaagacaaga

SEQ ID NO: 3993 - RNA, 18 nt, Artificial Sequence
  Description of Artificial Sequence: Synthetic oligonucleotide
gaagcuguccuucucggg

SEQ ID NO: 3994 - RNA, 18 nt, Artificial Sequence
  Description of Artificial Sequence: Synthetic oligonucleotide
gcccugaagcuguccuuc

SEQ ID NO: 3995 - RNA, 18 nt, Artificial Sequence
  Description of Artificial Sequence: Synthetic oligonucleotide
uccgggcccugaagcugu

SEQ ID NO: 3996 - RNA, 18 nt, Artificial Sequence
  Description of Artificial Sequence: Synthetic oligonucleotide
aguacuccgggcccugaa

SEQ ID NO: 3997 - RNA, 18 nt, Artificial Sequence
  Description of Artificial Sequence: Synthetic oligonucleotide
agacuaguacuccgggcc

SEQ ID NO: 3998 - RNA, 18 nt, Artificial Sequence
  Description of Artificial Sequence: Synthetic oligonucleotide
cguugagacuaguacucc

SEQ ID NO: 3999 - RNA, 18 nt, Artificial Sequence
  Description of Artificial Sequence: Synthetic oligonucleotide
ucucucguugagacuagu

SEQ ID NO: 4000 - RNA, 18 nt, Artificial Sequence
  Description of Artificial Sequence: Synthetic oligonucleotide
uugggucucucguugaga

SEQ ID NO: 4001 - RNA, 18 nt, Artificial Sequence
  Description of Artificial Sequence: Synthetic oligonucleotide
aggcacacccccgcaggc

SEQ ID NO: 4002 - RNA, 18 nt, Artificial Sequence
  Description of Artificial Sequence: Synthetic oligonucleotide
acuccaggcacacccccg

SEQ ID NO: 4003 - RNA, 18 nt, Artificial Sequence
  Description of Artificial Sequence: Synthetic oligonucleotide
caccgacuccaggcacac

SEQ ID NO: 4004 - RNA, 18 nt, Artificial Sequence
  Description of Artificial Sequence: Synthetic oligonucleotide
ccccacaccgacuccagg

SEQ ID NO: 4005 - RNA, 18 nt, Artificial Sequence
  Description of Artificial Sequence: Synthetic oligonucleotide
ccccaccccacaccgacu

SEQ ID NO: 4006 - RNA, 18 nt, Artificial Sequence
  Description of Artificial Sequence: Synthetic oligonucleotide
uccuuccccaccccacac

SEQ ID NO: 4007 - RNA, 18 nt, Artificial Sequence
  Description of Artificial Sequence: Synthetic oligonucleotide
ccauguccuuccccaccc

SEQ ID NO: 4008 - RNA, 18 nt, Artificial Sequence
  Description of Artificial Sequence: Synthetic oligonucleotide
cagccccauguccuuccc

SEQ ID NO: 4009 - RNA, 18 nt, Artificial Sequence
  Description of Artificial Sequence: Synthetic oligonucleotide
ggccacagccccaugucc

SEQ ID NO: 4010 - RNA, 18 nt, Artificial Sequence
  Description of Artificial Sequence: Synthetic oligonucleotide
aggcaggccacagcccca

SEQ ID NO: 4011 - RNA, 18 nt, Artificial Sequence
  Description of Artificial Sequence: Synthetic oligonucleotide
ccgucaggcaggccacag

SEQ ID NO: 4012 - RNA, 18 nt, Artificial Sequence
  Description of Artificial Sequence: Synthetic oligonucleotide
aggcaccgucaggcaggc

SEQ ID NO: 4013 - RNA, 18 nt, Artificial Sequence
  Description of Artificial Sequence: Synthetic oligonucleotide
cuuggaggcaccgucagg

SEQ ID NO: 4014 - RNA, 18 nt, Artificial Sequence
  Description of Artificial Sequence: Synthetic oligonucleotide
acugacuuggaggcaccg

SEQ ID NO: 4015 - RNA, 18 nt, Artificial Sequence
  Description of Artificial Sequence: Synthetic oligonucleotide
cacucacugacuuggagg

SEQ ID NO: 4016 - RNA, 18 nt, Artificial Sequence
  Description of Artificial Sequence: Synthetic oligonucleotide
auuuccacucacugacuu

SEQ ID NO: 4017 - RNA, 18 nt, Artificial Sequence
  Description of Artificial Sequence: Synthetic oligonucleotide
gacccauuuccacucacu

SEQ ID NO: 4018 - RNA, 18 nt, Artificial Sequence
  Description of Artificial Sequence: Synthetic oligonucleotide
cacaggacccauuuccac

SEQ ID NO: 4019 - RNA, 18 nt, Artificial Sequence
  Description of Artificial Sequence: Synthetic oligonucleotide
gggcacacaggacccauu

SEQ ID NO: 4020 - RNA, 18 nt, Artificial Sequence
  Description of Artificial Sequence: Synthetic oligonucleotide
cuccagggcacacaggac

SEQ ID NO: 4021 - RNA, 18 nt, Artificial Sequence
  Description of Artificial Sequence: Synthetic oligonucleotide
acauacuccagggcacac

SEQ ID NO: 4022 - RNA, 18 nt, Artificial Sequence
  Description of Artificial Sequence: Synthetic oligonucleotide
gccucacauacuccaggg

SEQ ID NO: 4023 - RNA, 18 nt, Artificial Sequence
  Description of Artificial Sequence: Synthetic oligonucleotide
gcccugccucacauacuc

SEQ ID NO: 4024 - RNA, 18 nt, Artificial Sequence
  Description of Artificial Sequence: Synthetic oligonucleotide
guccugcccugccucaca

SEQ ID NO: 4025 - RNA, 18 nt, Artificial Sequence
  Description of Artificial Sequence: Synthetic oligonucleotide
ugcagguccugcccugcc

SEQ ID NO: 4026 - RNA, 18 nt, Artificial Sequence
  Description of Artificial Sequence: Synthetic oligonucleotide
gcccuugcagguccugcc

SEQ ID NO: 4027 - RNA, 18 nt, Artificial Sequence
  Description of Artificial Sequence: Synthetic oligonucleotide
uagcggcccuugcagguc

SEQ ID NO: 4028 - RNA, 18 nt, Artificial Sequence
  Description of Artificial Sequence: Synthetic oligonucleotide
gguguuagcggcccuugc

SEQ ID NO: 4029 - RNA, 18 nt, Artificial Sequence
  Description of Artificial Sequence: Synthetic oligonucleotide
ggguguuagcggcccuug

SEQ ID NO: 4030 - RNA, 18 nt, Artificial Sequence
  Description of Artificial Sequence: Synthetic oligonucleotide
cggccaaccugcugaggg

SEQ ID NO: 4031 - RNA, 18 nt, Artificial Sequence
  Description of Artificial Sequence: Synthetic oligonucleotide
caccacggccaaccugcu

SEQ ID NO: 4032 - RNA, 18 nt, Artificial Sequence
  Description of Artificial Sequence: Synthetic oligonucleotide
caggccaccacggccaac

SEQ ID NO: 4033 - RNA, 18 nt, Artificial Sequence
  Description of Artificial Sequence: Synthetic oligonucleotide
ggacccaggccaccacgg

SEQ ID NO: 4034 - RNA, 18 nt, Artificial Sequence
  Description of Artificial Sequence: Synthetic oligonucleotide
agcccggacccaggccac

SEQ ID NO: 4035 - RNA, 18 nt, Artificial Sequence
  Description of Artificial Sequence: Synthetic oligonucleotide
cacgcagcccggacccag

SEQ ID NO: 4036 - RNA, 18 nt, Artificial Sequence
  Description of Artificial Sequence: Synthetic oligonucleotide
uggcacacgcagcccgga

SEQ ID NO: 4037 - RNA, 18 nt, Artificial Sequence
  Description of Artificial Sequence: Synthetic oligonucleotide
gcccguggcacacgcagc

SEQ ID NO: 4038 - RNA, 18 nt, Artificial Sequence
  Description of Artificial Sequence: Synthetic oligonucleotide
uaggugcccguggcacac

SEQ ID NO: 4039 - RNA, 18 nt, Artificial Sequence
  Description of Artificial Sequence: Synthetic oligonucleotide
acaaguaggugcccgugg

SEQ ID NO: 4040 - RNA, 18 nt, Artificial Sequence
  Description of Artificial Sequence: Synthetic oligonucleotide
auuccacaaguaggugcc

SEQ ID NO: 4041 - RNA, 18 nt, Artificial Sequence
  Description of Artificial Sequence: Synthetic oligonucleotide
ccccaauuccacaaguag

SEQ ID NO: 4042 - RNA, 18 nt, Artificial Sequence
  Description of Artificial Sequence: Synthetic oligonucleotide
ccaacccccaauuccaca

SEQ ID NO: 4043 - RNA, 18 nt, Artificial Sequence
  Description of Artificial Sequence: Synthetic oligonucleotide
gcaccccaacccccaauu

SEQ ID NO: 4044 - RNA, 18 nt, Artificial Sequence
  Description of Artificial Sequence: Synthetic oligonucleotide
agcuugcaccccaacccc

SEQ ID NO: 4045 - RNA, 18 nt, Artificial Sequence
  Description of Artificial Sequence: Synthetic oligonucleotide
ccuaaagcuugcacccca

SEQ ID NO: 4046 - RNA, 18 nt, Artificial Sequence
  Description of Artificial Sequence: Synthetic oligonucleotide
aggcgccuaaagcuugca

SEQ ID NO: 4047 - RNA, 18 nt, Artificial Sequence
  Description of Artificial Sequence: Synthetic oligonucleotide
ggcucaggcgccuaaagc

SEQ ID NO: 4048 - RNA, 18 nt, Artificial Sequence
  Description of Artificial Sequence: Synthetic oligonucleotide
gggcucaggcgccuaaag

SEQ ID NO: 4049 - RNA, 18 nt, Artificial Sequence
  Description of Artificial Sequence: Synthetic oligonucleotide
ggccggcuccuucgaggg

SEQ ID NO: 4050 - RNA, 18 nt, Artificial Sequence
  Description of Artificial Sequence: Synthetic oligonucleotide
gacaaggccggcuccuuc

SEQ ID NO: 4051 - RNA, 18 nt, Artificial Sequence
  Description of Artificial Sequence: Synthetic oligonucleotide
ccccagacaaggccggcu

SEQ ID NO: 4052 - RNA, 18 nt, Artificial Sequence
  Description of Artificial Sequence: Synthetic oligonucleotide
ggcagccccagacaaggc

SEQ ID NO: 4053 - RNA, 18 nt, Artificial Sequence
  Description of Artificial Sequence: Synthetic oligonucleotide
gggcagccccagacaagg

SEQ ID NO: 4054 - RNA, 18 nt, Artificial Sequence
  Description of Artificial Sequence: Synthetic oligonucleotide
ggcuagcagcaggcuggg

SEQ ID NO: 4055 - RNA, 18 nt, Artificial Sequence
  Description of Artificial Sequence: Synthetic oligonucleotide
uccccggcuagcagcagg

SEQ ID NO: 4056 - RNA, 18 nt, Artificial Sequence
  Description of Artificial Sequence: Synthetic oligonucleotide
cagaguccccggcuagca

SEQ ID NO: 4057 - RNA, 18 nt, Artificial Sequence
  Description of Artificial Sequence: Synthetic oligonucleotide
ugaagcagaguccccggc

SEQ ID NO: 4058 - RNA, 18 nt, Artificial Sequence
  Description of Artificial Sequence: Synthetic oligonucleotide
ggugaugaagcagagucc

SEQ ID NO: 4059 - RNA, 18 nt, Artificial Sequence
  Description of Artificial Sequence: Synthetic oligonucleotide
gcggcggugaugaagcag

SEQ ID NO: 4060 - RNA, 18 nt, Artificial Sequence
  Description of Artificial Sequence: Synthetic oligonucleotide
gcaaggcggcggugauga

SEQ ID NO: 4061 - RNA, 18 nt, Artificial Sequence
  Description of Artificial Sequence: Synthetic oligonucleotide
guccggcaaggcggcggu

SEQ ID NO: 4062 - RNA, 18 nt, Artificial Sequence
  Description of Artificial Sequence: Synthetic oligonucleotide
uugcgguccggcaaggcg

SEQ ID NO: 4063 - RNA, 18 nt, Artificial Sequence
  Description of Artificial Sequence: Synthetic oligonucleotide
gcucuuugcgguccggca

SEQ ID NO: 4064 - RNA, 18 nt, Artificial Sequence
  Description of Artificial Sequence: Synthetic oligonucleotide
gcucagcucuuugcgguc

SEQ ID NO: 4065 - RNA, 18 nt, Artificial Sequence
  Description of Artificial Sequence: Synthetic oligonucleotide
ggcuggcucagcucuuug

SEQ ID NO: 4066 - RNA, 18 nt, Artificial Sequence
  Description of Artificial Sequence: Synthetic oligonucleotide
acagaggcuggcucagcu

SEQ ID NO: 4067 - RNA, 18 nt, Artificial Sequence
  Description of Artificial Sequence: Synthetic oligonucleotide
agaacacagaggcuggcu

SEQ ID NO: 4068 - RNA, 18 nt, Artificial Sequence
  Description of Artificial Sequence: Synthetic oligonucleotide
aaacaagaacacagaggc

SEQ ID NO: 4069 - RNA, 18 nt, Artificial Sequence
  Description of Artificial Sequence: Synthetic oligonucleotide
aaugcaaacaagaacaca

SEQ ID NO: 4070 - RNA, 18 nt, Artificial Sequence
  Description of Artificial Sequence: Synthetic oligonucleotide
aaugaaaugcaaacaaga

SEQ ID NO: 4071 - RNA, 18 nt, Artificial Sequence
  Description of Artificial Sequence: Synthetic oligonucleotide
guucaaaugaaaugcaaa

SEQ ID NO: 4072 - RNA, 18 nt, Artificial Sequence
  Description of Artificial Sequence: Synthetic oligonucleotide
aagccguucaaaugaaau

SEQ ID NO: 4073 - RNA, 18 nt, Artificial Sequence
  Description of Artificial Sequence: Synthetic oligonucleotide
ggagaaagccguucaaau

SEQ ID NO: 4074 - RNA, 18 nt, Artificial Sequence
  Description of Artificial Sequence: Synthetic oligonucleotide
caggaggagaaagccguu

SEQ ID NO: 4075 - RNA, 18 nt, Artificial Sequence
  Description of Artificial Sequence: Synthetic oligonucleotide
gggacaggaggagaaagc

SEQ ID NO: 4076 - RNA, 18 nt, Artificial Sequence
  Description of Artificial Sequence: Synthetic oligonucleotide
cucgggcaggaagguggg

SEQ ID NO: 4077 - RNA, 18 nt, Artificial Sequence
  Description of Artificial Sequence: Synthetic oligonucleotide
aauagcucgggcaggaag

SEQ ID NO: 4078 - RNA, 18 nt, Artificial Sequence
  Description of Artificial Sequence: Synthetic oligonucleotide
gccaaaauagcucgggca

SEQ ID NO: 4079 - RNA, 18 nt, Artificial Sequence
  Description of Artificial Sequence: Synthetic oligonucleotide
ggaaagccaaaauagcuc

SEQ ID NO: 4080 - RNA, 18 nt, Artificial Sequence
  Description of Artificial Sequence: Synthetic oligonucleotide
ucuagggaaagccaaaau

SEQ ID NO: 4081 - RNA, 18 nt, Artificial Sequence
  Description of Artificial Sequence: Synthetic oligonucleotide
ucccaucuagggaaagcc

SEQ ID NO: 4082 - RNA, 18 nt, Artificial Sequence
  Description of Artificial Sequence: Synthetic oligonucleotide
cguauucccaucuaggga

SEQ ID NO: 4083 - RNA, 18 nt, Artificial Sequence
  Description of Artificial Sequence: Synthetic oligonucleotide
aaugccguauucccaucu

SEQ ID NO: 4084 - RNA, 18 nt, Artificial Sequence
  Description of Artificial Sequence: Synthetic oligonucleotide
uggaaaaugccguauucc

SEQ ID NO: 4085 - RNA, 18 nt, Artificial Sequence
  Description of Artificial Sequence: Synthetic oligonucleotide
cacgcuggaaaaugccgu

SEQ ID NO: 4086 - RNA, 18 nt, Artificial Sequence
  Description of Artificial Sequence: Synthetic oligonucleotide
gaggucacgcuggaaaau

SEQ ID NO: 4087 - RNA, 18 nt, Artificial Sequence
  Description of Artificial Sequence: Synthetic oligonucleotide
gaguugaggucacgcugg

SEQ ID NO: 4088 - RNA, 18 nt, Artificial Sequence
  Description of Artificial Sequence: Synthetic oligonucleotide
cuuccgaguugaggucac

SEQ ID NO: 4089 - RNA, 18 nt, Artificial Sequence
  Description of Artificial Sequence: Synthetic oligonucleotide
auacaaauuucauagccc

SEQ ID NO: 4090 - RNA, 18 nt, Artificial Sequence
  Description of Artificial Sequence: Synthetic oligonucleotide
uucugauacaaauuucau

SEQ ID NO: 4091 - RNA, 18 nt, Artificial Sequence
  Description of Artificial Sequence: Synthetic oligonucleotide
guucauucugauacaaau

SEQ ID NO: 4092 - RNA, 18 nt, Artificial Sequence
  Description of Artificial Sequence: Synthetic oligonucleotide
ugggaguucauucugaua

SEQ ID NO: 4093 - RNA, 18 nt, Artificial Sequence
  Description of Artificial Sequence: Synthetic oligonucleotide
gcuuaugggaguucauuc

SEQ ID NO: 4094 - RNA, 18 nt, Artificial Sequence
  Description of Artificial Sequence: Synthetic oligonucleotide
aagaggcuuaugggaguu

SEQ ID NO: 4095 - RNA, 18 nt, Artificial Sequence
  Description of Artificial Sequence: Synthetic oligonucleotide
cagggaagaggcuuaugg

SEQ ID NO: 4096 - RNA, 18 nt, Artificial Sequence
  Description of Artificial Sequence: Synthetic oligonucleotide
agugacagggaagaggcu

SEQ ID NO: 4097 - RNA, 18 nt, Artificial Sequence
  Description of Artificial Sequence: Synthetic oligonucleotide
cacccagugacagggaag

SEQ ID NO: 4098 - RNA, 18 nt, Artificial Sequence
  Description of Artificial Sequence: Synthetic oligonucleotide
cuccacacccagugacag

SEQ ID NO: 4099 - RNA, 18 nt, Artificial Sequence
  Description of Artificial Sequence: Synthetic oligonucleotide
cugagcuccacacccagu

SEQ ID NO: 4100 - RNA, 18 nt, Artificial Sequence
  Description of Artificial Sequence: Synthetic oligonucleotide
gcugccugagcuccacac

SEQ ID NO: 4101 - RNA, 18 nt, Artificial Sequence
  Description of Artificial Sequence: Synthetic oligonucleotide
gagcggcugccugagcuc

SEQ ID NO: 4102 - RNA, 18 nt, Artificial Sequence
  Description of Artificial Sequence: Synthetic oligonucleotide
caggcgagcggcugccug

SEQ ID NO: 4103 - RNA, 18 nt, Artificial Sequence
  Description of Artificial Sequence: Synthetic oligonucleotide
ucaggcaggcgagcggcu

SEQ ID NO: 4104 - RNA, 18 nt, Artificial Sequence
  Description of Artificial Sequence: Synthetic oligonucleotide
cacccucaggcaggcgag

SEQ ID NO: 4105 - RNA, 18 nt, Artificial Sequence
  Description of Artificial Sequence: Synthetic oligonucleotide
accgucacccucaggcag

SEQ ID NO: 4106 - RNA, 18 nt, Artificial Sequence
  Description of Artificial Sequence: Synthetic oligonucleotide
cuuccaccgucacccuca

SEQ ID NO: 4107 - RNA, 18 nt, Artificial Sequence
  Description of Artificial Sequence: Synthetic oligonucleotide
guggccuuccaccgucac

SEQ ID NO: 4108 - RNA, 18 nt, Artificial Sequence
  Description of Artificial Sequence: Synthetic oligonucleotide
cccauguggccuuccacc

SEQ ID NO: 4109 - RNA, 18 nt, Artificial Sequence
  Description of Artificial Sequence: Synthetic oligonucleotide
ggauccccauguggccuu

SEQ ID NO: 4110 - RNA, 18 nt, Artificial Sequence
  Description of Artificial Sequence: Synthetic oligonucleotide
gucugggauccccaugug

SEQ ID NO: 4111 - RNA, 18 nt, Artificial Sequence
  Description of Artificial Sequence: Synthetic oligonucleotide
cagaggucugggaucccc

SEQ ID NO: 4112 - RNA, 18 nt, Artificial Sequence
  Description of Artificial Sequence: Synthetic oligonucleotide
gcacacagaggucuggga

SEQ ID NO: 4113 - RNA, 18 nt, Artificial Sequence
  Description of Artificial Sequence: Synthetic oligonucleotide
ggcaagcacacagagguc

SEQ ID NO: 4114 - RNA, 18 nt, Artificial Sequence
  Description of Artificial Sequence: Synthetic oligonucleotide
ccuccggcaagcacacag

SEQ ID NO: 4115 - RNA, 18 nt, Artificial Sequence
  Description of Artificial Sequence: Synthetic oligonucleotide
ggcugccuccggcaagca

SEQ ID NO: 4116 - RNA, 18 nt, Artificial Sequence
  Description of Artificial Sequence: Synthetic oligonucleotide
ccgcaggcugccuccggc

SEQ ID NO: 4117 - RNA, 18 nt, Artificial Sequence
  Description of Artificial Sequence: Synthetic oligonucleotide
ucugcccgcaggcugccu

SEQ ID NO: 4118 - RNA, 18 nt, Artificial Sequence
  Description of Artificial Sequence: Synthetic oligonucleotide
ugcauucugcccgcaggc

SEQ ID NO: 4119 - RNA, 18 nt, Artificial Sequence
  Description of Artificial Sequence: Synthetic oligonucleotide
cagauugcauucugcccg

SEQ ID NO: 4120 - RNA, 18 nt, Artificial Sequence
  Description of Artificial Sequence: Synthetic oligonucleotide
aggcccagauugcauucu

SEQ ID NO: 4121 - RNA, 18 nt, Artificial Sequence
  Description of Artificial Sequence: Synthetic oligonucleotide
cagacaggcccagauugc

SEQ ID NO: 4122 - RNA, 18 nt, Artificial Sequence
  Description of Artificial Sequence: Synthetic oligonucleotide
ccacacagacaggcccag

SEQ ID NO: 4123 - RNA, 18 nt, Artificial Sequence
  Description of Artificial Sequence: Synthetic oligonucleotide
ggaggccacacagacagg

SEQ ID NO: 4124 - RNA, 18 nt, Artificial Sequence
  Description of Artificial Sequence: Synthetic oligonucleotide
gaggcggaggccacacag

SEQ ID NO: 4125 - RNA, 18 nt, Artificial Sequence
  Description of Artificial Sequence: Synthetic oligonucleotide
gcagagaggcggaggcca

SEQ ID NO: 4126 - RNA, 18 nt, Artificial Sequence
  Description of Artificial Sequence: Synthetic oligonucleotide
gucaugcagagaggcgga

SEQ ID NO: 4127 - RNA, 18 nt, Artificial Sequence
  Description of Artificial Sequence: Synthetic oligonucleotide
guguagucaugcagagag

SEQ ID NO: 4128 - RNA, 18 nt, Artificial Sequence
  Description of Artificial Sequence: Synthetic oligonucleotide
aaacgguguagucaugca

SEQ ID NO: 4129 - RNA, 18 nt, Artificial Sequence
  Description of Artificial Sequence: Synthetic oligonucleotide
uggcgaaacgguguaguc

SEQ ID NO: 4130 - RNA, 18 nt, Artificial Sequence
  Description of Artificial Sequence: Synthetic oligonucleotide
ccuccuggcgaaacggug

SEQ ID NO: 4131 - RNA, 18 nt, Artificial Sequence
  Description of Artificial Sequence: Synthetic oligonucleotide
uacggccuccuggcgaaa

SEQ ID NO: 4132 - RNA, 18 nt, Artificial Sequence
  Description of Artificial Sequence: Synthetic oligonucleotide
uagguuacggccuccugg

SEQ ID NO: 4133 - RNA, 18 nt, Artificial Sequence
  Description of Artificial Sequence: Synthetic oligonucleotide
agcacuagguuacggccu

SEQ ID NO: 4134 - RNA, 18 nt, Artificial Sequence
  Description of Artificial Sequence: Synthetic oligonucleotide
acgggagcacuagguuac

SEQ ID NO: 4135 - RNA, 18 nt, Artificial Sequence
  Description of Artificial Sequence: Synthetic oligonucleotide
agcccacgggagcacuag

SEQ ID NO: 4136 - RNA, 18 nt, Artificial Sequence
  Description of Artificial Sequence: Synthetic oligonucleotide
accgaagcccacgggagc

SEQ ID NO: 4137 - RNA, 18 nt, Artificial Sequence
  Description of Artificial Sequence: Synthetic oligonucleotide
cccucaccgaagcccacg

SEQ ID NO: 4138 - RNA, 18 nt, Artificial Sequence
  Description of Artificial Sequence: Synthetic oligonucleotide
caucccccucaccgaagc

SEQ ID NO: 4139 - RNA, 18 nt, Artificial Sequence
  Description of Artificial Sequence: Synthetic oligonucleotide
accgacaucccccucacc

SEQ ID NO: 4140 - RNA, 18 nt, Artificial Sequence
  Description of Artificial Sequence: Synthetic oligonucleotide
uagagaccgacauccccc

SEQ ID NO: 4141 - RNA, 18 nt, Artificial Sequence
  Description of Artificial Sequence: Synthetic oligonucleotide
gaggcuagagaccgacau

SEQ ID NO: 4142 - RNA, 18 nt, Artificial Sequence
  Description of Artificial Sequence: Synthetic oligonucleotide
cucaggaggcuagagacc

SEQ ID NO: 4143 - RNA, 18 nt, Artificial Sequence
  Description of Artificial Sequence: Synthetic oligonucleotide
gcagacucaggaggcuag

SEQ ID NO: 4144 - RNA, 18 nt, Artificial Sequence
  Description of Artificial Sequence: Synthetic oligonucleotide
ucggagcagacucaggag

SEQ ID NO: 4145 - RNA, 18 nt, Artificial Sequence
  Description of Artificial Sequence: Synthetic oligonucleotide
acuggucggagcagacuc

SEQ ID NO: 4146 - RNA, 18 nt, Artificial Sequence
  Description of Artificial Sequence: Synthetic oligonucleotide
ggccuacuggucggagca

SEQ ID NO: 4147 - RNA, 18 nt, Artificial Sequence
  Description of Artificial Sequence: Synthetic oligonucleotide
gaccaggccuacuggucg

SEQ ID NO: 4148 - RNA, 18 nt, Artificial Sequence
  Description of Artificial Sequence: Synthetic oligonucleotide
gggaagaccaggccuacu

SEQ ID NO: 4149 - RNA, 18 nt, Artificial Sequence
  Description of Artificial Sequence: Synthetic oligonucleotide
auugucccagagaacggg

SEQ ID NO: 4150 - RNA, 18 nt, Artificial Sequence
  Description of Artificial Sequence: Synthetic oligonucleotide
acauugucccagagaacg

SEQ ID NO: 4151 - RNA, 18 nt, Artificial Sequence
  Description of Artificial Sequence: Synthetic oligonucleotide
ggaccacauugucccaga

SEQ ID NO: 4152 - RNA, 18 nt, Artificial Sequence
  Description of Artificial Sequence: Synthetic oligonucleotide
cacguggaccacauuguc

SEQ ID NO: 4153 - RNA, 18 nt, Artificial Sequence
  Description of Artificial Sequence: Synthetic oligonucleotide
agaaucacguggaccaca

SEQ ID NO: 4154 - RNA, 18 nt, Artificial Sequence
  Description of Artificial Sequence: Synthetic oligonucleotide
gcuugagaaucacgugga

SEQ ID NO: 4155 - RNA, 18 nt, Artificial Sequence
  Description of Artificial Sequence: Synthetic oligonucleotide
ccucagcuugagaaucac

SEQ ID NO: 4156 - RNA, 18 nt, Artificial Sequence
  Description of Artificial Sequence: Synthetic oligonucleotide
gcgagccucagcuugaga

SEQ ID NO: 4157 - RNA, 18 nt, Artificial Sequence
  Description of Artificial Sequence: Synthetic oligonucleotide
gcccagcgagccucagcu

SEQ ID NO: 4158 - RNA, 18 nt, Artificial Sequence
  Description of Artificial Sequence: Synthetic oligonucleotide
gggcggcccagcgagccu

SEQ ID NO: 4159 - RNA, 18 nt, Artificial Sequence
  Description of Artificial Sequence: Synthetic oligonucleotide
ggcgugggcggcccagcg

SEQ ID NO: 4160 - RNA, 18 nt, Artificial Sequence
  Description of Artificial Sequence: Synthetic oligonucleotide
aacagggcgugggcggcc

SEQ ID NO: 4161 - RNA, 18 nt, Artificial Sequence
  Description of Artificial Sequence: Synthetic oligonucleotide
accccaacagggcguggg

SEQ ID NO: 4162 - RNA, 18 nt, Artificial Sequence
  Description of Artificial Sequence: Synthetic oligonucleotide
gaaagaccccaacagggc

SEQ ID NO: 4163 - RNA, 18 nt, Artificial Sequence
  Description of Artificial Sequence: Synthetic oligonucleotide
gcucggaaagaccccaac

SEQ ID NO: 4164 - RNA, 18 nt, Artificial Sequence
  Description of Artificial Sequence: Synthetic oligonucleotide
accucgcucggaaagacc

SEQ ID NO: 4165 - RNA, 18 nt, Artificial Sequence
  Description of Artificial Sequence: Synthetic oligonucleotide
ugaggaccucgcucggaa

SEQ ID NO: 4166 - RNA, 18 nt, Artificial Sequence
  Description of Artificial Sequence: Synthetic oligonucleotide
acggcugaggaccucgcu

SEQ ID NO: 4167 - RNA, 18 nt, Artificial Sequence
  Description of Artificial Sequence: Synthetic oligonucleotide
caugcacggcugaggacc

SEQ ID NO: 4168 - RNA, 18 nt, Artificial Sequence
  Description of Artificial Sequence: Synthetic oligonucleotide
caacgcaugcacggcuga

SEQ ID NO: 4169 - RNA, 18 nt, Artificial Sequence
  Description of Artificial Sequence: Synthetic oligonucleotide
aagcucaacgcaugcacg

SEQ ID NO: 4170 - RNA, 18 nt, Artificial Sequence
  Description of Artificial Sequence: Synthetic oligonucleotide
ggccaaagcucaacgcau

SEQ ID NO: 4171 - RNA, 18 nt, Artificial Sequence
  Description of Artificial Sequence: Synthetic oligonucleotide
ccaagggccaaagcucaa

SEQ ID NO: 4172 - RNA, 18 nt, Artificial Sequence
  Description of Artificial Sequence: Synthetic oligonucleotide
uaucaccaagggccaaag

SEQ ID NO: 4173 - RNA, 18 nt, Artificial Sequence
  Description of Artificial Sequence: Synthetic oligonucleotide
ccaccuaucaccaagggc

SEQ ID NO: 4174 - RNA, 18 nt, Artificial Sequence
  Description of Artificial Sequence: Synthetic oligonucleotide
ccgagccaccuaucacca

SEQ ID NO: 4175 - RNA, 18 nt, Artificial Sequence
  Description of Artificial Sequence: Synthetic oligonucleotide
gcgggccgagccaccuau

SEQ ID NO: 4176 - RNA, 18 nt, Artificial Sequence
  Description of Artificial Sequence: Synthetic oligonucleotide
guagggcgggccgagcca

SEQ ID NO: 4177 - RNA, 18 nt, Artificial Sequence
  Description of Artificial Sequence: Synthetic oligonucleotide
gccagguagggcgggccg

SEQ ID NO: 4178 - RNA, 18 nt, Artificial Sequence
  Description of Artificial Sequence: Synthetic oligonucleotide
agggugccagguagggcg

SEQ ID NO: 4179 - RNA, 18 nt, Artificial Sequence
  Description of Artificial Sequence: Synthetic oligonucleotide
gggucagggugccaggua

SEQ ID NO: 4180 - RNA, 18 nt, Artificial Sequence
  Description of Artificial Sequence: Synthetic oligonucleotide
gaccagggucagggugcc

SEQ ID NO: 4181 - RNA, 18 nt, Artificial Sequence
  Description of Artificial Sequence: Synthetic oligonucleotide
gccgugaccagggucagg

SEQ ID NO: 4182 - RNA, 18 nt, Artificial Sequence
  Description of Artificial Sequence: Synthetic oligonucleotide
ggugagggacgucuguau

SEQ ID NO: 4183 - RNA, 18 nt, Artificial Sequence
  Description of Artificial Sequence: Synthetic oligonucleotide
gcacuggugagggacguc

SEQ ID NO: 4184 - RNA, 18 nt, Artificial Sequence
  Description of Artificial Sequence: Synthetic oligonucleotide
agcuggcacuggugaggg

SEQ ID NO: 4185 - RNA, 18 nt, Artificial Sequence
  Description of Artificial Sequence: Synthetic oligonucleotide
ccccaagcuggcacuggu

SEQ ID NO: 4186 - RNA, 18 nt, Artificial Sequence
  Description of Artificial Sequence: Synthetic oligonucleotide
gcagaccccaagcuggca

SEQ ID NO: 4187 - RNA, 18 nt, Artificial Sequence
  Description of Artificial Sequence: Synthetic oligonucleotide
caucugcagaccccaagc

SEQ ID NO: 4188 - RNA, 18 nt, Artificial Sequence
  Description of Artificial Sequence: Synthetic oligonucleotide
guucucaucugcagaccc

SEQ ID NO: 4189 - RNA, 18 nt, Artificial Sequence
  Description of Artificial Sequence: Synthetic oligonucleotide
acggaguucucaucugca

SEQ ID NO: 4190 - RNA, 18 nt, Artificial Sequence
  Description of Artificial Sequence: Synthetic oligonucleotide
gggccacggaguucucau

SEQ ID NO: 4191 - RNA, 18 nt, Artificial Sequence
  Description of Artificial Sequence: Synthetic oligonucleotide
agccugggccacggaguu

SEQ ID NO: 4192 - RNA, 18 nt, Artificial Sequence
  Description of Artificial Sequence: Synthetic oligonucleotide
ucgucagccugggccacg

SEQ ID NO: 4193 - RNA, 18 nt, Artificial Sequence
  Description of Artificial Sequence: Synthetic oligonucleotide
ggcuaucgucagccuggg

SEQ ID NO: 4194 - RNA, 18 nt, Artificial Sequence
  Description of Artificial Sequence: Synthetic oligonucleotide
uuucaggcuaucgucagc

SEQ ID NO: 4195 - RNA, 18 nt, Artificial Sequence
  Description of Artificial Sequence: Synthetic oligonucleotide
agguuuuucaggcuaucg

SEQ ID NO: 4196 - RNA, 18 nt, Artificial Sequence
  Description of Artificial Sequence: Synthetic oligonucleotide
gguggagguuuuucaggc

SEQ ID NO: 4197 - RNA, 18 nt, Artificial Sequence
  Description of Artificial Sequence: Synthetic oligonucleotide
cuccagguggagguuuuu

SEQ ID NO: 4198 - RNA, 18 nt, Artificial Sequence
  Description of Artificial Sequence: Synthetic oligonucleotide
gugagcuccagguggagg

SEQ ID NO: 4199 - RNA, 18 nt, Artificial Sequence
  Description of Artificial Sequence: Synthetic oligonucleotide
uuuccgugagcuccaggu

SEQ ID NO: 4200 - RNA, 18 nt, Artificial Sequence
  Description of Artificial Sequence: Synthetic oligonucleotide
acagguuuccgugagcuc

SEQ ID NO: 4201 - RNA, 18 nt, Artificial Sequence
  Description of Artificial Sequence: Synthetic oligonucleotide
uccagacagguuuccgug

SEQ ID NO: 4202 - RNA, 18 nt, Artificial Sequence
  Description of Artificial Sequence: Synthetic oligonucleotide
ucauguccagacagguuu

SEQ ID NO: 4203 - RNA, 18 nt, Artificial Sequence
  Description of Artificial Sequence: Synthetic oligonucleotide
agccaucauguccagaca

SEQ ID NO: 4204 - RNA, 18 nt, Artificial Sequence
  Description of Artificial Sequence: Synthetic oligonucleotide
uaucgagccaucaugucc

SEQ ID NO: 4205 - RNA, 18 nt, Artificial Sequence
  Description of Artificial Sequence: Synthetic oligonucleotide
agacguaucgagccauca

SEQ ID NO: 4206 - RNA, 18 nt, Artificial Sequence
  Description of Artificial Sequence: Synthetic oligonucleotide
ggagaagacguaucgagc

SEQ ID NO: 4207 - RNA, 18 nt, Artificial Sequence
  Description of Artificial Sequence: Synthetic oligonucleotide
aaguuggagaagacguau

SEQ ID NO: 4208 - RNA, 18 nt, Artificial Sequence
  Description of Artificial Sequence: Synthetic oligonucleotide
ccgugaaguuggagaaga

SEQ ID NO: 4209 - RNA, 18 nt, Artificial Sequence
  Description of Artificial Sequence: Synthetic oligonucleotide
gacagccgugaaguugga

SEQ ID NO: 4210 - RNA, 18 nt, Artificial Sequence
  Description of Artificial Sequence: Synthetic oligonucleotide
uucgggacagccgugaag

SEQ ID NO: 4211 - RNA, 18 nt, Artificial Sequence
  Description of Artificial Sequence: Synthetic oligonucleotide
agaggacauuggaccgca

SEQ ID NO: 4212 - RNA, 18 nt, Artificial Sequence
  Description of Artificial Sequence: Synthetic oligonucleotide
agacaagaggacauugga

SEQ ID NO: 4213 - RNA, 18 nt, Artificial Sequence
  Description of Artificial Sequence: Synthetic oligonucleotide
ucaaaagacaagaggaca

SEQ ID NO: 4214 - RNA, 18 nt, Artificial Sequence
  Description of Artificial Sequence: Synthetic oligonucleotide
ugucaucaaaagacaaga

SEQ ID NO: 4215 - RNA, 18 nt, Artificial Sequence
  Description of Artificial Sequence: Synthetic oligonucleotide
gaagcuguccuucucggg

SEQ ID NO: 4216 - RNA, 18 nt, Artificial Sequence
  Description of Artificial Sequence: Synthetic oligonucleotide
gcccugaagcuguccuuc

SEQ ID NO: 4217 - RNA, 18 nt, Artificial Sequence
  Description of Artificial Sequence: Synthetic oligonucleotide
uccgggcccugaagcugu

SEQ ID NO: 4218 - RNA, 18 nt, Artificial Sequence
  Description of Artificial Sequence: Synthetic oligonucleotide
aguacuccgggcccugaa

SEQ ID NO: 4219 - RNA, 18 nt, Artificial Sequence
  Description of Artificial Sequence: Synthetic oligonucleotide
agacuaguacuccgggcc

SEQ ID NO: 4220 - RNA, 18 nt, Artificial Sequence
  Description of Artificial Sequence: Synthetic oligonucleotide
cguugagacuaguacucc

SEQ ID NO: 4221 - RNA, 18 nt, Artificial Sequence
  Description of Artificial Sequence: Synthetic oligonucleotide
ucucucguugagacuagu

SEQ ID NO: 4222 - RNA, 18 nt, Artificial Sequence
  Description of Artificial Sequence: Synthetic oligonucleotide
uugggucucucguugaga

SEQ ID NO: 4223 - RNA, 18 nt, Artificial Sequence
  Description of Artificial Sequence: Synthetic oligonucleotide
aggcacacccccgcaggc

SEQ ID NO: 4224 - RNA, 18 nt, Artificial Sequence
  Description of Artificial Sequence: Synthetic oligonucleotide
acuccaggcacacccccg

SEQ ID NO: 4225 - RNA, 18 nt, Artificial Sequence
  Description of Artificial Sequence: Synthetic oligonucleotide
caccgacuccaggcacac

SEQ ID NO: 4226 - RNA, 18 nt, Artificial Sequence
  Description of Artificial Sequence: Synthetic oligonucleotide
ccccacaccgacuccagg

SEQ ID NO: 4227 - RNA, 18 nt, Artificial Sequence
  Description of Artificial Sequence: Synthetic oligonucleotide
ccccaccccacaccgacu

SEQ ID NO: 4228 - RNA, 18 nt, Artificial Sequence
  Description of Artificial Sequence: Synthetic oligonucleotide
uccuuccccaccccacac

SEQ ID NO: 4229 - RNA, 18 nt, Artificial Sequence
  Description of Artificial Sequence: Synthetic oligonucleotide
ccauguccuuccccaccc

SEQ ID NO: 4230 - RNA, 18 nt, Artificial Sequence
  Description of Artificial Sequence: Synthetic oligonucleotide
cagccccauguccuuccc

SEQ ID NO: 4231 - RNA, 18 nt, Artificial Sequence
  Description of Artificial Sequence: Synthetic oligonucleotide
ggccacagccccaugucc

SEQ ID NO: 4232 - RNA, 18 nt, Artificial Sequence
  Description of Artificial Sequence: Synthetic oligonucleotide
aggcaggccacagcccca

SEQ ID NO: 4233 - RNA, 18 nt, Artificial Sequence
  Description of Artificial Sequence: Synthetic oligonucleotide
ccgucaggcaggccacag

SEQ ID NO: 4234 - RNA, 18 nt, Artificial Sequence
  Description of Artificial Sequence: Synthetic oligonucleotide
aggcaccgucaggcaggc

SEQ ID NO: 4235 - RNA, 18 nt, Artificial Sequence
  Description of Artificial Sequence: Synthetic oligonucleotide
cuuggaggcaccgucagg

SEQ ID NO: 4236 - RNA, 18 nt, Artificial Sequence
  Description of Artificial Sequence: Synthetic oligonucleotide
acugacuuggaggcaccg

SEQ ID NO: 4237 - RNA, 18 nt, Artificial Sequence
  Description of Artificial Sequence: Synthetic oligonucleotide
cacucacugacuuggagg

SEQ ID NO: 4238 - RNA, 18 nt, Artificial Sequence
  Description of Artificial Sequence: Synthetic oligonucleotide
auuuccacucacugacuu

SEQ ID NO: 4239 - RNA, 18 nt, Artificial Sequence
  Description of Artificial Sequence: Synthetic oligonucleotide
gacccauuuccacucacu

SEQ ID NO: 4240 - RNA, 18 nt, Artificial Sequence
  Description of Artificial Sequence: Synthetic oligonucleotide
cacaggacccauuuccac

SEQ ID NO: 4241 - RNA, 18 nt, Artificial Sequence
  Description of Artificial Sequence: Synthetic oligonucleotide
gggcacacaggacccauu

SEQ ID NO: 4242 - RNA, 18 nt, Artificial Sequence
  Description of Artificial Sequence: Synthetic oligonucleotide
cuccagggcacacaggac

SEQ ID NO: 4243 - RNA, 18 nt, Artificial Sequence
  Description of Artificial Sequence: Synthetic oligonucleotide
acauacuccagggcacac

SEQ ID NO: 4244 - RNA, 18 nt, Artificial Sequence
  Description of Artificial Sequence: Synthetic oligonucleotide
gccucacauacuccaggg

SEQ ID NO: 4245 - RNA, 18 nt, Artificial Sequence
  Description of Artificial Sequence: Synthetic oligonucleotide
gcccugccucacauacuc

SEQ ID NO: 4246 - RNA, 18 nt, Artificial Sequence
  Description of Artificial Sequence: Synthetic oligonucleotide
guccugcccugccucaca

SEQ ID NO: 4247 - RNA, 18 nt, Artificial Sequence
  Description of Artificial Sequence: Synthetic oligonucleotide
ugcagguccugcccugcc

SEQ ID NO: 4248 - RNA, 18 nt, Artificial Sequence
  Description of Artificial Sequence: Synthetic oligonucleotide
gcccuugcagguccugcc

SEQ ID NO: 4249 - RNA, 18 nt, Artificial Sequence
  Description of Artificial Sequence: Synthetic oligonucleotide
uagcggcccuugcagguc

SEQ ID NO: 4250 - RNA, 18 nt, Artificial Sequence
  Description of Artificial Sequence: Synthetic oligonucleotide
gguguuagcggcccuugc

SEQ ID NO: 4251 - RNA, 18 nt, Artificial Sequence
  Description of Artificial Sequence: Synthetic oligonucleotide
ggguguuagcggcccuug

SEQ ID NO: 4252 - RNA, 18 nt, Artificial Sequence
  Description of Artificial Sequence: Synthetic oligonucleotide
cggccaaccugcugaggg

SEQ ID NO: 4253 - RNA, 18 nt, Artificial Sequence
  Description of Artificial Sequence: Synthetic oligonucleotide
caccacggccaaccugcu

SEQ ID NO: 4254 - RNA, 18 nt, Artificial Sequence
  Description of Artificial Sequence: Synthetic oligonucleotide
caggccaccacggccaac

SEQ ID NO: 4255 - RNA, 18 nt, Artificial Sequence
  Description of Artificial Sequence: Synthetic oligonucleotide
ggacccaggccaccacgg

SEQ ID NO: 4256 - RNA, 18 nt, Artificial Sequence
  Description of Artificial Sequence: Synthetic oligonucleotide
agcccggacccaggccac

SEQ ID NO: 4257 - RNA, 18 nt, Artificial Sequence
  Description of Artificial Sequence: Synthetic oligonucleotide
cacgcagcccggacccag

SEQ ID NO: 4258 - RNA, 18 nt, Artificial Sequence
  Description of Artificial Sequence: Synthetic oligonucleotide
uggcacacgcagcccgga

SEQ ID NO: 4259 - RNA, 18 nt, Artificial Sequence
  Description of Artificial Sequence: Synthetic oligonucleotide
gcccguggcacacgcagc

SEQ ID NO: 4260 - RNA, 18 nt, Artificial Sequence
  Description of Artificial Sequence: Synthetic oligonucleotide
uaggugcccguggcacac

SEQ ID NO: 4261 - RNA, 18 nt, Artificial Sequence
  Description of Artificial Sequence: Synthetic oligonucleotide
acaaguaggugcccgugg

SEQ ID NO: 4262 - RNA, 18 nt, Artificial Sequence
  Description of Artificial Sequence: Synthetic oligonucleotide
auuccacaaguaggugcc

SEQ ID NO: 4263 - RNA, 18 nt, Artificial Sequence
  Description of Artificial Sequence: Synthetic oligonucleotide
ccccaauuccacaaguag

SEQ ID NO: 4264 - RNA, 18 nt, Artificial Sequence
  Description of Artificial Sequence: Synthetic oligonucleotide
ccaacccccaauuccaca

SEQ ID NO: 4265 - RNA, 18 nt, Artificial Sequence
  Description of Artificial Sequence: Synthetic oligonucleotide
gcaccccaacccccaauu

SEQ ID NO: 4266 - RNA, 18 nt, Artificial Sequence
  Description of Artificial Sequence: Synthetic oligonucleotide
agcuugcaccccaacccc

SEQ ID NO: 4267 - RNA, 18 nt, Artificial Sequence
  Description of Artificial Sequence: Synthetic oligonucleotide
ccuaaagcuugcacccca

SEQ ID NO: 4268 - RNA, 18 nt, Artificial Sequence
  Description of Artificial Sequence: Synthetic oligonucleotide
aggcgccuaaagcuugca

SEQ ID NO: 4269 - RNA, 18 nt, Artificial Sequence
  Description of Artificial Sequence: Synthetic oligonucleotide
ggcucaggcgccuaaagc

SEQ ID NO: 4270 - RNA, 18 nt, Artificial Sequence
  Description of Artificial Sequence: Synthetic oligonucleotide
gggcucaggcgccuaaag

SEQ ID NO: 4271 - RNA, 18 nt, Artificial Sequence
  Description of Artificial Sequence: Synthetic oligonucleotide
ggccggcuccuucgaggg

SEQ ID NO: 4272 - RNA, 18 nt, Artificial Sequence
  Description of Artificial Sequence: Synthetic oligonucleotide
gacaaggccggcuccuuc

SEQ ID NO: 4273 - RNA, 18 nt, Artificial Sequence
  Description of Artificial Sequence: Synthetic oligonucleotide
ccccagacaaggccggcu

SEQ ID NO: 4274 - RNA, 18 nt, Artificial Sequence
  Description of Artificial Sequence: Synthetic oligonucleotide
ggcagccccagacaaggc

SEQ ID NO: 4275 - RNA, 18 nt, Artificial Sequence
  Description of Artificial Sequence: Synthetic oligonucleotide
gggcagccccagacaagg

SEQ ID NO: 4276 - RNA, 18 nt, Artificial Sequence
  Description of Artificial Sequence: Synthetic oligonucleotide
ggcuagcagcaggcuggg

SEQ ID NO: 4277 - RNA, 18 nt, Artificial Sequence
  Description of Artificial Sequence: Synthetic oligonucleotide
uccccggcuagcagcagg

SEQ ID NO: 4278 - RNA, 18 nt, Artificial Sequence
  Description of Artificial Sequence: Synthetic oligonucleotide
cagaguccccggcuagca

SEQ ID NO: 4279 - RNA, 18 nt, Artificial Sequence
  Description of Artificial Sequence: Synthetic oligonucleotide
ugaagcagaguccccggc

SEQ ID NO: 4280 - RNA, 18 nt, Artificial Sequence
  Description of Artificial Sequence: Synthetic oligonucleotide
ggugaugaagcagagucc

SEQ ID NO: 4281 - RNA, 18 nt, Artificial Sequence
  Description of Artificial Sequence: Synthetic oligonucleotide
gcggcggugaugaagcag

SEQ ID NO: 4282 - RNA, 18 nt, Artificial Sequence
  Description of Artificial Sequence: Synthetic oligonucleotide
gcaaggcggcggugauga

SEQ ID NO: 4283 - RNA, 18 nt, Artificial Sequence
  Description of Artificial Sequence: Synthetic oligonucleotide
guccggcaaggcggcggu

SEQ ID NO: 4284 - RNA, 18 nt, Artificial Sequence
  Description of Artificial Sequence: Synthetic oligonucleotide
uugcgguccggcaaggcg

SEQ ID NO: 4285 - RNA, 18 nt, Artificial Sequence
  Description of Artificial Sequence: Synthetic oligonucleotide
gcucuuugcgguccggca

SEQ ID NO: 4286 - RNA, 18 nt, Artificial Sequence
  Description of Artificial Sequence: Synthetic oligonucleotide
gcucagcucuuugcgguc

SEQ ID NO: 4287 - RNA, 18 nt, Artificial Sequence
  Description of Artificial Sequence: Synthetic oligonucleotide
ggcuggcucagcucuuug

SEQ ID NO: 4288 - RNA, 18 nt, Artificial Sequence
  Description of Artificial Sequence: Synthetic oligonucleotide
acagaggcuggcucagcu

SEQ ID NO: 4289 - RNA, 18 nt, Artificial Sequence
  Description of Artificial Sequence: Synthetic oligonucleotide
agaacacagaggcuggcu

SEQ ID NO: 4290 - RNA, 18 nt, Artificial Sequence
  Description of Artificial Sequence: Synthetic oligonucleotide
aaacaagaacacagaggc

SEQ ID NO: 4291 - RNA, 18 nt, Artificial Sequence
  Description of Artificial Sequence: Synthetic oligonucleotide
aaugcaaacaagaacaca

SEQ ID NO: 4292 - RNA, 18 nt, Artificial Sequence
  Description of Artificial Sequence: Synthetic oligonucleotide
aaugaaaugcaaacaaga

SEQ ID NO: 4293 - RNA, 18 nt, Artificial Sequence
  Description of Artificial Sequence: Synthetic oligonucleotide
guucaaaugaaaugcaaa

SEQ ID NO: 4294 - RNA, 18 nt, Artificial Sequence
  Description of Artificial Sequence: Synthetic oligonucleotide
aagccguucaaaugaaau

SEQ ID NO: 4295 - RNA, 18 nt, Artificial Sequence
  Description of Artificial Sequence: Synthetic oligonucleotide
ggagaaagccguucaaau

SEQ ID NO: 4296 - RNA, 18 nt, Artificial Sequence
  Description of Artificial Sequence: Synthetic oligonucleotide
caggaggagaaagccguu

SEQ ID NO: 4297 - RNA, 18 nt, Artificial Sequence
  Description of Artificial Sequence: Synthetic oligonucleotide
gggacaggaggagaaagc

SEQ ID NO: 4298 - RNA, 18 nt, Artificial Sequence
  Description of Artificial Sequence: Synthetic oligonucleotide
cucgggcaggaagguggg

SEQ ID NO: 4299 - RNA, 18 nt, Artificial Sequence
  Description of Artificial Sequence: Synthetic oligonucleotide
aauagcucgggcaggaag

SEQ ID NO: 4300 - RNA, 18 nt, Artificial Sequence
  Description of Artificial Sequence: Synthetic oligonucleotide
gccaaaauagcucgggca

SEQ ID NO: 4301 - RNA, 18 nt, Artificial Sequence
  Description of Artificial Sequence: Synthetic oligonucleotide
ggaaagccaaaauagcuc

SEQ ID NO: 4302 - RNA, 18 nt, Artificial Sequence
  Description of Artificial Sequence: Synthetic oligonucleotide
ucuagggaaagccaaaau

SEQ ID NO: 4303 - RNA, 18 nt, Artificial Sequence
  Description of Artificial Sequence: Synthetic oligonucleotide
ucccaucuagggaaagcc

SEQ ID NO: 4304 - RNA, 18 nt, Artificial Sequence
  Description of Artificial Sequence: Synthetic oligonucleotide
cguauucccaucuaggga

SEQ ID NO: 4305 - RNA, 18 nt, Artificial Sequence
  Description of Artificial Sequence: Synthetic oligonucleotide
aaugccguauucccaucu

SEQ ID NO: 4306 - RNA, 18 nt, Artificial Sequence
  Description of Artificial Sequence: Synthetic oligonucleotide
uggaaaaugccguauucc

SEQ ID NO: 4307 - RNA, 18 nt, Artificial Sequence
  Description of Artificial Sequence: Synthetic oligonucleotide
cacgcuggaaaaugccgu

SEQ ID NO: 4308 - RNA, 18 nt, Artificial Sequence
  Description of Artificial Sequence: Synthetic oligonucleotide
gaggucacgcuggaaaau

SEQ ID NO: 4309 - RNA, 18 nt, Artificial Sequence
  Description of Artificial Sequence: Synthetic oligonucleotide
gaguugaggucacgcugg

SEQ ID NO: 4310 - RNA, 18 nt, Artificial Sequence
  Description of Artificial Sequence: Synthetic oligonucleotide
cuuccgaguugaggucac

SEQ ID NO: 4311 - RNA, 18 nt, Artificial Sequence
  Description of Artificial Sequence: Synthetic oligonucleotide
auacaaauuucauagccc

SEQ ID NO: 4312 - RNA, 18 nt, Artificial Sequence
  Description of Artificial Sequence: Synthetic oligonucleotide
uucugauacaaauuucau

SEQ ID NO: 4313 - RNA, 18 nt, Artificial Sequence
  Description of Artificial Sequence: Synthetic oligonucleotide
guucauucugauacaaau

SEQ ID NO: 4314 - RNA, 18 nt, Artificial Sequence
  Description of Artificial Sequence: Synthetic oligonucleotide
ugggaguucauucugaua

SEQ ID NO: 4315 - RNA, 18 nt, Artificial Sequence
  Description of Artificial Sequence: Synthetic oligonucleotide
gcuuaugggaguucauuc

SEQ ID NO: 4316 - RNA, 18 nt, Artificial Sequence
  Description of Artificial Sequence: Synthetic oligonucleotide
aagaggcuuaugggaguu

SEQ ID NO: 4317 - RNA, 18 nt, Artificial Sequence
  Description of Artificial Sequence: Synthetic oligonucleotide
cagggaagaggcuuaugg

SEQ ID NO: 4318 - RNA, 18 nt, Artificial Sequence
  Description of Artificial Sequence: Synthetic oligonucleotide
agugacagggaagaggcu

SEQ ID NO: 4319 - RNA, 18 nt, Artificial Sequence
  Description of Artificial Sequence: Synthetic oligonucleotide
cacccagugacagggaag

SEQ ID NO: 4320 - RNA, 18 nt, Artificial Sequence
  Description of Artificial Sequence: Synthetic oligonucleotide
cuccacacccagugacag

SEQ ID NO: 4321 - RNA, 18 nt, Artificial Sequence
  Description of Artificial Sequence: Synthetic oligonucleotide
cugagcuccacacccagu

SEQ ID NO: 4322 - RNA, 18 nt, Artificial Sequence
  Description of Artificial Sequence: Synthetic oligonucleotide
gcugccugagcuccacac

SEQ ID NO: 4323 - RNA, 18 nt, Artificial Sequence
  Description of Artificial Sequence: Synthetic oligonucleotide
gagcggcugccugagcuc

SEQ ID NO: 4324 - RNA, 18 nt, Artificial Sequence
  Description of Artificial Sequence: Synthetic oligonucleotide
caggcgagcggcugccug

SEQ ID NO: 4325 - RNA, 18 nt, Artificial Sequence
  Description of Artificial Sequence: Synthetic oligonucleotide
ucaggcaggcgagcggcu

SEQ ID NO: 4326 - RNA, 18 nt, Artificial Sequence
  Description of Artificial Sequence: Synthetic oligonucleotide
cacccucaggcaggcgag

SEQ ID NO: 4327 - RNA, 18 nt, Artificial Sequence
  Description of Artificial Sequence: Synthetic oligonucleotide
accgucacccucaggcag

SEQ ID NO: 4328 - RNA, 18 nt, Artificial Sequence
  Description of Artificial Sequence: Synthetic oligonucleotide
cuuccaccgucacccuca

SEQ ID NO: 4329 - RNA, 18 nt, Artificial Sequence
  Description of Artificial Sequence: Synthetic oligonucleotide
guggccuuccaccgucac

SEQ ID NO: 4330 - RNA, 18 nt, Artificial Sequence
  Description of Artificial Sequence: Synthetic oligonucleotide
cccauguggccuuccacc

SEQ ID NO: 4331 - RNA, 18 nt, Artificial Sequence
  Description of Artificial Sequence: Synthetic oligonucleotide
ggauccccauguggccuu

SEQ ID NO: 4332 - RNA, 18 nt, Artificial Sequence
  Description of Artificial Sequence: Synthetic oligonucleotide
gucugggauccccaugug

SEQ ID NO: 4333 - RNA, 18 nt, Artificial Sequence
  Description of Artificial Sequence: Synthetic oligonucleotide
cagaggucugggaucccc

SEQ ID NO: 4334 - RNA, 18 nt, Artificial Sequence
  Description of Artificial Sequence: Synthetic oligonucleotide
gcacacagaggucuggga

SEQ ID NO: 4335 - RNA, 18 nt, Artificial Sequence
  Description of Artificial Sequence: Synthetic oligonucleotide
ggcaagcacacagagguc

SEQ ID NO: 4336 - RNA, 18 nt, Artificial Sequence
  Description of Artificial Sequence: Synthetic oligonucleotide
ccuccggcaagcacacag

SEQ ID NO: 4337 - RNA, 18 nt, Artificial Sequence
  Description of Artificial Sequence: Synthetic oligonucleotide
ggcugccuccggcaagca

SEQ ID NO: 4338 - RNA, 18 nt, Artificial Sequence
  Description of Artificial Sequence: Synthetic oligonucleotide
ccgcaggcugccuccggc

SEQ ID NO: 4339 - RNA, 18 nt, Artificial Sequence
  Description of Artificial Sequence: Synthetic oligonucleotide
ucugcccgcaggcugccu

SEQ ID NO: 4340 - RNA, 18 nt, Artificial Sequence
  Description of Artificial Sequence: Synthetic oligonucleotide
ugcauucugcccgcaggc

SEQ ID NO: 4341 - RNA, 18 nt, Artificial Sequence
  Description of Artificial Sequence: Synthetic oligonucleotide
cagauugcauucugcccg

SEQ ID NO: 4342 - RNA, 18 nt, Artificial Sequence
  Description of Artificial Sequence: Synthetic oligonucleotide
aggcccagauugcauucu

SEQ ID NO: 4343 - RNA, 18 nt, Artificial Sequence
  Description of Artificial Sequence: Synthetic oligonucleotide
cagacaggcccagauugc

SEQ ID NO: 4344 - RNA, 18 nt, Artificial Sequence
  Description of Artificial Sequence: Synthetic oligonucleotide
ccacacagacaggcccag

SEQ ID NO: 4345 - RNA, 18 nt, Artificial Sequence
  Description of Artificial Sequence: Synthetic oligonucleotide
ggaggccacacagacagg

SEQ ID NO: 4346 - RNA, 18 nt, Artificial Sequence
  Description of Artificial Sequence: Synthetic oligonucleotide
gaggcggaggccacacag

SEQ ID NO: 4347 - RNA, 18 nt, Artificial Sequence
  Description of Artificial Sequence: Synthetic oligonucleotide
gcagagaggcggaggcca

SEQ ID NO: 4348 - RNA, 18 nt, Artificial Sequence
  Description of Artificial Sequence: Synthetic oligonucleotide
gucaugcagagaggcgga

SEQ ID NO: 4349 - RNA, 18 nt, Artificial Sequence
  Description of Artificial Sequence: Synthetic oligonucleotide
guguagucaugcagagag

SEQ ID NO: 4350 - RNA, 18 nt, Artificial Sequence
  Description of Artificial Sequence: Synthetic oligonucleotide
aaacgguguagucaugca

SEQ ID NO: 4351 - RNA, 18 nt, Artificial Sequence
  Description of Artificial Sequence: Synthetic oligonucleotide
uggcgaaacgguguaguc

SEQ ID NO: 4352 - RNA, 18 nt, Artificial Sequence
  Description of Artificial Sequence: Synthetic oligonucleotide
ccuccuggcgaaacggug

SEQ ID NO: 4353 - RNA, 18 nt, Artificial Sequence
  Description of Artificial Sequence: Synthetic oligonucleotide
uacggccuccuggcgaaa

SEQ ID NO: 4354 - RNA, 18 nt, Artificial Sequence
  Description of Artificial Sequence: Synthetic oligonucleotide
uagguuacggccuccugg

SEQ ID NO: 4355 - RNA, 18 nt, Artificial Sequence
  Description of Artificial Sequence: Synthetic oligonucleotide
agcacuagguuacggccu

SEQ ID NO: 4356 - RNA, 18 nt, Artificial Sequence
  Description of Artificial Sequence: Synthetic oligonucleotide
acgggagcacuagguuac

SEQ ID NO: 4357 - RNA, 18 nt, Artificial Sequence
  Description of Artificial Sequence: Synthetic oligonucleotide
agcccacgggagcacuag

SEQ ID NO: 4358 - RNA, 18 nt, Artificial Sequence
  Description of Artificial Sequence: Synthetic oligonucleotide
accgaagcccacgggagc

SEQ ID NO: 4359 - RNA, 18 nt, Artificial Sequence
  Description of Artificial Sequence: Synthetic oligonucleotide
cccucaccgaagcccacg

SEQ ID NO: 4360 - RNA, 18 nt, Artificial Sequence
  Description of Artificial Sequence: Synthetic oligonucleotide
caucccccucaccgaagc

SEQ ID NO: 4361 - RNA, 18 nt, Artificial Sequence
  Description of Artificial Sequence: Synthetic oligonucleotide
accgacaucccccucacc

SEQ ID NO: 4362 - RNA, 18 nt, Artificial Sequence
  Description of Artificial Sequence: Synthetic oligonucleotide
uagagaccgacauccccc

SEQ ID NO: 4363 - RNA, 18 nt, Artificial Sequence
  Description of Artificial Sequence: Synthetic oligonucleotide
gaggcuagagaccgacau

SEQ ID NO: 4364 - RNA, 18 nt, Artificial Sequence
  Description of Artificial Sequence: Synthetic oligonucleotide
cucaggaggcuagagacc

SEQ ID NO: 4365 - RNA, 18 nt, Artificial Sequence
  Description of Artificial Sequence: Synthetic oligonucleotide
gcagacucaggaggcuag

SEQ ID NO: 4366 - RNA, 18 nt, Artificial Sequence
  Description of Artificial Sequence: Synthetic oligonucleotide
ucggagcagacucaggag

SEQ ID NO: 4367 - RNA, 18 nt, Artificial Sequence
  Description of Artificial Sequence: Synthetic oligonucleotide
acuggucggagcagacuc

SEQ ID NO: 4368 - RNA, 18 nt, Artificial Sequence
  Description of Artificial Sequence: Synthetic oligonucleotide
ggccuacuggucggagca

SEQ ID NO: 4369 - RNA, 18 nt, Artificial Sequence
  Description of Artificial Sequence: Synthetic oligonucleotide
gaccaggccuacuggucg

SEQ ID NO: 4370 - RNA, 18 nt, Artificial Sequence
  Description of Artificial Sequence: Synthetic oligonucleotide
gggaagaccaggccuacu

SEQ ID NO: 4371 - RNA, 18 nt, Artificial Sequence
  Description of Artificial Sequence: Synthetic oligonucleotide
auugucccagagaacggg

SEQ ID NO: 4372 - RNA, 18 nt, Artificial Sequence
  Description of Artificial Sequence: Synthetic oligonucleotide
acauugucccagagaacg

SEQ ID NO: 4373 - RNA, 18 nt, Artificial Sequence
  Description of Artificial Sequence: Synthetic oligonucleotide
ggaccacauugucccaga

SEQ ID NO: 4374 - RNA, 18 nt, Artificial Sequence
  Description of Artificial Sequence: Synthetic oligonucleotide
cacguggaccacauuguc

SEQ ID NO: 4375 - RNA, 18 nt, Artificial Sequence
  Description of Artificial Sequence: Synthetic oligonucleotide
agaaucacguggaccaca

SEQ ID NO: 4376 - RNA, 18 nt, Artificial Sequence
  Description of Artificial Sequence: Synthetic oligonucleotide
gcuugagaaucacgugga

SEQ ID NO: 4377 - RNA, 18 nt, Artificial Sequence
  Description of Artificial Sequence: Synthetic oligonucleotide
ccucagcuugagaaucac

SEQ ID NO: 4378 - RNA, 18 nt, Artificial Sequence
  Description of Artificial Sequence: Synthetic oligonucleotide
gcgagccucagcuugaga

SEQ ID NO: 4379 - RNA, 18 nt, Artificial Sequence
  Description of Artificial Sequence: Synthetic oligonucleotide
gcccagcgagccucagcu

SEQ ID NO: 4380 - RNA, 18 nt, Artificial Sequence
  Description of Artificial Sequence: Synthetic oligonucleotide
gggcggcccagcgagccu

SEQ ID NO: 4381 - RNA, 18 nt, Artificial Sequence
  Description of Artificial Sequence: Synthetic oligonucleotide
ggcgugggcggcccagcg

SEQ ID NO: 4382 - RNA, 18 nt, Artificial Sequence
  Description of Artificial Sequence: Synthetic oligonucleotide
aacagggcgugggcggcc

SEQ ID NO: 4383 - RNA, 18 nt, Artificial Sequence
  Description of Artificial Sequence: Synthetic oligonucleotide
accccaacagggcguggg

SEQ ID NO: 4384 - RNA, 18 nt, Artificial Sequence
  Description of Artificial Sequence: Synthetic oligonucleotide
gaaagaccccaacagggc

SEQ ID NO: 4385 - RNA, 18 nt, Artificial Sequence
  Description of Artificial Sequence: Synthetic oligonucleotide
gcucggaaagaccccaac

SEQ ID NO: 4386 - RNA, 18 nt, Artificial Sequence
  Description of Artificial Sequence: Synthetic oligonucleotide
accucgcucggaaagacc

SEQ ID NO: 4387 - RNA, 18 nt, Artificial Sequence
  Description of Artificial Sequence: Synthetic oligonucleotide
ugaggaccucgcucggaa

SEQ ID NO: 4388 - RNA, 18 nt, Artificial Sequence
  Description of Artificial Sequence: Synthetic oligonucleotide
acggcugaggaccucgcu

SEQ ID NO: 4389 - RNA, 18 nt, Artificial Sequence
  Description of Artificial Sequence: Synthetic oligonucleotide
caugcacggcugaggacc

SEQ ID NO: 4390 - RNA, 18 nt, Artificial Sequence
  Description of Artificial Sequence: Synthetic oligonucleotide
caacgcaugcacggcuga

SEQ ID NO: 4391 - RNA, 18 nt, Artificial Sequence
  Description of Artificial Sequence: Synthetic oligonucleotide
aagcucaacgcaugcacg

SEQ ID NO: 4392 - RNA, 18 nt, Artificial Sequence
  Description of Artificial Sequence: Synthetic oligonucleotide
ggccaaagcucaacgcau

SEQ ID NO: 4393 - RNA, 18 nt, Artificial Sequence
  Description of Artificial Sequence: Synthetic oligonucleotide
ccaagggccaaagcucaa

SEQ ID NO: 4394 - RNA, 18 nt, Artificial Sequence
  Description of Artificial Sequence: Synthetic oligonucleotide
uaucaccaagggccaaag

SEQ ID NO: 4395 - RNA, 18 nt, Artificial Sequence
  Description of Artificial Sequence: Synthetic oligonucleotide
ccaccuaucaccaagggc

SEQ ID NO: 4396 - RNA, 18 nt, Artificial Sequence
  Description of Artificial Sequence: Synthetic oligonucleotide
ccgagccaccuaucacca

SEQ ID NO: 4397 - RNA, 18 nt, Artificial Sequence
  Description of Artificial Sequence: Synthetic oligonucleotide
gcgggccgagccaccuau

SEQ ID NO: 4398 - RNA, 18 nt, Artificial Sequence
  Description of Artificial Sequence: Synthetic oligonucleotide
guagggcgggccgagcca

SEQ ID NO: 4399 - RNA, 18 nt, Artificial Sequence
  Description of Artificial Sequence: Synthetic oligonucleotide
gccagguagggcgggccg

SEQ ID NO: 4400 - RNA, 18 nt, Artificial Sequence
  Description of Artificial Sequence: Synthetic oligonucleotide
agggugccagguagggcg

SEQ ID NO: 4401 - RNA, 18 nt, Artificial Sequence
  Description of Artificial Sequence: Synthetic oligonucleotide
gggucagggugccaggua

SEQ ID NO: 4402 - RNA, 18 nt, Artificial Sequence
  Description of Artificial Sequence: Synthetic oligonucleotide
gaccagggucagggugcc

SEQ ID NO: 4403 - RNA, 18 nt, Artificial Sequence
  Description of Artificial Sequence: Synthetic oligonucleotide
gccgugaccagggucagg

SEQ ID NO: 4404 - RNA, 18 nt, Artificial Sequence
  Description of Artificial Sequence: Synthetic oligonucleotide
ggugagggacgucuguau

SEQ ID NO: 4405 - RNA, 18 nt, Artificial Sequence
  Description of Artificial Sequence: Synthetic oligonucleotide
gcacuggugagggacguc

SEQ ID NO: 4406 - RNA, 18 nt, Artificial Sequence
  Description of Artificial Sequence: Synthetic oligonucleotide
agcuggcacuggugaggg

SEQ ID NO: 4407 - RNA, 18 nt, Artificial Sequence
  Description of Artificial Sequence: Synthetic oligonucleotide
ccccaagcuggcacuggu

SEQ ID NO: 4408 - RNA, 18 nt, Artificial Sequence
  Description of Artificial Sequence: Synthetic oligonucleotide
gcagaccccaagcuggca

SEQ ID NO: 4409 - RNA, 18 nt, Artificial Sequence
  Description of Artificial Sequence: Synthetic oligonucleotide
caucugcagaccccaagc

SEQ ID NO: 4410 - RNA, 18 nt, Artificial Sequence
  Description of Artificial Sequence: Synthetic oligonucleotide
guucucaucugcagaccc

SEQ ID NO: 4411 - RNA, 18 nt, Artificial Sequence
  Description of Artificial Sequence: Synthetic oligonucleotide
acggaguucucaucugca

SEQ ID NO: 4412 - RNA, 18 nt, Artificial Sequence
  Description of Artificial Sequence: Synthetic oligonucleotide
gggccacggaguucucau

SEQ ID NO: 4413 - RNA, 18 nt, Artificial Sequence
  Description of Artificial Sequence: Synthetic oligonucleotide
agccugggccacggaguu

SEQ ID NO: 4414 - RNA, 18 nt, Artificial Sequence
  Description of Artificial Sequence: Synthetic oligonucleotide
ucgucagccugggccacg

SEQ ID NO: 4415 - RNA, 18 nt, Artificial Sequence
  Description of Artificial Sequence: Synthetic oligonucleotide
ggcuaucgucagccuggg

SEQ ID NO: 4416 - RNA, 18 nt, Artificial Sequence
  Description of Artificial Sequence: Synthetic oligonucleotide
uuucaggcuaucgucagc

SEQ ID NO: 4417 - RNA, 18 nt, Artificial Sequence
  Description of Artificial Sequence: Synthetic oligonucleotide
agguuuuucaggcuaucg

SEQ ID NO: 4418 - RNA, 18 nt, Artificial Sequence
  Description of Artificial Sequence: Synthetic oligonucleotide
gguggagguuuuucaggc

SEQ ID NO: 4419 - RNA, 18 nt, Artificial Sequence
  Description of Artificial Sequence: Synthetic oligonucleotide
cuccagguggagguuuuu

SEQ ID NO: 4420 - RNA, 18 nt, Artificial Sequence
  Description of Artificial Sequence: Synthetic oligonucleotide
gugagcuccagguggagg

SEQ ID NO: 4421 - RNA, 18 nt, Artificial Sequence
  Description of Artificial Sequence: Synthetic oligonucleotide
uuuccgugagcuccaggu

SEQ ID NO: 4422 - RNA, 18 nt, Artificial Sequence
  Description of Artificial Sequence: Synthetic oligonucleotide
acagguuuccgugagcuc

SEQ ID NO: 4423 - RNA, 18 nt, Artificial Sequence
  Description of Artificial Sequence: Synthetic oligonucleotide
uccagacagguuuccgug

SEQ ID NO: 4424 - RNA, 18 nt, Artificial Sequence
  Description of Artificial Sequence: Synthetic oligonucleotide
ucauguccagacagguuu

SEQ ID NO: 4425 - RNA, 18 nt, Artificial Sequence
  Description of Artificial Sequence: Synthetic oligonucleotide
agccaucauguccagaca

SEQ ID NO: 4426 - RNA, 18 nt, Artificial Sequence
  Description of Artificial Sequence: Synthetic oligonucleotide
uaucgagccaucaugucc

SEQ ID NO: 4427 - RNA, 18 nt, Artificial Sequence
  Description of Artificial Sequence: Synthetic oligonucleotide
agacguaucgagccauca

SEQ ID NO: 4428 - RNA, 18 nt, Artificial Sequence
  Description of Artificial Sequence: Synthetic oligonucleotide
ggagaagacguaucgagc

SEQ ID NO: 4429 - RNA, 18 nt, Artificial Sequence
  Description of Artificial Sequence: Synthetic oligonucleotide
aaguuggagaagacguau

SEQ ID NO: 4430 - RNA, 18 nt, Artificial Sequence
  Description of Artificial Sequence: Synthetic oligonucleotide
ccgugaaguuggagaaga

SEQ ID NO: 4431 - RNA, 18 nt, Artificial Sequence
  Description of Artificial Sequence: Synthetic oligonucleotide
gacagccgugaaguugga

SEQ ID NO: 4432 - RNA, 18 nt, Artificial Sequence
  Description of Artificial Sequence: Synthetic oligonucleotide
uucgggacagccgugaag

SEQ ID NO: 4433 - RNA, 18 nt, Artificial Sequence
  Description of Artificial Sequence: Synthetic oligonucleotide
gagugcuuccacugcgug

SEQ ID NO: 4434 - RNA, 18 nt, Artificial Sequence
  Description of Artificial Sequence: Synthetic oligonucleotide
uuccagagugcuuccacu

SEQ ID NO: 4435 - RNA, 18 nt, Artificial Sequence
  Description of Artificial Sequence: Synthetic oligonucleotide
ccgccuuccagagugcuu

SEQ ID NO: 4436 - RNA, 18 nt, Artificial Sequence
  Description of Artificial Sequence: Synthetic oligonucleotide
cgcgaccgccuuccagag

SEQ ID NO: 4437 - RNA, 18 nt, Artificial Sequence
  Description of Artificial Sequence: Synthetic oligonucleotide
agauccgcgaccgccuuc

SEQ ID NO: 4438 - RNA, 18 nt, Artificial Sequence
  Description of Artificial Sequence: Synthetic oligonucleotide
gcaacagauccgcgaccg

SEQ ID NO: 4439 - RNA, 18 nt, Artificial Sequence
  Description of Artificial Sequence: Synthetic oligonucleotide
cggcugcaacagauccgc

SEQ ID NO: 4440 - RNA, 18 nt, Artificial Sequence
  Description of Artificial Sequence: Synthetic oligonucleotide
cgcuccggcugcaacaga

SEQ ID NO: 4441 - RNA, 18 nt, Artificial Sequence
  Description of Artificial Sequence: Synthetic oligonucleotide
gcggccgcuccggcugca

SEQ ID NO: 4442 - RNA, 18 nt, Artificial Sequence
  Description of Artificial Sequence: Synthetic oligonucleotide
cuccagcggccgcuccgg

SEQ ID NO: 4443 - RNA, 18 nt, Artificial Sequence
  Description of Artificial Sequence: Synthetic oligonucleotide
cgggccuccagcggccgc

SEQ ID NO: 4444 - RNA, 18 nt, Artificial Sequence
  Description of Artificial Sequence: Synthetic oligonucleotide
cgugccgggccuccagcg

SEQ ID NO: 4445 - RNA, 18 nt, Artificial Sequence
  Description of Artificial Sequence: Synthetic oligonucleotide
caccgcgugccgggccuc

SEQ ID NO: 4446 - RNA, 18 nt, Artificial Sequence
  Description of Artificial Sequence: Synthetic oligonucleotide
gccagcaccgcgugccgg

SEQ ID NO: 4447 - RNA, 18 nt, Artificial Sequence
  Description of Artificial Sequence: Synthetic oligonucleotide
gcagagccagcaccgcgu

SEQ ID NO: 4448 - RNA, 18 nt, Artificial Sequence
  Description of Artificial Sequence: Synthetic oligonucleotide
cuucagcagagccagcac

SEQ ID NO: 4449 - RNA, 18 nt, Artificial Sequence
  Description of Artificial Sequence: Synthetic oligonucleotide
auggccuucagcagagcc

SEQ ID NO: 4450 - RNA, 18 nt, Artificial Sequence
  Description of Artificial Sequence: Synthetic oligonucleotide
gcacgauggccuucagca

SEQ ID NO: 4451 - RNA, 18 nt, Artificial Sequence
  Description of Artificial Sequence: Synthetic oligonucleotide
ccccugcacgauggccuu

SEQ ID NO: 4452 - RNA, 18 nt, Artificial Sequence
  Description of Artificial Sequence: Synthetic oligonucleotide
cccagcgucgcccugggc

SEQ ID NO: 4453 - RNA, 18 nt, Artificial Sequence
  Description of Artificial Sequence: Synthetic oligonucleotide
cccaucccagcgucgccc

SEQ ID NO: 4454 - RNA, 18 nt, Artificial Sequence
  Description of Artificial Sequence: Synthetic oligonucleotide
cgucacccaucccagcgu

SEQ ID NO: 4455 - RNA, 18 nt, Artificial Sequence
  Description of Artificial Sequence: Synthetic oligonucleotide
ccugacgucacccauccc

SEQ ID NO: 4456 - RNA, 18 nt, Artificial Sequence
  Description of Artificial Sequence: Synthetic oligonucleotide
ggcagccugacgucaccc

SEQ ID NO: 4457 - RNA, 18 nt, Artificial Sequence
  Description of Artificial Sequence: Synthetic oligonucleotide
cagugggcagccugacgu

SEQ ID NO: 4458 - RNA, 18 nt, Artificial Sequence
  Description of Artificial Sequence: Synthetic oligonucleotide
acagucagugggcagccu

SEQ ID NO: 4459 - RNA, 18 nt, Artificial Sequence
  Description of Artificial Sequence: Synthetic oligonucleotide
acaggacagucagugggc

SEQ ID NO: 4460 - RNA, 18 nt, Artificial Sequence
  Description of Artificial Sequence: Synthetic oligonucleotide
cagggacaggacagucag

SEQ ID NO: 4461 - RNA, 18 nt, Artificial Sequence
  Description of Artificial Sequence: Synthetic oligonucleotide
cccagcagggacaggaca

SEQ ID NO: 4462 - RNA, 18 nt, Artificial Sequence
  Description of Artificial Sequence: Synthetic oligonucleotide
cacggcccagcagggaca

SEQ ID NO: 4463 - RNA, 18 nt, Artificial Sequence
  Description of Artificial Sequence: Synthetic oligonucleotide
ccaaacacggcccagcag

SEQ ID NO: 4464 - RNA, 18 nt, Artificial Sequence
  Description of Artificial Sequence: Synthetic oligonucleotide
ggaguccaaacacggccc

SEQ ID NO: 4465 - RNA, 18 nt, Artificial Sequence
  Description of Artificial Sequence: Synthetic oligonucleotide
aggcaggaguccaaacac

SEQ ID NO: 4466 - RNA, 18 nt, Artificial Sequence
  Description of Artificial Sequence: Synthetic oligonucleotide
caccgaggcaggagucca

SEQ ID NO: 4467 - RNA, 18 nt, Artificial Sequence
  Description of Artificial Sequence: Synthetic oligonucleotide
caacucaccgaggcagga

SEQ ID NO: 4468 - RNA, 18 nt, Artificial Sequence
  Description of Artificial Sequence: Synthetic oligonucleotide
cccagcaacucaccgagg

SEQ ID NO: 4469 - RNA, 18 nt, Artificial Sequence
  Description of Artificial Sequence: Synthetic oligonucleotide
cugugcccagcaacucac

SEQ ID NO: 4470 - RNA, 18 nt, Artificial Sequence
  Description of Artificial Sequence: Synthetic oligonucleotide
agacccugugcccagcaa

SEQ ID NO: 4471 - RNA, 18 nt, Artificial Sequence
  Description of Artificial Sequence: Synthetic oligonucleotide
ccccuagacccugugccc

SEQ ID NO: 4472 - RNA, 18 nt, Artificial Sequence
  Description of Artificial Sequence: Synthetic oligonucleotide
aucagccccuagacccug

SEQ ID NO: 4473 - RNA, 18 nt, Artificial Sequence
  Description of Artificial Sequence: Synthetic oligonucleotide
agcccaucagccccuaga

SEQ ID NO: 4474 - RNA, 18 nt, Artificial Sequence
  Description of Artificial Sequence: Synthetic oligonucleotide
uccagagcccaucagccc

SEQ ID NO: 4475 - RNA, 18 nt, Artificial Sequence
  Description of Artificial Sequence: Synthetic oligonucleotide
ccagcuccagagcccauc

SEQ ID NO: 4476 - RNA, 18 nt, Artificial Sequence
  Description of Artificial Sequence: Synthetic oligonucleotide
gccauccagcuccagagc

SEQ ID NO: 4477 - RNA, 18 nt, Artificial Sequence
  Description of Artificial Sequence: Synthetic oligonucleotide
cacaggccauccagcucc

SEQ ID NO: 4478 - RNA, 18 nt, Artificial Sequence
  Description of Artificial Sequence: Synthetic oligonucleotide
gaccccacaggccaucca

SEQ ID NO: 4479 - RNA, 18 nt, Artificial Sequence
  Description of Artificial Sequence: Synthetic oligonucleotide
caggagaccccacaggcc

SEQ ID NO: 4480 - RNA, 18 nt, Artificial Sequence
  Description of Artificial Sequence: Synthetic oligonucleotide
gacaccaggagaccccac

SEQ ID NO: 4481 - RNA, 18 nt, Artificial Sequence
  Description of Artificial Sequence: Synthetic oligonucleotide
cucaugacaccaggagac

SEQ ID NO: 4482 - RNA, 18 nt, Artificial Sequence
  Description of Artificial Sequence: Synthetic oligonucleotide
cagaccucaugacaccag

SEQ ID NO: 4483 - RNA, 18 nt, Artificial Sequence
  Description of Artificial Sequence: Synthetic oligonucleotide
ucacacagaccucaugac

SEQ ID NO: 4484 - RNA, 18 nt, Artificial Sequence
  Description of Artificial Sequence: Synthetic oligonucleotide
uacggucacacagaccuc

SEQ ID NO: 4485 - RNA, 18 nt, Artificial Sequence
  Description of Artificial Sequence: Synthetic oligonucleotide
gugccuacggucacacag

SEQ ID NO: 4486 - RNA, 18 nt, Artificial Sequence
  Description of Artificial Sequence: Synthetic oligonucleotide
aggcagugccuacgguca

SEQ ID NO: 4487 - RNA, 18 nt, Artificial Sequence
  Description of Artificial Sequence: Synthetic oligonucleotide
cgaggaggcagugccuac

SEQ ID NO: 4488 - RNA, 18 nt, Artificial Sequence
  Description of Artificial Sequence: Synthetic oligonucleotide
acaggcgaggaggcagug

SEQ ID NO: 4489 - RNA, 18 nt, Artificial Sequence
  Description of Artificial Sequence: Synthetic oligonucleotide
uguuuacaggcgaggagg

SEQ ID NO: 4490 - RNA, 18 nt, Artificial Sequence
  Description of Artificial Sequence: Synthetic oligonucleotide
ccaucuguuuacaggcga

SEQ ID NO: 4491 - RNA, 18 nt, Artificial Sequence
  Description of Artificial Sequence: Synthetic oligonucleotide
agugaccaucuguuuaca

SEQ ID NO: 4492 - RNA, 18 nt, Artificial Sequence
  Description of Artificial Sequence: Synthetic oligonucleotide
ggugcagugaccaucugu

SEQ ID NO: 4493 - RNA, 18 nt, Artificial Sequence
  Description of Artificial Sequence: Synthetic oligonucleotide
aggaaggugcagugacca

SEQ ID NO: 4494 - RNA, 18 nt, Artificial Sequence
  Description of Artificial Sequence: Synthetic oligonucleotide
auaagaggaaggugcagu

SEQ ID NO: 4495 - RNA, 18 nt, Artificial Sequence
  Description of Artificial Sequence: Synthetic oligonucleotide
aucccauaagaggaaggu

SEQ ID NO: 4496 - RNA, 18 nt, Artificial Sequence
  Description of Artificial Sequence: Synthetic oligonucleotide
agaacaucccauaagagg

SEQ ID NO: 4497 - RNA, 18 nt, Artificial Sequence
  Description of Artificial Sequence: Synthetic oligonucleotide
uccccagaacaucccaua

SEQ ID NO: 4498 - RNA, 18 nt, Artificial Sequence
  Description of Artificial Sequence: Synthetic oligonucleotide
uaugauccccagaacauc

SEQ ID NO: 4499 - RNA, 18 nt, Artificial Sequence
  Description of Artificial Sequence: Synthetic oligonucleotide
ccucauaugauccccaga

SEQ ID NO: 4500 - RNA, 18 nt, Artificial Sequence
  Description of Artificial Sequence: Synthetic oligonucleotide
aacugccucauaugaucc

SEQ ID NO: 4501 - RNA, 18 nt, Artificial Sequence
  Description of Artificial Sequence: Synthetic oligonucleotide
gcgagaacugccucauau

SEQ ID NO: 4502 - RNA, 18 nt, Artificial Sequence
  Description of Artificial Sequence: Synthetic oligonucleotide
acucugcgagaacugccu

SEQ ID NO: 4503 - RNA, 18 nt, Artificial Sequence
  Description of Artificial Sequence: Synthetic oligonucleotide
ucagcacucugcgagaac

SEQ ID NO: 4504 - RNA, 18 nt, Artificial Sequence
  Description of Artificial Sequence: Synthetic oligonucleotide
cgaucucagcacucugcg

SEQ ID NO: 4505 - RNA, 18 nt, Artificial Sequence
  Description of Artificial Sequence: Synthetic oligonucleotide
agguacgaucucagcacu

SEQ ID NO: 4506 - RNA, 18 nt, Artificial Sequence
  Description of Artificial Sequence: Synthetic oligonucleotide
cugccagguacgaucuca

SEQ ID NO: 4507 - RNA, 18 nt, Artificial Sequence
  Description of Artificial Sequence: Synthetic oligonucleotide
accagcugccagguacga

SEQ ID NO: 4508 - RNA, 18 nt, Artificial Sequence
  Description of Artificial Sequence: Synthetic oligonucleotide
cccacaccagcugccagg

SEQ ID NO: 4509 - RNA, 18 nt, Artificial Sequence
  Description of Artificial Sequence: Synthetic oligonucleotide
guagccccacaccagcug

SEQ ID NO: 4510 - RNA, 18 nt, Artificial Sequence
  Description of Artificial Sequence: Synthetic oligonucleotide
acaccguagccccacacc

SEQ ID NO: 4511 - RNA, 18 nt, Artificial Sequence
  Description of Artificial Sequence: Synthetic oligonucleotide
aaacaacaccguagcccc

SEQ ID NO: 4512 - RNA, 18 nt, Artificial Sequence
  Description of Artificial Sequence: Synthetic oligonucleotide
gggcaaaacaacaccgua

SEQ ID NO: 4513 - RNA, 18 nt, Artificial Sequence
  Description of Artificial Sequence: Synthetic oligonucleotide
ugcaagggcaaaacaaca

SEQ ID NO: 4514 - RNA, 18 nt, Artificial Sequence
  Description of Artificial Sequence: Synthetic oligonucleotide
aagggugcaagggcaaaa

SEQ ID NO: 4515 - RNA, 18 nt, Artificial Sequence
  Description of Artificial Sequence: Synthetic oligonucleotide
cccgaaagggugcaaggg

SEQ ID NO: 4516 - RNA, 18 nt, Artificial Sequence
  Description of Artificial Sequence: Synthetic oligonucleotide
guggccccgaaagggugc

SEQ ID NO: 4517 - RNA, 18 nt, Artificial Sequence
  Description of Artificial Sequence: Synthetic oligonucleotide
gggaguggccccgaaagg

SEQ ID NO: 4518 - RNA, 18 nt, Artificial Sequence
  Description of Artificial Sequence: Synthetic oligonucleotide
ggaaugcagugagcaggg

SEQ ID NO: 4519 - RNA, 18 nt, Artificial Sequence
  Description of Artificial Sequence: Synthetic oligonucleotide
cagauggaaugcagugag

SEQ ID NO: 4520 - RNA, 18 nt, Artificial Sequence
  Description of Artificial Sequence: Synthetic oligonucleotide
cagcacagauggaaugca

SEQ ID NO: 4521 - RNA, 18 nt, Artificial Sequence
  Description of Artificial Sequence: Synthetic oligonucleotide
aagaccagcacagaugga

SEQ ID NO: 4522 - RNA, 18 nt, Artificial Sequence
  Description of Artificial Sequence: Synthetic oligonucleotide
cagccaagaccagcacag

SEQ ID NO: 4523 - RNA, 18 nt, Artificial Sequence
  Description of Artificial Sequence: Synthetic oligonucleotide
agggucagccaagaccag

SEQ ID NO: 4524 - RNA, 18 nt, Artificial Sequence
  Description of Artificial Sequence: Synthetic oligonucleotide
uguucagggucagccaag

SEQ ID NO: 4525 - RNA, 18 nt, Artificial Sequence
  Description of Artificial Sequence: Synthetic oligonucleotide
cuggguguucagggucag

SEQ ID NO: 4526 - RNA, 18 nt, Artificial Sequence
  Description of Artificial Sequence: Synthetic oligonucleotide
gaggccuggguguucagg

SEQ ID NO: 4527 - RNA, 18 nt, Artificial Sequence
  Description of Artificial Sequence: Synthetic oligonucleotide
accaagaggccugggugu

SEQ ID NO: 4528 - RNA, 18 nt, Artificial Sequence
  Description of Artificial Sequence: Synthetic oligonucleotide
ggaacaccaagaggccug

SEQ ID NO: 4529 - RNA, 18 nt, Artificial Sequence
  Description of Artificial Sequence: Synthetic oligonucleotide
aggcaggaacaccaagag

SEQ ID NO: 4530 - RNA, 18 nt, Artificial Sequence
  Description of Artificial Sequence: Synthetic oligonucleotide
gggaggcaggaacaccaa

SEQ ID NO: 4531 - RNA, 18 nt, Artificial Sequence
  Description of Artificial Sequence: Synthetic oligonucleotide
agaaguggccgaccaggg

SEQ ID NO: 4532 - RNA, 18 nt, Artificial Sequence
  Description of Artificial Sequence: Synthetic oligonucleotide
ggaguagaaguggccgac

SEQ ID NO: 4533 - RNA, 18 nt, Artificial Sequence
  Description of Artificial Sequence: Synthetic oligonucleotide
augaaggaguagaagugg

SEQ ID NO: 4534 - RNA, 18 nt, Artificial Sequence
  Description of Artificial Sequence: Synthetic oligonucleotide
gggacaugaaggaguaga

SEQ ID NO: 4535 - RNA, 18 nt, Artificial Sequence
  Description of Artificial Sequence: Synthetic oligonucleotide
gaacaccaagaggccugg

SEQ ID NO: 4536 - RNA, 18 nt, Artificial Sequence
  Description of Artificial Sequence: Synthetic oligonucleotide
ggcaggaacaccaagagg

SEQ ID NO: 4537 - RNA, 18 nt, Artificial Sequence
  Description of Artificial Sequence: Synthetic oligonucleotide
agaaguggccgaccaggg

SEQ ID NO: 4538 - RNA, 18 nt, Artificial Sequence
  Description of Artificial Sequence: Synthetic oligonucleotide
ggaguagaaguggccgac

SEQ ID NO: 4539 - RNA, 18 nt, Artificial Sequence
  Description of Artificial Sequence: Synthetic oligonucleotide
augaaggaguagaagugg

SEQ ID NO: 4540 - RNA, 18 nt, Artificial Sequence
  Description of Artificial Sequence: Synthetic oligonucleotide
gggacaugaaggaguaga

SEQ ID NO: 4541 - RNA, 18 nt, Artificial Sequence
  Description of Artificial Sequence: Synthetic oligonucleotide
cagcugggacaugaagga

SEQ ID NO: 4542 - RNA, 18 nt, Artificial Sequence
  Description of Artificial Sequence: Synthetic oligonucleotide
cugagcagcugggacaug

SEQ ID NO: 4543 - RNA, 18 nt, Artificial Sequence
  Description of Artificial Sequence: Synthetic oligonucleotide
cccuucugagcagcuggg

SEQ ID NO: 4544 - RNA, 18 nt, Artificial Sequence
  Description of Artificial Sequence: Synthetic oligonucleotide
gacggcccuucugagcag

SEQ ID NO: 4545 - RNA, 18 nt, Artificial Sequence
  Description of Artificial Sequence: Synthetic oligonucleotide
gaguggacggcccuucug

SEQ ID NO: 4546 - RNA, 18 nt, Artificial Sequence
  Description of Artificial Sequence: Synthetic oligonucleotide
ugugagaguggacggccc

SEQ ID NO: 4547 - RNA, 18 nt, Artificial Sequence
  Description of Artificial Sequence: Synthetic oligonucleotide
gagccugugagaguggac

SEQ ID NO: 4548 - RNA, 18 nt, Artificial Sequence
  Description of Artificial Sequence: Synthetic oligonucleotide
caggagagccugugagag

SEQ ID NO: 4549 - RNA, 18 nt, Artificial Sequence
  Description of Artificial Sequence: Synthetic oligonucleotide
aaacccaggagagccugu

SEQ ID NO: 4550 - RNA, 18 nt, Artificial Sequence
  Description of Artificial Sequence: Synthetic oligonucleotide
ggacaaggccugaguggg

SEQ ID NO: 4551 - RNA, 18 nt, Artificial Sequence
  Description of Artificial Sequence: Synthetic oligonucleotide
acugaggacaaggccuga

SEQ ID NO: 4552 - RNA, 18 nt, Artificial Sequence
  Description of Artificial Sequence: Synthetic oligonucleotide
cagagacugaggacaagg

SEQ ID NO: 4553 - RNA, 18 nt, Artificial Sequence
  Description of Artificial Sequence: Synthetic oligonucleotide
gugcucagagacugagga

SEQ ID NO: 4554 - RNA, 18 nt, Artificial Sequence
  Description of Artificial Sequence: Synthetic oligonucleotide
gccuugugcucagagacu

SEQ ID NO: 4555 - RNA, 18 nt, Artificial Sequence
  Description of Artificial Sequence: Synthetic oligonucleotide
agacagccuugugcucag

SEQ ID NO: 4556 - RNA, 18 nt, Artificial Sequence
  Description of Artificial Sequence: Synthetic oligonucleotide
agggcagacagccuugug

SEQ ID NO: 4557 - RNA, 18 nt, Artificial Sequence
  Description of Artificial Sequence: Synthetic oligonucleotide
ggugcagggcagacagcc

SEQ ID NO: 4558 - RNA, 18 nt, Artificial Sequence
  Description of Artificial Sequence: Synthetic oligonucleotide
cacucggugcagggcaga

SEQ ID NO: 4559 - RNA, 18 nt, Artificial Sequence
  Description of Artificial Sequence: Synthetic oligonucleotide
cccugcacucggugcagg

SEQ ID NO: 4560 - RNA, 18 nt, Artificial Sequence
  Description of Artificial Sequence: Synthetic oligonucleotide
ccgaccccugcacucggu

SEQ ID NO: 4561 - RNA, 18 nt, Artificial Sequence
  Description of Artificial Sequence: Synthetic oligonucleotide
ccugcccgaccccugcac

SEQ ID NO: 4562 - RNA, 18 nt, Artificial Sequence
  Description of Artificial Sequence: Synthetic oligonucleotide
cagcuccugcccgacccc

SEQ ID NO: 4563 - RNA, 18 nt, Artificial Sequence
  Description of Artificial Sequence: Synthetic oligonucleotide
ugacacagcuccugcccg

SEQ ID NO: 4564 - RNA, 18 nt, Artificial Sequence
  Description of Artificial Sequence: Synthetic oligonucleotide
ggguggcgcagagcaggg

SEQ ID NO: 4565 - RNA, 18 nt, Artificial Sequence
  Description of Artificial Sequence: Synthetic oligonucleotide
acagcggguggcgcagag

SEQ ID NO: 4566 - RNA, 18 nt, Artificial Sequence
  Description of Artificial Sequence: Synthetic oligonucleotide
cuggcacagcggguggcg

SEQ ID NO: 4567 - RNA, 18 nt, Artificial Sequence
  Description of Artificial Sequence: Synthetic oligonucleotide
gggaccuggcacagcggg

SEQ ID NO: 4568 - RNA, 18 nt, Artificial Sequence
  Description of Artificial Sequence: Synthetic oligonucleotide
gugucgggaccuggcaca

SEQ ID NO: 4569 - RNA, 18 nt, Artificial Sequence
  Description of Artificial Sequence: Synthetic oligonucleotide
gcugugugucgggaccug

SEQ ID NO: 4570 - RNA, 18 nt, Artificial Sequence
  Description of Artificial Sequence: Synthetic oligonucleotide
caacugcugugugucggg

SEQ ID NO: 4571 - RNA, 18 nt, Artificial Sequence
  Description of Artificial Sequence: Synthetic oligonucleotide
gggagcaacugcugugug

SEQ ID NO: 4572 - RNA, 18 nt, Artificial Sequence
  Description of Artificial Sequence: Synthetic oligonucleotide
cgcagagcggcguauggg

SEQ ID NO: 4573 - RNA, 18 nt, Artificial Sequence
  Description of Artificial Sequence: Synthetic oligonucleotide
gaccgcagagcggcguau

SEQ ID NO: 4574 - RNA, 18 nt, Artificial Sequence
  Description of Artificial Sequence: Synthetic oligonucleotide
cggccgaccgcagagcgg

SEQ ID NO: 4575 - RNA, 18 nt, Artificial Sequence
  Description of Artificial Sequence: Synthetic oligonucleotide
ugcaccggccgaccgcag

SEQ ID NO: 4576 - RNA, 18 nt, Artificial Sequence
  Description of Artificial Sequence: Synthetic oligonucleotide
ccggaugcaccggccgac

SEQ ID NO: 4577 - RNA, 18 nt, Artificial Sequence
  Description of Artificial Sequence: Synthetic oligonucleotide
gcauuguacagggcaggg

SEQ ID NO: 4578 - RNA, 18 nt, Artificial Sequence
  Description of Artificial Sequence: Synthetic oligonucleotide
caucagcauuguacaggg

SEQ ID NO: 4579 - RNA, 18 nt, Artificial Sequence
  Description of Artificial Sequence: Synthetic oligonucleotide
ugcagcaucagcauugua

SEQ ID NO: 4580 - RNA, 18 nt, Artificial Sequence
  Description of Artificial Sequence: Synthetic oligonucleotide
aggucugcagcaucagca

SEQ ID NO: 4581 - RNA, 18 nt, Artificial Sequence
  Description of Artificial Sequence: Synthetic oligonucleotide
gagacaggucugcagcau

SEQ ID NO: 4582 - RNA, 18 nt, Artificial Sequence
  Description of Artificial Sequence: Synthetic oligonucleotide
ugcaagagacaggucugc

SEQ ID NO: 4583 - RNA, 18 nt, Artificial Sequence
  Description of Artificial Sequence: Synthetic oligonucleotide
cgcccugcaagagacagg

SEQ ID NO: 4584 - RNA, 18 nt, Artificial Sequence
  Description of Artificial Sequence: Synthetic oligonucleotide
agaggcgcccugcaagag

SEQ ID NO: 4585 - RNA, 18 nt, Artificial Sequence
  Description of Artificial Sequence: Synthetic oligonucleotide
cccacagaggcgcccugc

SEQ ID NO: 4586 - RNA, 18 nt, Artificial Sequence
  Description of Artificial Sequence: Synthetic oligonucleotide
uccuucccacagaggcgc

SEQ ID NO: 4587 - RNA, 18 nt, Artificial Sequence
  Description of Artificial Sequence: Synthetic oligonucleotide
cccucuccuucccacaga

SEQ ID NO: 4588 - RNA, 18 nt, Artificial Sequence
  Description of Artificial Sequence: Synthetic oligonucleotide
uggaccccucuccuuccc

SEQ ID NO: 4589 - RNA, 18 nt, Artificial Sequence
  Description of Artificial Sequence: Synthetic oligonucleotide
agcccuggaccccucucc

SEQ ID NO: 4590 - RNA, 18 nt, Artificial Sequence
  Description of Artificial Sequence: Synthetic oligonucleotide
acuccagcccuggacccc

SEQ ID NO: 4591 - RNA, 18 nt, Artificial Sequence
  Description of Artificial Sequence: Synthetic oligonucleotide
cccggacuccagcccugg

SEQ ID NO: 4592 - RNA, 18 nt, Artificial Sequence
  Description of Artificial Sequence: Synthetic oligonucleotide
gggcacccggacuccagc

SEQ ID NO: 4593 - RNA, 18 nt, Artificial Sequence
  Description of Artificial Sequence: Synthetic oligonucleotide
agucccugaagugcaggg

SEQ ID NO: 4594 - RNA, 18 nt, Artificial Sequence
  Description of Artificial Sequence: Synthetic oligonucleotide
aagucccugaagugcagg

SEQ ID NO: 4595 - RNA, 18 nt, Artificial Sequence
  Description of Artificial Sequence: Synthetic oligonucleotide
ccaagaagucccugaagu

SEQ ID NO: 4596 - RNA, 18 nt, Artificial Sequence
  Description of Artificial Sequence: Synthetic oligonucleotide
ggcugccaagaagucccu

SEQ ID NO: 4597 - RNA, 18 nt, Artificial Sequence
  Description of Artificial Sequence: Synthetic oligonucleotide
cacacggcugccaagaag

SEQ ID NO: 4598 - RNA, 18 nt, Artificial Sequence
  Description of Artificial Sequence: Synthetic oligonucleotide
ucgcccacacggcugcca

SEQ ID NO: 4599 - RNA, 18 nt, Artificial Sequence
  Description of Artificial Sequence: Synthetic oligonucleotide
cagcgucgcccacacggc

SEQ ID NO: 4600 - RNA, 18 nt, Artificial Sequence
  Description of Artificial Sequence: Synthetic oligonucleotide
ccugccagcgucgcccac

SEQ ID NO: 4601 - RNA, 18 nt, Artificial Sequence
  Description of Artificial Sequence: Synthetic oligonucleotide
cagagccugccagcgucg

SEQ ID NO: 4602 - RNA, 18 nt, Artificial Sequence
  Description of Artificial Sequence: Synthetic oligonucleotide
aucagcagagccugccag

SEQ ID NO: 4603 - RNA, 18 nt, Artificial Sequence
  Description of Artificial Sequence: Synthetic oligonucleotide
acaggaucagcagagccu

SEQ ID NO: 4604 - RNA, 18 nt, Artificial Sequence
  Description of Artificial Sequence: Synthetic oligonucleotide
ggacccccaaacgcucgc

SEQ ID NO: 4605 - RNA, 18 nt, Artificial Sequence
  Description of Artificial Sequence: Synthetic oligonucleotide
ucugaggacccccaaacg

SEQ ID NO: 4606 - RNA, 18 nt, Artificial Sequence
  Description of Artificial Sequence: Synthetic oligonucleotide
agggcucugaggaccccc

SEQ ID NO: 4607 - RNA, 18 nt, Artificial Sequence
  Description of Artificial Sequence: Synthetic oligonucleotide
agaagagggcucugagga

SEQ ID NO: 4608 - RNA, 18 nt, Artificial Sequence
  Description of Artificial Sequence: Synthetic oligonucleotide
cuuaaagaagagggcucu

SEQ ID NO: 4609 - RNA, 18 nt, Artificial Sequence
  Description of Artificial Sequence: Synthetic oligonucleotide
augaccuuaaagaagagg

SEQ ID NO: 4610 - RNA, 18 nt, Artificial Sequence
  Description of Artificial Sequence: Synthetic oligonucleotide
ccuugaugaccuuaaaga

SEQ ID NO: 4611 - RNA, 18 nt, Artificial Sequence
  Description of Artificial Sequence: Synthetic oligonucleotide
guaauccuugaugaccuu

SEQ ID NO: 4612 - RNA, 18 nt, Artificial Sequence
  Description of Artificial Sequence: Synthetic oligonucleotide
gaaggguaauccuugaug

SEQ ID NO: 4613 - RNA, 18 nt, Artificial Sequence
  Description of Artificial Sequence: Synthetic oligonucleotide
cguuggaaggguaauccu

SEQ ID NO: 4614 - RNA, 18 nt, Artificial Sequence
  Description of Artificial Sequence: Synthetic oligonucleotide
gucuucguuggaagggua

SEQ ID NO: 4615 - RNA, 18 nt, Artificial Sequence
  Description of Artificial Sequence: Synthetic oligonucleotide
ugaaggucuucguuggaa

SEQ ID NO: 4616 - RNA, 18 nt, Artificial Sequence
  Description of Artificial Sequence: Synthetic oligonucleotide
uuucgugaaggucuucgu

SEQ ID NO: 4617 - RNA, 18 nt, Artificial Sequence
  Description of Artificial Sequence: Synthetic oligonucleotide
cagccuuucgugaagguc

SEQ ID NO: 4618 - RNA, 18 nt, Artificial Sequence
  Description of Artificial Sequence: Synthetic oligonucleotide
accuccagccuuucguga

SEQ ID NO: 4619 - RNA, 18 nt, Artificial Sequence
  Description of Artificial Sequence: Synthetic oligonucleotide
ugaaaaccuccagccuuu

SEQ ID NO: 4620 - RNA, 18 nt, Artificial Sequence
  Description of Artificial Sequence: Synthetic oligonucleotide
ggccuugaaaaccuccag

SEQ ID NO: 4621 - RNA, 18 nt, Artificial Sequence
  Description of Artificial Sequence: Synthetic oligonucleotide
gugagggccuugaaaacc

SEQ ID NO: 4622 - RNA, 18 nt, Artificial Sequence
  Description of Artificial Sequence: Synthetic oligonucleotide
ugucugugagggccuuga

SEQ ID NO: 4623 - RNA, 18 nt, Artificial Sequence
  Description of Artificial Sequence: Synthetic oligonucleotide
cccauugucugugagggc

SEQ ID NO: 4624 - RNA, 18 nt, Artificial Sequence
  Description of Artificial Sequence: Synthetic oligonucleotide
ugucucccauugucugug

SEQ ID NO: 4625 - RNA, 18 nt, Artificial Sequence
  Description of Artificial Sequence: Synthetic oligonucleotide
ugaugugucucccauugu

SEQ ID NO: 4626 - RNA, 18 nt, Artificial Sequence
  Description of Artificial Sequence: Synthetic oligonucleotide
guaggugaugugucuccc

SEQ ID NO: 4627 - RNA, 18 nt, Artificial Sequence
  Description of Artificial Sequence: Synthetic oligonucleotide
uccaaguaggugaugugu

SEQ ID NO: 4628 - RNA, 18 nt, Artificial Sequence
  Description of Artificial Sequence: Synthetic oligonucleotide
cuuccuccaaguagguga

SEQ ID NO: 4629 - RNA, 18 nt, Artificial Sequence
  Description of Artificial Sequence: Synthetic oligonucleotide
cagcucuuccuccaagua

SEQ ID NO: 4630 - RNA, 18 nt, Artificial Sequence
  Description of Artificial Sequence: Synthetic oligonucleotide
ucaucagccagcuggugu

SEQ ID NO: 4631 - RNA, 18 nt, Artificial Sequence
  Description of Artificial Sequence: Synthetic oligonucleotide
caggcucaucagccagcu

SEQ ID NO: 4632 - RNA, 18 nt, Artificial Sequence
  Description of Artificial Sequence: Synthetic oligonucleotide
uucuccaggcucaucagc

SEQ ID NO: 4633 - RNA, 18 nt, Artificial Sequence
  Description of Artificial Sequence: Synthetic oligonucleotide
gcggguucuccaggcuca

SEQ ID NO: 4634 - RNA, 18 nt, Artificial Sequence
  Description of Artificial Sequence: Synthetic oligonucleotide
gcugagcggguucuccag

SEQ ID NO: 4635 - RNA, 18 nt, Artificial Sequence
  Description of Artificial Sequence: Synthetic oligonucleotide
aaagggcugagcggguuc

SEQ ID NO: 4636 - RNA, 18 nt, Artificial Sequence
  Description of Artificial Sequence: Synthetic oligonucleotide
aggagaaagggcugagcg

SEQ ID NO: 4637 - RNA, 18 nt, Artificial Sequence
  Description of Artificial Sequence: Synthetic oligonucleotide
guccgaggagaaagggcu

SEQ ID NO: 4638 - RNA, 18 nt, Artificial Sequence
  Description of Artificial Sequence: Synthetic oligonucleotide
uugauguccgaggagaaa

SEQ ID NO: 4639 - RNA, 18 nt, Artificial Sequence
  Description of Artificial Sequence: Synthetic oligonucleotide
uguuguugauguccgagg

SEQ ID NO: 4640 - RNA, 18 nt, Artificial Sequence
  Description of Artificial Sequence: Synthetic oligonucleotide
gggcauguuguugauguc

SEQ ID NO: 4641 - RNA, 18 nt, Artificial Sequence
  Description of Artificial Sequence: Synthetic oligonucleotide
uagacagcuccugcaggg

SEQ ID NO: 4642 - RNA, 18 nt, Artificial Sequence
  Description of Artificial Sequence: Synthetic oligonucleotide
gcguuagacagcuccugc

SEQ ID NO: 4643 - RNA, 18 nt, Artificial Sequence
  Description of Artificial Sequence: Synthetic oligonucleotide
ugagggcguuagacagcu

SEQ ID NO: 4644 - RNA, 18 nt, Artificial Sequence
  Description of Artificial Sequence: Synthetic oligonucleotide
cgccaugagggcguuaga

SEQ ID NO: 4645 - RNA, 18 nt, Artificial Sequence
  Description of Artificial Sequence: Synthetic oligonucleotide
ucagccgccaugagggcg

SEQ ID NO: 4646 - RNA, 18 nt, Artificial Sequence
  Description of Artificial Sequence: Synthetic oligonucleotide
agcgcucagccgccauga

SEQ ID NO: 4647 - RNA, 18 nt, Artificial Sequence
  Description of Artificial Sequence: Synthetic oligonucleotide
cuugaagcgcucagccgc

SEQ ID NO: 4648 - RNA, 18 nt, Artificial Sequence
  Description of Artificial Sequence: Synthetic oligonucleotide
ugcuccuugaagcgcuca

SEQ ID NO: 4649 - RNA, 18 nt, Artificial Sequence
  Description of Artificial Sequence: Synthetic oligonucleotide
cccggugcuccuugaagc

SEQ ID NO: 4650 - RNA, 18 nt, Artificial Sequence
  Description of Artificial Sequence: Synthetic oligonucleotide
ugugucccggugcuccuu

SEQ ID NO: 4651 - RNA, 18 nt, Artificial Sequence
  Description of Artificial Sequence: Synthetic oligonucleotide
agggcugugucccggugc

SEQ ID NO: 4652 - RNA, 18 nt, Artificial Sequence
  Description of Artificial Sequence: Synthetic oligonucleotide
uguacagggcuguguccc

SEQ ID NO: 4653 - RNA, 18 nt, Artificial Sequence
  Description of Artificial Sequence: Synthetic oligonucleotide
ugacuuguacagggcugu

SEQ ID NO: 4654 - RNA, 18 nt, Artificial Sequence
  Description of Artificial Sequence: Synthetic oligonucleotide
gacagugacuuguacagg

SEQ ID NO: 4655 - RNA, 18 nt, Artificial Sequence
  Description of Artificial Sequence: Synthetic oligonucleotide
gcaccgacagugacuugu

SEQ ID NO: 4656 - RNA, 18 nt, Artificial Sequence
  Description of Artificial Sequence: Synthetic oligonucleotide
ugccggcaccgacaguga

SEQ ID NO: 4657 - RNA, 18 nt, Artificial Sequence
  Description of Artificial Sequence: Synthetic oligonucleotide
cuggcugccggcaccgac

SEQ ID NO: 4658 - RNA, 18 nt, Artificial Sequence
  Description of Artificial Sequence: Synthetic oligonucleotide
ccgugcuggcugccggca

SEQ ID NO: 4659 - RNA, 18 nt, Artificial Sequence
  Description of Artificial Sequence: Synthetic oligonucleotide
uuuggccgugcuggcugc

SEQ ID NO: 4660 - RNA, 18 nt, Artificial Sequence
  Description of Artificial Sequence: Synthetic oligonucleotide
gagcgaggcagaggaggg

SEQ ID NO: 4661 - RNA, 18 nt, Artificial Sequence
  Description of Artificial Sequence: Synthetic oligonucleotide
uguuggagcgaggcagag

SEQ ID NO: 4662 - RNA, 18 nt, Artificial Sequence
  Description of Artificial Sequence: Synthetic oligonucleotide
ccaaggcccgccaugcca

SEQ ID NO: 4663 - RNA, 18 nt, Artificial Sequence
  Description of Artificial Sequence: Synthetic oligonucleotide
ccgugccaaggcccgcca

SEQ ID NO: 4664 - RNA, 18 nt, Artificial Sequence
  Description of Artificial Sequence: Synthetic oligonucleotide
agagcccgugccaaggcc

SEQ ID NO: 4665 - RNA, 18 nt, Artificial Sequence
  Description of Artificial Sequence: Synthetic oligonucleotide
ggagcagagcccgugcca

SEQ ID NO: 4666 - RNA, 18 nt, Artificial Sequence
  Description of Artificial Sequence: Synthetic oligonucleotide
cagugggagcagagcccg

SEQ ID NO: 4667 - RNA, 18 nt, Artificial Sequence
  Description of Artificial Sequence: Synthetic oligonucleotide
caggccagugggagcaga

SEQ ID NO: 4668 - RNA, 18 nt, Artificial Sequence
  Description of Artificial Sequence: Synthetic oligonucleotide
agcaccaggccaguggga

SEQ ID NO: 4669 - RNA, 18 nt, Artificial Sequence
  Description of Artificial Sequence: Synthetic oligonucleotide
ccgggagcaccaggccag

SEQ ID NO: 4670 - RNA, 18 nt, Artificial Sequence
  Description of Artificial Sequence: Synthetic oligonucleotide
cgucaccgggagcaccag

SEQ ID NO: 4671 - RNA, 18 nt, Artificial Sequence
  Description of Artificial Sequence: Synthetic oligonucleotide
auugccgucaccgggagc

SEQ ID NO: 4672 - RNA, 18 nt, Artificial Sequence
  Description of Artificial Sequence: Synthetic oligonucleotide
gccacauugccgucaccg

SEQ ID NO: 4673 - RNA, 18 nt, Artificial Sequence
  Description of Artificial Sequence: Synthetic oligonucleotide
gaggagccacauugccgu

SEQ ID NO: 4674 - RNA, 18 nt, Artificial Sequence
  Description of Artificial Sequence: Synthetic oligonucleotide
gcagagaggagccacauu

SEQ ID NO: 4675 - RNA, 18 nt, Artificial Sequence
  Description of Artificial Sequence: Synthetic oligonucleotide
ccucagcagagaggagcc

SEQ ID NO: 4676 - RNA, 18 nt, Artificial Sequence
  Description of Artificial Sequence: Synthetic oligonucleotide
ggcgcccucagcagagag

SEQ ID NO: 4677 - RNA, 18 nt, Artificial Sequence
  Description of Artificial Sequence: Synthetic oligonucleotide
gugugggcgcccucagca

SEQ ID NO: 4678 - RNA, 18 nt, Artificial Sequence
  Description of Artificial Sequence: Synthetic oligonucleotide
cagccgugugggcgcccu

SEQ ID NO: 4679 - RNA, 18 nt, Artificial Sequence
  Description of Artificial Sequence: Synthetic oligonucleotide
acucccagccgugugggc

SEQ ID NO: 4680 - RNA, 18 nt, Artificial Sequence
  Description of Artificial Sequence: Synthetic oligonucleotide
ggaccacucccagccgug

SEQ ID NO: 4681 - RNA, 18 nt, Artificial Sequence
  Description of Artificial Sequence: Synthetic oligonucleotide
gccagggaccacucccag

SEQ ID NO: 4682 - RNA, 18 nt, Artificial Sequence
  Description of Artificial Sequence: Synthetic oligonucleotide
ggcaggccagggaccacu

SEQ ID NO: 4683 - RNA, 18 nt, Artificial Sequence
  Description of Artificial Sequence: Synthetic oligonucleotide
gcugaggcaggccaggga

SEQ ID NO: 4684 - RNA, 18 nt, Artificial Sequence
  Description of Artificial Sequence: Synthetic oligonucleotide
auggugcugaggcaggcc

SEQ ID NO: 4685 - RNA, 18 nt, Artificial Sequence
  Description of Artificial Sequence: Synthetic oligonucleotide
gaacaauggugcugaggc

SEQ ID NO: 4686 - RNA, 18 nt, Artificial Sequence
  Description of Artificial Sequence: Synthetic oligonucleotide
ccggagaacaauggugcu

SEQ ID NO: 4687 - RNA, 18 nt, Artificial Sequence
  Description of Artificial Sequence: Synthetic oligonucleotide
aaacaccggagaacaaug

SEQ ID NO: 4688 - RNA, 18 nt, Artificial Sequence
  Description of Artificial Sequence: Synthetic oligonucleotide
cucccaaacaccggagaa

SEQ ID NO: 4689 - RNA, 18 nt, Artificial Sequence
  Description of Artificial Sequence: Synthetic oligonucleotide
gccuccucccaaacaccg

SEQ ID NO: 4690 - RNA, 18 nt, Artificial Sequence
  Description of Artificial Sequence: Synthetic oligonucleotide
ggucagccuccucccaaa

SEQ ID NO: 4691 - RNA, 18 nt, Artificial Sequence
  Description of Artificial Sequence: Synthetic oligonucleotide
ccacgggucagccuccuc

SEQ ID NO: 4692 - RNA, 18 nt, Artificial Sequence
  Description of Artificial Sequence: Synthetic oligonucleotide
accucccacgggucagcc

SEQ ID NO: 4693 - RNA, 18 nt, Artificial Sequence
  Description of Artificial Sequence: Synthetic oligonucleotide
cagacaccucccacgggu

SEQ ID NO: 4694 - RNA, 18 nt, Artificial Sequence
  Description of Artificial Sequence: Synthetic oligonucleotide
cagggcagacaccuccca

SEQ ID NO: 4695 - RNA, 18 nt, Artificial Sequence
  Description of Artificial Sequence: Synthetic oligonucleotide
cugagcagggcagacacc

SEQ ID NO: 4696 - RNA, 18 nt, Artificial Sequence
  Description of Artificial Sequence: Synthetic oligonucleotide
gcuuccugagcagggcag

SEQ ID NO: 4697 - RNA, 18 nt, Artificial Sequence
  Description of Artificial Sequence: Synthetic oligonucleotide
ccccagcuuccugagcag

SEQ ID NO: 4698 - RNA, 18 nt, Artificial Sequence
  Description of Artificial Sequence: Synthetic oligonucleotide
gccagccccagcuuccug

SEQ ID NO: 4699 - RNA, 18 nt, Artificial Sequence
  Description of Artificial Sequence: Synthetic oligonucleotide
aagcugccagccccagcu

SEQ ID NO: 4700 - RNA, 18 nt, Artificial Sequence
  Description of Artificial Sequence: Synthetic oligonucleotide
uucugaagcugccagccc

SEQ ID NO: 4701 - RNA, 18 nt, Artificial Sequence
  Description of Artificial Sequence: Synthetic oligonucleotide
acugcuucugaagcugcc

SEQ ID NO: 4702 - RNA, 18 nt, Artificial Sequence
  Description of Artificial Sequence: Synthetic oligonucleotide
ccccuacugcuucugaag

SEQ ID NO: 4703 - RNA, 18 nt, Artificial Sequence
  Description of Artificial Sequence: Synthetic oligonucleotide
cagggccccuacugcuuc

SEQ ID NO: 4704 - RNA, 18 nt, Artificial Sequence
  Description of Artificial Sequence: Synthetic oligonucleotide
cuccacagggccccuacu

SEQ ID NO: 4705 - RNA, 18 nt, Artificial Sequence
  Description of Artificial Sequence: Synthetic oligonucleotide
agaggcuccacagggccc

SEQ ID NO: 4706 - RNA, 18 nt, Artificial Sequence
  Description of Artificial Sequence: Synthetic oligonucleotide
ugggcagaggcuccacag

SEQ ID NO: 4707 - RNA, 18 nt, Artificial Sequence
  Description of Artificial Sequence: Synthetic oligonucleotide
gaugcugggcagaggcuc

SEQ ID NO: 4708 - RNA, 18 nt, Artificial Sequence
  Description of Artificial Sequence: Synthetic oligonucleotide
cggaggaugcugggcaga

SEQ ID NO: 4709 - RNA, 18 nt, Artificial Sequence
  Description of Artificial Sequence: Synthetic oligonucleotide
ccccacggaggaugcugg

SEQ ID NO: 4710 - RNA, 18 nt, Artificial Sequence
  Description of Artificial Sequence: Synthetic oligonucleotide
ggacuccccacggaggau

SEQ ID NO: 4711 - RNA, 18 nt, Artificial Sequence
  Description of Artificial Sequence: Synthetic oligonucleotide
gugcuggacuccccacgg

SEQ ID NO: 4712 - RNA, 18 nt, Artificial Sequence
  Description of Artificial Sequence: Synthetic oligonucleotide
ccgcagugcuggacuccc

SEQ ID NO: 4713 - RNA, 18 nt, Artificial Sequence
  Description of Artificial Sequence: Synthetic oligonucleotide
ggagcccgcagugcugga

SEQ ID NO: 4714 - RNA, 18 nt, Artificial Sequence
  Description of Artificial Sequence: Synthetic oligonucleotide
cuccuggagcccgcagug

SEQ ID NO: 4715 - RNA, 18 nt, Artificial Sequence
  Description of Artificial Sequence: Synthetic oligonucleotide
agagccuccuggagcccg

SEQ ID NO: 4716 - RNA, 18 nt, Artificial Sequence
  Description of Artificial Sequence: Synthetic oligonucleotide
gccgcagagccuccugga

SEQ ID NO: 4717 - RNA, 18 nt, Artificial Sequence
  Description of Artificial Sequence: Synthetic oligonucleotide
aggcugccgcagagccuc

SEQ ID NO: 4718 - RNA, 18 nt, Artificial Sequence
  Description of Artificial Sequence: Synthetic oligonucleotide
gagggaggcugccgcaga

SEQ ID NO: 4719 - RNA, 18 nt, Artificial Sequence
  Description of Artificial Sequence: Synthetic oligonucleotide
gcagggagggaggcugcc

SEQ ID NO: 4720 - RNA, 18 nt, Artificial Sequence
  Description of Artificial Sequence: Synthetic oligonucleotide
cccaggcagggagggagg

SEQ ID NO: 4721 - RNA, 18 nt, Artificial Sequence
  Description of Artificial Sequence: Synthetic oligonucleotide
cugggcccaggcagggag

SEQ ID NO: 4722 - RNA, 18 nt, Artificial Sequence
  Description of Artificial Sequence: Synthetic oligonucleotide
caaaccugggcccaggca

SEQ ID NO: 4723 - RNA, 18 nt, Artificial Sequence
  Description of Artificial Sequence: Synthetic oligonucleotide
guguccaaaccugggccc

SEQ ID NO: 4724 - RNA, 18 nt, Artificial Sequence
  Description of Artificial Sequence: Synthetic oligonucleotide
cucagguguccaaaccug

SEQ ID NO: 4725 - RNA, 18 nt, Artificial Sequence
  Description of Artificial Sequence: Synthetic oligonucleotide
gcgggcucagguguccaa

SEQ ID NO: 4726 - RNA, 18 nt, Artificial Sequence
  Description of Artificial Sequence: Synthetic oligonucleotide
cgcaggcgggcucaggug

SEQ ID NO: 4727 - RNA, 18 nt, Artificial Sequence
  Description of Artificial Sequence: Synthetic oligonucleotide
gagugcgcaggcgggcuc

SEQ ID NO: 4728 - RNA, 18 nt, Artificial Sequence
  Description of Artificial Sequence: Synthetic oligonucleotide
gcccagagugcgcaggcg

SEQ ID NO: 4729 - RNA, 18 nt, Artificial Sequence
  Description of Artificial Sequence: Synthetic oligonucleotide
gggcccagagugcgcagg

SEQ ID NO: 4730 - RNA, 18 nt, Artificial Sequence
  Description of Artificial Sequence: Synthetic oligonucleotide
agcacggugccgaguggg

SEQ ID NO: 4731 - RNA, 18 nt, Artificial Sequence
  Description of Artificial Sequence: Synthetic oligonucleotide
cgagaagcacggugccga

SEQ ID NO: 4732 - RNA, 18 nt, Artificial Sequence
  Description of Artificial Sequence: Synthetic oligonucleotide
ccuggcgagaagcacggu

SEQ ID NO: 4733 - RNA, 18 nt, Artificial Sequence
  Description of Artificial Sequence: Synthetic oligonucleotide
gagggccuggcgagaagc

SEQ ID NO: 4734 - RNA, 18 nt, Artificial Sequence
  Description of Artificial Sequence: Synthetic oligonucleotide
agccagagggccuggcga

SEQ ID NO: 4735 - RNA, 18 nt, Artificial Sequence
  Description of Artificial Sequence: Synthetic oligonucleotide
ggaagagccagagggccu

SEQ ID NO: 4736 - RNA, 18 nt, Artificial Sequence
  Description of Artificial Sequence: Synthetic oligonucleotide
cacagggaagagccagag

SEQ ID NO: 4737 - RNA, 18 nt, Artificial Sequence
  Description of Artificial Sequence: Synthetic oligonucleotide
gcagccacagggaagagc

SEQ ID NO: 4738 - RNA, 18 nt, Artificial Sequence
  Description of Artificial Sequence: Synthetic oligonucleotide
caucugcagccacaggga

SEQ ID NO: 4739 - RNA, 18 nt, Artificial Sequence
  Description of Artificial Sequence: Synthetic oligonucleotide
agugccaucugcagccac

SEQ ID NO: 4740 - RNA, 18 nt, Artificial Sequence
  Description of Artificial Sequence: Synthetic oligonucleotide
cgcuaagugccaucugca

SEQ ID NO: 4741 - RNA, 18 nt, Artificial Sequence
  Description of Artificial Sequence: Synthetic oligonucleotide
uaggccgcuaagugccau

SEQ ID NO: 4742 - RNA, 18 nt, Artificial Sequence
  Description of Artificial Sequence: Synthetic oligonucleotide
cguccuaggccgcuaagu

SEQ ID NO: 4743 - RNA, 18 nt, Artificial Sequence
  Description of Artificial Sequence: Synthetic oligonucleotide
auagacguccuaggccgc

SEQ ID NO: 4744 - RNA, 18 nt, Artificial Sequence
  Description of Artificial Sequence: Synthetic oligonucleotide
cgugaauagacguccuag

SEQ ID NO: 4745 - RNA, 18 nt, Artificial Sequence
  Description of Artificial Sequence: Synthetic oligonucleotide
ccucccgugaauagacgu

SEQ ID NO: 4746 - RNA, 18 nt, Artificial Sequence
  Description of Artificial Sequence: Synthetic oligonucleotide
ucccuccucccgugaaua

SEQ ID NO: 4747 - RNA, 18 nt, Artificial Sequence
  Description of Artificial Sequence: Synthetic oligonucleotide
gugccucccuccucccgu

SEQ ID NO: 4748 - RNA, 18 nt, Artificial Sequence
  Description of Artificial Sequence: Synthetic oligonucleotide
gggcagugccucccuccu

SEQ ID NO: 4749 - RNA, 18 nt, Artificial Sequence
  Description of Artificial Sequence: Synthetic oligonucleotide
gaggagggcagugccucc

SEQ ID NO: 4750 - RNA, 18 nt, Artificial Sequence
  Description of Artificial Sequence: Synthetic oligonucleotide
gaccugaggagggcagug

SEQ ID NO: 4751 - RNA, 18 nt, Artificial Sequence
  Description of Artificial Sequence: Synthetic oligonucleotide
gggcagaccugaggaggg

SEQ ID NO: 4752 - RNA, 18 nt, Artificial Sequence
  Description of Artificial Sequence: Synthetic oligonucleotide
ugcuugggcagaccugag

SEQ ID NO: 4753 - RNA, 18 nt, Artificial Sequence
  Description of Artificial Sequence: Synthetic oligonucleotide
caagcugcuugggcagac

SEQ ID NO: 4754 - RNA, 18 nt, Artificial Sequence
  Description of Artificial Sequence: Synthetic oligonucleotide
agcuacaagcugcuuggg

SEQ ID NO: 4755 - RNA, 18 nt, Artificial Sequence
  Description of Artificial Sequence: Synthetic oligonucleotide
gugcuagcuacaagcugc

SEQ ID NO: 4756 - RNA, 18 nt, Artificial Sequence
  Description of Artificial Sequence: Synthetic oligonucleotide
gcccagugcuagcuacaa

SEQ ID NO: 4757 - RNA, 18 nt, Artificial Sequence
  Description of Artificial Sequence: Synthetic oligonucleotide
gggcccagugcuagcuac

SEQ ID NO: 4758 - RNA, 18 nt, Artificial Sequence
  Description of Artificial Sequence: Synthetic oligonucleotide
caaagcagcauuuccugu

SEQ ID NO: 4759 - RNA, 18 nt, Artificial Sequence
  Description of Artificial Sequence: Synthetic oligonucleotide
ggucccaaagcagcauuu

SEQ ID NO: 4760 - RNA, 18 nt, Artificial Sequence
  Description of Artificial Sequence: Synthetic oligonucleotide
ugggaggucccaaagcag

SEQ ID NO: 4761 - RNA, 18 nt, Artificial Sequence
  Description of Artificial Sequence: Synthetic oligonucleotide
gagggugggaggucccaa

SEQ ID NO: 4762 - RNA, 18 nt, Artificial Sequence
  Description of Artificial Sequence: Synthetic oligonucleotide
ggagagagggugggaggu

SEQ ID NO: 4763 - RNA, 18 nt, Artificial Sequence
  Description of Artificial Sequence: Synthetic oligonucleotide
gcuaaggagagagggugg

SEQ ID NO: 4764 - RNA, 18 nt, Artificial Sequence
  Description of Artificial Sequence: Synthetic oligonucleotide
gggacgcuaaggagagag

SEQ ID NO: 4765 - RNA, 18 nt, Artificial Sequence
  Description of Artificial Sequence: Synthetic oligonucleotide
gccagacccacagcuggg

SEQ ID NO: 4766 - RNA, 18 nt, Artificial Sequence
  Description of Artificial Sequence: Synthetic oligonucleotide
agccagacccacagcugg

SEQ ID NO: 4767 - RNA, 18 nt, Artificial Sequence
  Description of Artificial Sequence: Synthetic oligonucleotide
cuccaagccagacccaca

SEQ ID NO: 4768 - RNA, 18 nt, Artificial Sequence
  Description of Artificial Sequence: Synthetic oligonucleotide
uccaacuccaagccagac

SEQ ID NO: 4769 - RNA, 18 nt, Artificial Sequence
  Description of Artificial Sequence: Synthetic oligonucleotide
cacccuccaacuccaagc

SEQ ID NO: 4770 - RNA, 18 nt, Artificial Sequence
  Description of Artificial Sequence: Synthetic oligonucleotide
aggcucacccuccaacuc

SEQ ID NO: 4771 - RNA, 18 nt, Artificial Sequence
  Description of Artificial Sequence: Synthetic oligonucleotide
agcagaggcucacccucc

SEQ ID NO: 4772 - RNA, 18 nt, Artificial Sequence
  Description of Artificial Sequence: Synthetic oligonucleotide
ccaagagcagaggcucac

SEQ ID NO: 4773 - RNA, 18 nt, Artificial Sequence
  Description of Artificial Sequence: Synthetic oligonucleotide
ugcucccaagagcagagg

SEQ ID NO: 4774 - RNA, 18 nt, Artificial Sequence
  Description of Artificial Sequence: Synthetic oligonucleotide
cagacugcucccaagagc

SEQ ID NO: 4775 - RNA, 18 nt, Artificial Sequence
  Description of Artificial Sequence: Synthetic oligonucleotide
gcaaacagacugcuccca

SEQ ID NO: 4776 - RNA, 18 nt, Artificial Sequence
  Description of Artificial Sequence: Synthetic oligonucleotide
uguuugcaaacagacugc

SEQ ID NO: 4777 - RNA, 18 nt, Artificial Sequence
  Description of Artificial Sequence: Synthetic oligonucleotide
gucccuguuugcaaacag

SEQ ID NO: 4778 - RNA, 18 nt, Artificial Sequence
  Description of Artificial Sequence: Synthetic oligonucleotide
gggaagucccuguuugca

SEQ ID NO: 4779 - RNA, 18 nt, Artificial Sequence
  Description of Artificial Sequence: Synthetic oligonucleotide
gagacuccgugacguggg

SEQ ID NO: 4780 - RNA, 18 nt, Artificial Sequence
  Description of Artificial Sequence: Synthetic oligonucleotide
ugcggagacuccgugacg

SEQ ID NO: 4781 - RNA, 18 nt, Artificial Sequence
  Description of Artificial Sequence: Synthetic oligonucleotide
agagcugcggagacuccg

SEQ ID NO: 4782 - RNA, 18 nt, Artificial Sequence
  Description of Artificial Sequence: Synthetic oligonucleotide
cgaggagagcugcggaga

SEQ ID NO: 4783 - RNA, 18 nt, Artificial Sequence
  Description of Artificial Sequence: Synthetic oligonucleotide
guaaccgaggagagcugc

SEQ ID NO: 4784 - RNA, 18 nt, Artificial Sequence
  Description of Artificial Sequence: Synthetic oligonucleotide
cccucguaaccgaggaga

SEQ ID NO: 4785 - RNA, 18 nt, Artificial Sequence
  Description of Artificial Sequence: Synthetic oligonucleotide
accagcccucguaaccga

SEQ ID NO: 4786 - RNA, 18 nt, Artificial Sequence
  Description of Artificial Sequence: Synthetic oligonucleotide
cugaaaccagcccucgua

SEQ ID NO: 4787 - RNA, 18 nt, Artificial Sequence
  Description of Artificial Sequence: Synthetic oligonucleotide
ggagccugaaaccagccc

SEQ ID NO: 4788 - RNA, 18 nt, Artificial Sequence
  Description of Artificial Sequence: Synthetic oligonucleotide
gagcgggagccugaaacc

SEQ ID NO: 4789 - RNA, 18 nt, Artificial Sequence
  Description of Artificial Sequence: Synthetic oligonucleotide
uaaaagagcgggagccug

SEQ ID NO: 4790 - RNA, 18 nt, Artificial Sequence
  Description of Artificial Sequence: Synthetic oligonucleotide
agcucuaaaagagcggga

SEQ ID NO: 4791 - RNA, 18 nt, Artificial Sequence
  Description of Artificial Sequence: Synthetic oligonucleotide
gccucagcucuaaaagag

SEQ ID NO: 4792 - RNA, 18 nt, Artificial Sequence
  Description of Artificial Sequence: Synthetic oligonucleotide
gacgggccucagcucuaa

SEQ ID NO: 4793 - RNA, 18 nt, Artificial Sequence
  Description of Artificial Sequence: Synthetic oligonucleotide
cgcccgacgggccucagc

SEQ ID NO: 4794 - RNA, 18 nt, Artificial Sequence
  Description of Artificial Sequence: Synthetic oligonucleotide
cucuccgcccgacgggcc

SEQ ID NO: 4795 - RNA, 18 nt, Artificial Sequence
  Description of Artificial Sequence: Synthetic oligonucleotide
agacgcucuccgcccgac

SEQ ID NO: 4796 - RNA, 18 nt, Artificial Sequence
  Description of Artificial Sequence: Synthetic oligonucleotide
gggcaagacgcucuccgc

SEQ ID NO: 4797 - RNA, 18 nt, Artificial Sequence
  Description of Artificial Sequence: Synthetic oligonucleotide
gccuccagguaggcaggg

SEQ ID NO: 4798 - RNA, 18 nt, Artificial Sequence
  Description of Artificial Sequence: Synthetic oligonucleotide
gugccuccagguaggcag

SEQ ID NO: 4799 - RNA, 18 nt, Artificial Sequence
  Description of Artificial Sequence: Synthetic oligonucleotide
ccccugugccuccaggua

SEQ ID NO: 4800 - RNA, 18 nt, Artificial Sequence
  Description of Artificial Sequence: Synthetic oligonucleotide
agccaccccugugccucc

SEQ ID NO: 4801 - RNA, 18 nt, Artificial Sequence
  Description of Artificial Sequence: Synthetic oligonucleotide
ccagcagccaccccugug

SEQ ID NO: 4802 - RNA, 18 nt, Artificial Sequence
  Description of Artificial Sequence: Synthetic oligonucleotide
guccaccagcagccaccc

SEQ ID NO: 4803 - RNA, 18 nt, Artificial Sequence
  Description of Artificial Sequence: Synthetic oligonucleotide
cuaguguccaccagcagc

SEQ ID NO: 4804 - RNA, 18 nt, Artificial Sequence
  Description of Artificial Sequence: Synthetic oligonucleotide
ccacccuaguguccacca

SEQ ID NO: 4805 - RNA, 18 nt, Artificial Sequence
  Description of Artificial Sequence: Synthetic oligonucleotide
ucugcccacccuaguguc

SEQ ID NO: 4806 - RNA, 18 nt, Artificial Sequence
  Description of Artificial Sequence: Synthetic oligonucleotide
ucggcucugcccacccua

SEQ ID NO: 4807 - RNA, 18 nt, Artificial Sequence
  Description of Artificial Sequence: Synthetic oligonucleotide
ggcaaucggcucugccca

SEQ ID NO: 4808 - RNA, 18 nt, Artificial Sequence
  Description of Artificial Sequence: Synthetic oligonucleotide
gggcaggcaaucggcucu

SEQ ID NO: 4809 - RNA, 18 nt, Artificial Sequence
  Description of Artificial Sequence: Synthetic oligonucleotide
ggguugggcaggcaaucg

SEQ ID NO: 4810 - RNA, 18 nt, Artificial Sequence
  Description of Artificial Sequence: Synthetic oligonucleotide
ccugcaugagugcccggg

SEQ ID NO: 4811 - RNA, 18 nt, Artificial Sequence
  Description of Artificial Sequence: Synthetic oligonucleotide
uccugcaugagugcccgg

SEQ ID NO: 4812 - RNA, 18 nt, Artificial Sequence
  Description of Artificial Sequence: Synthetic oligonucleotide
gccucuccugcaugagug

SEQ ID NO: 4813 - RNA, 18 nt, Artificial Sequence
  Description of Artificial Sequence: Synthetic oligonucleotide
cacaggccucuccugcau

SEQ ID NO: 4814 - RNA, 18 nt, Artificial Sequence
  Description of Artificial Sequence: Synthetic oligonucleotide
cccgacacaggccucucc

SEQ ID NO: 4815 - RNA, 18 nt, Artificial Sequence
  Description of Artificial Sequence: Synthetic oligonucleotide
gugaccccgacacaggcc

SEQ ID NO: 4816 - RNA, 18 nt, Artificial Sequence
  Description of Artificial Sequence: Synthetic oligonucleotide
ugcacgugaccccgacac

SEQ ID NO: 4817 - RNA, 18 nt, Artificial Sequence
  Description of Artificial Sequence: Synthetic oligonucleotide
aggccugcacgugacccc

SEQ ID NO: 4818 - RNA, 18 nt, Artificial Sequence
  Description of Artificial Sequence: Synthetic oligonucleotide
ugggaaggccugcacgug

SEQ ID NO: 4819 - RNA, 18 nt, Artificial Sequence
  Description of Artificial Sequence: Synthetic oligonucleotide
gacgcugggaaggccugc

SEQ ID NO: 4820 - RNA, 18 nt, Artificial Sequence
  Description of Artificial Sequence: Synthetic oligonucleotide
gggaggacgcugggaagg

SEQ ID NO: 4821 - RNA, 18 nt, Artificial Sequence
  Description of Artificial Sequence: Synthetic oligonucleotide
gggcagggaggacgcugg

SEQ ID NO: 4822 - RNA, 18 nt, Artificial Sequence
  Description of Artificial Sequence: Synthetic oligonucleotide
cgagcgggcagggaggac

SEQ ID NO: 4823 - RNA, 18 nt, Artificial Sequence
  Description of Artificial Sequence: Synthetic oligonucleotide
uccaccgagcgggcaggg

SEQ ID NO: 4824 - RNA, 18 nt, Artificial Sequence
  Description of Artificial Sequence: Synthetic oligonucleotide
ugccauccaccgagcggg

SEQ ID NO: 4825 - RNA, 18 nt, Artificial Sequence
  Description of Artificial Sequence: Synthetic oligonucleotide
acugcugccauccaccga

SEQ ID NO: 4826 - RNA, 18 nt, Artificial Sequence
  Description of Artificial Sequence: Synthetic oligonucleotide
ugcuuacugcugccaucc

SEQ ID NO: 4827 - RNA, 18 nt, Artificial Sequence
  Description of Artificial Sequence: Synthetic oligonucleotide
ggcucugcuuacugcugc

SEQ ID NO: 4828 - RNA, 18 nt, Artificial Sequence
  Description of Artificial Sequence: Synthetic oligonucleotide
cccagggcucugcuuacu

SEQ ID NO: 4829 - RNA, 18 nt, Artificial Sequence
  Description of Artificial Sequence: Synthetic oligonucleotide
gccuccccagggcucugc

SEQ ID NO: 4830 - RNA, 18 nt, Artificial Sequence
  Description of Artificial Sequence: Synthetic oligonucleotide
ugcgagccuccccagggc

SEQ ID NO: 4831 - RNA, 18 nt, Artificial Sequence
  Description of Artificial Sequence: Synthetic oligonucleotide
agcccugcgagccucccc

SEQ ID NO: 4832 - RNA, 18 nt, Artificial Sequence
  Description of Artificial Sequence: Synthetic oligonucleotide
acagcagcccugcgagcc

SEQ ID NO: 4833 - RNA, 18 nt, Artificial Sequence
  Description of Artificial Sequence: Synthetic oligonucleotide
gagggacagcagcccugc

SEQ ID NO: 4834 - RNA, 18 nt, Artificial Sequence
  Description of Artificial Sequence: Synthetic oligonucleotide
gaccagagggacagcagc

SEQ ID NO: 4835 - RNA, 18 nt, Artificial Sequence
  Description of Artificial Sequence: Synthetic oligonucleotide
cuccugaccagagggaca

SEQ ID NO: 4836 - RNA, 18 nt, Artificial Sequence
  Description of Artificial Sequence: Synthetic oligonucleotide
gccuucuccugaccagag

SEQ ID NO: 4837 - RNA, 18 nt, Artificial Sequence
  Description of Artificial Sequence: Synthetic oligonucleotide
aaccagccuucuccugac

SEQ ID NO: 4838 - RNA, 18 nt, Artificial Sequence
  Description of Artificial Sequence: Synthetic oligonucleotide
ccgagaaccagccuucuc

SEQ ID NO: 4839 - RNA, 18 nt, Artificial Sequence
  Description of Artificial Sequence: Synthetic oligonucleotide
ggccuccgagaaccagcc

SEQ ID NO: 4840 - RNA, 18 nt, Artificial Sequence
  Description of Artificial Sequence: Synthetic oligonucleotide
gacguggccuccgagaac

SEQ ID NO: 4841 - RNA, 18 nt, Artificial Sequence
  Description of Artificial Sequence: Synthetic oligonucleotide
gcccugacguggccuccg

SEQ ID NO: 4842 - RNA, 18 nt, Artificial Sequence
  Description of Artificial Sequence: Synthetic oligonucleotide
cccuggcccugacguggc

SEQ ID NO: 4843 - RNA, 18 nt, Artificial Sequence
  Description of Artificial Sequence: Synthetic oligonucleotide
ccaggcccuggcccugac

SEQ ID NO: 4844 - RNA, 18 nt, Artificial Sequence
  Description of Artificial Sequence: Synthetic oligonucleotide
cugggccaggcccuggcc

SEQ ID NO: 4845 - RNA, 18 nt, Artificial Sequence
  Description of Artificial Sequence: Synthetic oligonucleotide
uccaugaccacggcggag

SEQ ID NO: 4846 - RNA, 18 nt, Artificial Sequence
  Description of Artificial Sequence: Synthetic oligonucleotide
ccuccuccaugaccacgg

SEQ ID NO: 4847 - RNA, 18 nt, Artificial Sequence
  Description of Artificial Sequence: Synthetic oligonucleotide
acuucccuccuccaugac

SEQ ID NO: 4848 - RNA, 18 nt, Artificial Sequence
  Description of Artificial Sequence: Synthetic oligonucleotide
cccggacuucccuccucc

SEQ ID NO: 4849 - RNA, 18 nt, Artificial Sequence
  Description of Artificial Sequence: Synthetic oligonucleotide
ccucgcccggacuucccu

SEQ ID NO: 4850 - RNA, 18 nt, Artificial Sequence
  Description of Artificial Sequence: Synthetic oligonucleotide
aggaaccucgcccggacu

SEQ ID NO: 4851 - RNA, 18 nt, Artificial Sequence
  Description of Artificial Sequence: Synthetic oligonucleotide
agcacaggaaccucgccc

SEQ ID NO: 4852 - RNA, 18 nt, Artificial Sequence
  Description of Artificial Sequence: Synthetic oligonucleotide
ccaccagcacaggaaccu

SEQ ID NO: 4853 - RNA, 18 nt, Artificial Sequence
  Description of Artificial Sequence: Synthetic oligonucleotide
gggcuccaccagcacagg

SEQ ID NO: 4854 - RNA, 18 nt, Artificial Sequence
  Description of Artificial Sequence: Synthetic oligonucleotide
ucaacguccuccaacccu

SEQ ID NO: 4855 - RNA, 18 nt, Artificial Sequence
  Description of Artificial Sequence: Synthetic oligonucleotide
cugccucaacguccucca

SEQ ID NO: 4856 - RNA, 18 nt, Artificial Sequence
  Description of Artificial Sequence: Synthetic oligonucleotide
uagcgcugccucaacguc

SEQ ID NO: 4857 - RNA, 18 nt, Artificial Sequence
  Description of Artificial Sequence: Synthetic oligonucleotide
augccuagcgcugccuca

SEQ ID NO: 4858 - RNA, 18 nt, Artificial Sequence
  Description of Artificial Sequence: Synthetic oligonucleotide
uguccaugccuagcgcug

SEQ ID NO: 4859 - RNA, 18 nt, Artificial Sequence
  Description of Artificial Sequence: Synthetic oligonucleotide
gcgccuguccaugccuag

SEQ ID NO: 4860 - RNA, 18 nt, Artificial Sequence
  Description of Artificial Sequence: Synthetic oligonucleotide
uccgugcgccuguccaug

SEQ ID NO: 4861 - RNA, 18 nt, Artificial Sequence
  Description of Artificial Sequence: Synthetic oligonucleotide
aggcauccgugcgccugu

SEQ ID NO: 4862 - RNA, 18 nt, Artificial Sequence
  Description of Artificial Sequence: Synthetic oligonucleotide
gcuguaggcauccgugcg

SEQ ID NO: 4863 - RNA, 18 nt, Artificial Sequence
  Description of Artificial Sequence: Synthetic oligonucleotide
agaggacauuggaccgca

SEQ ID NO: 4864 - RNA, 18 nt, Artificial Sequence
  Description of Artificial Sequence: Synthetic oligonucleotide
agacaagaggacauugga

SEQ ID NO: 4865 - RNA, 18 nt, Artificial Sequence
  Description of Artificial Sequence: Synthetic oligonucleotide
ucaaaagacaagaggaca

SEQ ID NO: 4866 - RNA, 18 nt, Artificial Sequence
  Description of Artificial Sequence: Synthetic oligonucleotide
ugucaucaaaagacaaga

SEQ ID NO: 4867 - RNA, 18 nt, Artificial Sequence
  Description of Artificial Sequence: Synthetic oligonucleotide
gaagcuguccuucucggg

SEQ ID NO: 4868 - RNA, 18 nt, Artificial Sequence
  Description of Artificial Sequence: Synthetic oligonucleotide
gcccugaagcuguccuuc

SEQ ID NO: 4869 - RNA, 18 nt, Artificial Sequence
  Description of Artificial Sequence: Synthetic oligonucleotide
uccgggcccugaagcugu

SEQ ID NO: 4870 - RNA, 18 nt, Artificial Sequence
  Description of Artificial Sequence: Synthetic oligonucleotide
aguacuccgggcccugaa

SEQ ID NO: 4871 - RNA, 18 nt, Artificial Sequence
  Description of Artificial Sequence: Synthetic oligonucleotide
agacuaguacuccgggcc

SEQ ID NO: 4872 - RNA, 18 nt, Artificial Sequence
  Description of Artificial Sequence: Synthetic oligonucleotide
cguugagacuaguacucc

SEQ ID NO: 4873 - RNA, 18 nt, Artificial Sequence
  Description of Artificial Sequence: Synthetic oligonucleotide
ucucucguugagacuagu

SEQ ID NO: 4874 - RNA, 18 nt, Artificial Sequence
  Description of Artificial Sequence: Synthetic oligonucleotide
uugggucucucguugaga

SEQ ID NO: 4875 - RNA, 18 nt, Artificial Sequence
  Description of Artificial Sequence: Synthetic oligonucleotide
aggcacacccccgcaggc

SEQ ID NO: 4876 - RNA, 18 nt, Artificial Sequence
  Description of Artificial Sequence: Synthetic oligonucleotide
acuccaggcacacccccg

SEQ ID NO: 4877 - RNA, 18 nt, Artificial Sequence
  Description of Artificial Sequence: Synthetic oligonucleotide
caccgacuccaggcacac

SEQ ID NO: 4878 - RNA, 18 nt, Artificial Sequence
  Description of Artificial Sequence: Synthetic oligonucleotide
ccccacaccgacuccagg

SEQ ID NO: 4879 - RNA, 18 nt, Artificial Sequence
  Description of Artificial Sequence: Synthetic oligonucleotide
ccccaccccacaccgacu

SEQ ID NO: 4880 - RNA, 18 nt, Artificial Sequence
  Description of Artificial Sequence: Synthetic oligonucleotide
uccuuccccaccccacac

SEQ ID NO: 4881 - RNA, 18 nt, Artificial Sequence
  Description of Artificial Sequence: Synthetic oligonucleotide
ccauguccuuccccaccc

SEQ ID NO: 4882 - RNA, 18 nt, Artificial Sequence
  Description of Artificial Sequence: Synthetic oligonucleotide
cagccccauguccuuccc

SEQ ID NO: 4883 - RNA, 18 nt, Artificial Sequence
  Description of Artificial Sequence: Synthetic oligonucleotide
ggccacagccccaugucc

SEQ ID NO: 4884 - RNA, 18 nt, Artificial Sequence
  Description of Artificial Sequence: Synthetic oligonucleotide
aggcaggccacagcccca

SEQ ID NO: 4885 - RNA, 18 nt, Artificial Sequence
  Description of Artificial Sequence: Synthetic oligonucleotide
ccgucaggcaggccacag

SEQ ID NO: 4886 - RNA, 18 nt, Artificial Sequence
  Description of Artificial Sequence: Synthetic oligonucleotide
aggcaccgucaggcaggc

SEQ ID NO: 4887 - RNA, 18 nt, Artificial Sequence
  Description of Artificial Sequence: Synthetic oligonucleotide
cuuggaggcaccgucagg

SEQ ID NO: 4888 - RNA, 18 nt, Artificial Sequence
  Description of Artificial Sequence: Synthetic oligonucleotide
acugacuuggaggcaccg

SEQ ID NO: 4889 - RNA, 18 nt, Artificial Sequence
  Description of Artificial Sequence: Synthetic oligonucleotide
cacucacugacuuggagg

SEQ ID NO: 4890 - RNA, 18 nt, Artificial Sequence
  Description of Artificial Sequence: Synthetic oligonucleotide
auuuccacucacugacuu

SEQ ID NO: 4891 - RNA, 18 nt, Artificial Sequence
  Description of Artificial Sequence: Synthetic oligonucleotide
gacccauuuccacucacu

SEQ ID NO: 4892 - RNA, 18 nt, Artificial Sequence
  Description of Artificial Sequence: Synthetic oligonucleotide
cacaggacccauuuccac

SEQ ID NO: 4893 - RNA, 18 nt, Artificial Sequence
  Description of Artificial Sequence: Synthetic oligonucleotide
gggcacacaggacccauu

SEQ ID NO: 4894 - RNA, 18 nt, Artificial Sequence
  Description of Artificial Sequence: Synthetic oligonucleotide
cuccagggcacacaggac

SEQ ID NO: 4895 - RNA, 18 nt, Artificial Sequence
  Description of Artificial Sequence: Synthetic oligonucleotide
acauacuccagggcacac

SEQ ID NO: 4896 - RNA, 18 nt, Artificial Sequence
  Description of Artificial Sequence: Synthetic oligonucleotide
gccucacauacuccaggg

SEQ ID NO: 4897 - RNA, 18 nt, Artificial Sequence
  Description of Artificial Sequence: Synthetic oligonucleotide
gcccugccucacauacuc

SEQ ID NO: 4898 - RNA, 18 nt, Artificial Sequence
  Description of Artificial Sequence: Synthetic oligonucleotide
guccugcccugccucaca

SEQ ID NO: 4899 - RNA, 18 nt, Artificial Sequence
  Description of Artificial Sequence: Synthetic oligonucleotide
ugcagguccugcccugcc

SEQ ID NO: 4900 - RNA, 18 nt, Artificial Sequence
  Description of Artificial Sequence: Synthetic oligonucleotide
gcccuugcagguccugcc

SEQ ID NO: 4901 - RNA, 18 nt, Artificial Sequence
  Description of Artificial Sequence: Synthetic oligonucleotide
uagcggcccuugcagguc

SEQ ID NO: 4902 - RNA, 18 nt, Artificial Sequence
  Description of Artificial Sequence: Synthetic oligonucleotide
gguguuagcggcccuugc

SEQ ID NO: 4903 - RNA, 18 nt, Artificial Sequence
  Description of Artificial Sequence: Synthetic oligonucleotide
ggguguuagcggcccuug

SEQ ID NO: 4904 - RNA, 18 nt, Artificial Sequence
  Description of Artificial Sequence: Synthetic oligonucleotide
cggccaaccugcugaggg

SEQ ID NO: 4905 - RNA, 18 nt, Artificial Sequence
  Description of Artificial Sequence: Synthetic oligonucleotide
caccacggccaaccugcu

SEQ ID NO: 4906 - RNA, 18 nt, Artificial Sequence
  Description of Artificial Sequence: Synthetic oligonucleotide
caggccaccacggccaac

SEQ ID NO: 4907 - RNA, 18 nt, Artificial Sequence
  Description of Artificial Sequence: Synthetic oligonucleotide
ggacccaggccaccacgg

SEQ ID NO: 4908 - RNA, 18 nt, Artificial Sequence
  Description of Artificial Sequence: Synthetic oligonucleotide
agcccggacccaggccac

SEQ ID NO: 4909 - RNA, 18 nt, Artificial Sequence
  Description of Artificial Sequence: Synthetic oligonucleotide
cacgcagcccggacccag

SEQ ID NO: 4910 - RNA, 18 nt, Artificial Sequence
  Description of Artificial Sequence: Synthetic oligonucleotide
uggcacacgcagcccgga

SEQ ID NO: 4911 - RNA, 18 nt, Artificial Sequence
  Description of Artificial Sequence: Synthetic oligonucleotide
gcccguggcacacgcagc

SEQ ID NO: 4912 - RNA, 18 nt, Artificial Sequence
  Description of Artificial Sequence: Synthetic oligonucleotide
uaggugcccguggcacac

SEQ ID NO: 4913 - RNA, 18 nt, Artificial Sequence
  Description of Artificial Sequence: Synthetic oligonucleotide
acaaguaggugcccgugg

SEQ ID NO: 4914 - RNA, 18 nt, Artificial Sequence
  Description of Artificial Sequence: Synthetic oligonucleotide
auuccacaaguaggugcc

SEQ ID NO: 4915 - RNA, 18 nt, Artificial Sequence
  Description of Artificial Sequence: Synthetic oligonucleotide
ccccaauuccacaaguag

SEQ ID NO: 4916 - RNA, 18 nt, Artificial Sequence
  Description of Artificial Sequence: Synthetic oligonucleotide
ccaacccccaauuccaca

SEQ ID NO: 4917 - RNA, 18 nt, Artificial Sequence
  Description of Artificial Sequence: Synthetic oligonucleotide
gcaccccaacccccaauu

SEQ ID NO: 4918 - RNA, 18 nt, Artificial Sequence
  Description of Artificial Sequence: Synthetic oligonucleotide
agcuugcaccccaacccc

SEQ ID NO: 4919 - RNA, 18 nt, Artificial Sequence
  Description of Artificial Sequence: Synthetic oligonucleotide
ccuaaagcuugcacccca

SEQ ID NO: 4920 - RNA, 18 nt, Artificial Sequence
  Description of Artificial Sequence: Synthetic oligonucleotide
aggcgccuaaagcuugca

SEQ ID NO: 4921 - RNA, 18 nt, Artificial Sequence
  Description of Artificial Sequence: Synthetic oligonucleotide
ggcucaggcgccuaaagc

SEQ ID NO: 4922 - RNA, 18 nt, Artificial Sequence
  Description of Artificial Sequence: Synthetic oligonucleotide
gggcucaggcgccuaaag

SEQ ID NO: 4923 - RNA, 18 nt, Artificial Sequence
  Description of Artificial Sequence: Synthetic oligonucleotide
ggccggcuccuucgaggg

SEQ ID NO: 4924 - RNA, 18 nt, Artificial Sequence
  Description of Artificial Sequence: Synthetic oligonucleotide
gacaaggccggcuccuuc

SEQ ID NO: 4925 - RNA, 18 nt, Artificial Sequence
  Description of Artificial Sequence: Synthetic oligonucleotide
ccccagacaaggccggcu

SEQ ID NO: 4926 - RNA, 18 nt, Artificial Sequence
  Description of Artificial Sequence: Synthetic oligonucleotide
ggcagccccagacaaggc

SEQ ID NO: 4927 - RNA, 18 nt, Artificial Sequence
  Description of Artificial Sequence: Synthetic oligonucleotide
gggcagccccagacaagg

SEQ ID NO: 4928 - RNA, 18 nt, Artificial Sequence
  Description of Artificial Sequence: Synthetic oligonucleotide
ggcuagcagcaggcuggg

SEQ ID NO: 4929 - RNA, 18 nt, Artificial Sequence
  Description of Artificial Sequence: Synthetic oligonucleotide
uccccggcuagcagcagg

SEQ ID NO: 4930 - RNA, 18 nt, Artificial Sequence
  Description of Artificial Sequence: Synthetic oligonucleotide
cagaguccccggcuagca

SEQ ID NO: 4931 - RNA, 18 nt, Artificial Sequence
  Description of Artificial Sequence: Synthetic oligonucleotide
ugaagcagaguccccggc

SEQ ID NO: 4932 - RNA, 18 nt, Artificial Sequence
  Description of Artificial Sequence: Synthetic oligonucleotide
ggugaugaagcagagucc

SEQ ID NO: 4933 - RNA, 18 nt, Artificial Sequence
  Description of Artificial Sequence: Synthetic oligonucleotide
gcggcggugaugaagcag

SEQ ID NO: 4934 - RNA, 18 nt, Artificial Sequence
  Description of Artificial Sequence: Synthetic oligonucleotide
gcaaggcggcggugauga

SEQ ID NO: 4935 - RNA, 18 nt, Artificial Sequence
  Description of Artificial Sequence: Synthetic oligonucleotide
guccggcaaggcggcggu

SEQ ID NO: 4936 - RNA, 18 nt, Artificial Sequence
  Description of Artificial Sequence: Synthetic oligonucleotide
uugcgguccggcaaggcg

SEQ ID NO: 4937 - RNA, 18 nt, Artificial Sequence
  Description of Artificial Sequence: Synthetic oligonucleotide
gcucuuugcgguccggca

SEQ ID NO: 4938 - RNA, 18 nt, Artificial Sequence
  Description of Artificial Sequence: Synthetic oligonucleotide
gcucagcucuuugcgguc

SEQ ID NO: 4939 - RNA, 18 nt, Artificial Sequence
  Description of Artificial Sequence: Synthetic oligonucleotide
ggcuggcucagcucuuug

SEQ ID NO: 4940 - RNA, 18 nt, Artificial Sequence
  Description of Artificial Sequence: Synthetic oligonucleotide
acagaggcuggcucagcu

SEQ ID NO: 4941 - RNA, 18 nt, Artificial Sequence
  Description of Artificial Sequence: Synthetic oligonucleotide
agaacacagaggcuggcu

SEQ ID NO: 4942 - RNA, 18 nt, Artificial Sequence
  Description of Artificial Sequence: Synthetic oligonucleotide
aaacaagaacacagaggc

SEQ ID NO: 4943 - RNA, 18 nt, Artificial Sequence
  Description of Artificial Sequence: Synthetic oligonucleotide
aaugcaaacaagaacaca

SEQ ID NO: 4944 - RNA, 18 nt, Artificial Sequence
  Description of Artificial Sequence: Synthetic oligonucleotide
aaugaaaugcaaacaaga

SEQ ID NO: 4945 - RNA, 18 nt, Artificial Sequence
  Description of Artificial Sequence: Synthetic oligonucleotide
guucaaaugaaaugcaaa

SEQ ID NO: 4946 - RNA, 18 nt, Artificial Sequence
  Description of Artificial Sequence: Synthetic oligonucleotide
aagccguucaaaugaaau

SEQ ID NO: 4947 - RNA, 18 nt, Artificial Sequence
  Description of Artificial Sequence: Synthetic oligonucleotide
ggagaaagccguucaaau

SEQ ID NO: 4948 - RNA, 18 nt, Artificial Sequence
  Description of Artificial Sequence: Synthetic oligonucleotide
caggaggagaaagccguu

SEQ ID NO: 4949 - RNA, 18 nt, Artificial Sequence
  Description of Artificial Sequence: Synthetic oligonucleotide
gggacaggaggagaaagc

SEQ ID NO: 4950 - RNA, 18 nt, Artificial Sequence
  Description of Artificial Sequence: Synthetic oligonucleotide
cucgggcaggaagguggg

SEQ ID NO: 4951 - RNA, 18 nt, Artificial Sequence
  Description of Artificial Sequence: Synthetic oligonucleotide
aauagcucgggcaggaag

SEQ ID NO: 4952 - RNA, 18 nt, Artificial Sequence
  Description of Artificial Sequence: Synthetic oligonucleotide
gccaaaauagcucgggca

SEQ ID NO: 4953 - RNA, 18 nt, Artificial Sequence
  Description of Artificial Sequence: Synthetic oligonucleotide
ggaaagccaaaauagcuc

SEQ ID NO: 4954 - RNA, 18 nt, Artificial Sequence
  Description of Artificial Sequence: Synthetic oligonucleotide
ucuagggaaagccaaaau

SEQ ID NO: 4955 - RNA, 18 nt, Artificial Sequence
  Description of Artificial Sequence: Synthetic oligonucleotide
ucccaucuagggaaagcc

SEQ ID NO: 4956 - RNA, 18 nt, Artificial Sequence
  Description of Artificial Sequence: Synthetic oligonucleotide
cguauucccaucuaggga

SEQ ID NO: 4957 - RNA, 18 nt, Artificial Sequence
  Description of Artificial Sequence: Synthetic oligonucleotide
aaugccguauucccaucu

SEQ ID NO: 4958 - RNA, 18 nt, Artificial Sequence
  Description of Artificial Sequence: Synthetic oligonucleotide
uggaaaaugccguauucc

SEQ ID NO: 4959 - RNA, 18 nt, Artificial Sequence
  Description of Artificial Sequence: Synthetic oligonucleotide
cacgcuggaaaaugccgu

SEQ ID NO: 4960 - RNA, 18 nt, Artificial Sequence
  Description of Artificial Sequence: Synthetic oligonucleotide
gaggucacgcuggaaaau

SEQ ID NO: 4961 - RNA, 18 nt, Artificial Sequence
  Description of Artificial Sequence: Synthetic oligonucleotide
gaguugaggucacgcugg

SEQ ID NO: 4962 - RNA, 18 nt, Artificial Sequence
  Description of Artificial Sequence: Synthetic oligonucleotide
cuuccgaguugaggucac

SEQ ID NO: 4963 - RNA, 18 nt, Artificial Sequence
  Description of Artificial Sequence: Synthetic oligonucleotide
auacaaauuucauagccc

SEQ ID NO: 4964 - RNA, 18 nt, Artificial Sequence
  Description of Artificial Sequence: Synthetic oligonucleotide
uucugauacaaauuucau

SEQ ID NO: 4965 - RNA, 18 nt, Artificial Sequence
  Description of Artificial Sequence: Synthetic oligonucleotide
guucauucugauacaaau

SEQ ID NO: 4966 - RNA, 18 nt, Artificial Sequence
  Description of Artificial Sequence: Synthetic oligonucleotide
ugggaguucauucugaua

SEQ ID NO: 4967 - RNA, 18 nt, Artificial Sequence
  Description of Artificial Sequence: Synthetic oligonucleotide
gcuuaugggaguucauuc

SEQ ID NO: 4968 - RNA, 18 nt, Artificial Sequence
  Description of Artificial Sequence: Synthetic oligonucleotide
aagaggcuuaugggaguu

SEQ ID NO: 4969 - RNA, 18 nt, Artificial Sequence
  Description of Artificial Sequence: Synthetic oligonucleotide
cagggaagaggcuuaugg

SEQ ID NO: 4970 - RNA, 18 nt, Artificial Sequence
  Description of Artificial Sequence: Synthetic oligonucleotide
agugacagggaagaggcu

SEQ ID NO: 4971 - RNA, 18 nt, Artificial Sequence
  Description of Artificial Sequence: Synthetic oligonucleotide
cacccagugacagggaag

SEQ ID NO: 4972 - RNA, 18 nt, Artificial Sequence
  Description of Artificial Sequence: Synthetic oligonucleotide
cuccacacccagugacag

SEQ ID NO: 4973 - RNA, 18 nt, Artificial Sequence
  Description of Artificial Sequence: Synthetic oligonucleotide
cugagcuccacacccagu

SEQ ID NO: 4974 - RNA, 18 nt, Artificial Sequence
  Description of Artificial Sequence: Synthetic oligonucleotide
gcugccugagcuccacac

SEQ ID NO: 4975 - RNA, 18 nt, Artificial Sequence
  Description of Artificial Sequence: Synthetic oligonucleotide
gagcggcugccugagcuc

SEQ ID NO: 4976 - RNA, 18 nt, Artificial Sequence
  Description of Artificial Sequence: Synthetic oligonucleotide
caggcgagcggcugccug

SEQ ID NO: 4977 - RNA, 18 nt, Artificial Sequence
  Description of Artificial Sequence: Synthetic oligonucleotide
ucaggcaggcgagcggcu

SEQ ID NO: 4978 - RNA, 18 nt, Artificial Sequence
  Description of Artificial Sequence: Synthetic oligonucleotide
cacccucaggcaggcgag

SEQ ID NO: 4979 - RNA, 18 nt, Artificial Sequence
  Description of Artificial Sequence: Synthetic oligonucleotide
accgucacccucaggcag

SEQ ID NO: 4980 - RNA, 18 nt, Artificial Sequence
  Description of Artificial Sequence: Synthetic oligonucleotide
cuuccaccgucacccuca

SEQ ID NO: 4981 - RNA, 18 nt, Artificial Sequence
  Description of Artificial Sequence: Synthetic oligonucleotide
guggccuuccaccgucac

SEQ ID NO: 4982 - RNA, 18 nt, Artificial Sequence
  Description of Artificial Sequence: Synthetic oligonucleotide
cccauguggccuuccacc

SEQ ID NO: 4983 - RNA, 18 nt, Artificial Sequence
  Description of Artificial Sequence: Synthetic oligonucleotide
ggauccccauguggccuu

SEQ ID NO: 4984 - RNA, 18 nt, Artificial Sequence
  Description of Artificial Sequence: Synthetic oligonucleotide
gucugggauccccaugug

SEQ ID NO: 4985 - RNA, 18 nt, Artificial Sequence
  Description of Artificial Sequence: Synthetic oligonucleotide
cagaggucugggaucccc

SEQ ID NO: 4986 - RNA, 18 nt, Artificial Sequence
  Description of Artificial Sequence: Synthetic oligonucleotide
gcacacagaggucuggga

SEQ ID NO: 4987 - RNA, 18 nt, Artificial Sequence
  Description of Artificial Sequence: Synthetic oligonucleotide
ggcaagcacacagagguc

SEQ ID NO: 4988 - RNA, 18 nt, Artificial Sequence
  Description of Artificial Sequence: Synthetic oligonucleotide
ccuccggcaagcacacag

SEQ ID NO: 4989 - RNA, 18 nt, Artificial Sequence
  Description of Artificial Sequence: Synthetic oligonucleotide
ggcugccuccggcaagca

SEQ ID NO: 4990 - RNA, 18 nt, Artificial Sequence
  Description of Artificial Sequence: Synthetic oligonucleotide
ccgcaggcugccuccggc

SEQ ID NO: 4991 - RNA, 18 nt, Artificial Sequence
  Description of Artificial Sequence: Synthetic oligonucleotide
ucugcccgcaggcugccu

SEQ ID NO: 4992 - RNA, 18 nt, Artificial Sequence
  Description of Artificial Sequence: Synthetic oligonucleotide
ugcauucugcccgcaggc

SEQ ID NO: 4993 - RNA, 18 nt, Artificial Sequence
  Description of Artificial Sequence: Synthetic oligonucleotide
cagauugcauucugcccg

SEQ ID NO: 4994 - RNA, 18 nt, Artificial Sequence
  Description of Artificial Sequence: Synthetic oligonucleotide
aggcccagauugcauucu

SEQ ID NO: 4995 - RNA, 18 nt, Artificial Sequence
  Description of Artificial Sequence: Synthetic oligonucleotide
cagacaggcccagauugc

SEQ ID NO: 4996 - RNA, 18 nt, Artificial Sequence
  Description of Artificial Sequence: Synthetic oligonucleotide
ccacacagacaggcccag

SEQ ID NO: 4997 - RNA, 18 nt, Artificial Sequence
  Description of Artificial Sequence: Synthetic oligonucleotide
ggaggccacacagacagg

SEQ ID NO: 4998 - RNA, 18 nt, Artificial Sequence
  Description of Artificial Sequence: Synthetic oligonucleotide
gaggcggaggccacacag

SEQ ID NO: 4999 - RNA, 18 nt, Artificial Sequence
  Description of Artificial Sequence: Synthetic oligonucleotide
gcagagaggcggaggcca

SEQ ID NO: 5000 - RNA, 18 nt, Artificial Sequence
  Description of Artificial Sequence: Synthetic oligonucleotide
gucaugcagagaggcgga

SEQ ID NO: 5001 - RNA, 18 nt, Artificial Sequence
  Description of Artificial Sequence: Synthetic oligonucleotide
guguagucaugcagagag

SEQ ID NO: 5002 - RNA, 18 nt, Artificial Sequence
  Description of Artificial Sequence: Synthetic oligonucleotide
aaacgguguagucaugca

SEQ ID NO: 5003 - RNA, 18 nt, Artificial Sequence
  Description of Artificial Sequence: Synthetic oligonucleotide
uggcgaaacgguguaguc

SEQ ID NO: 5004 - RNA, 18 nt, Artificial Sequence
  Description of Artificial Sequence: Synthetic oligonucleotide
ccuccuggcgaaacggug

SEQ ID NO: 5005 - RNA, 18 nt, Artificial Sequence
  Description of Artificial Sequence: Synthetic oligonucleotide
uacggccuccuggcgaaa

SEQ ID NO: 5006 - RNA, 18 nt, Artificial Sequence
  Description of Artificial Sequence: Synthetic oligonucleotide
uagguuacggccuccugg

SEQ ID NO: 5007 - RNA, 18 nt, Artificial Sequence
  Description of Artificial Sequence: Synthetic oligonucleotide
agcacuagguuacggccu

SEQ ID NO: 5008 - RNA, 18 nt, Artificial Sequence
  Description of Artificial Sequence: Synthetic oligonucleotide
acgggagcacuagguuac

SEQ ID NO: 5009 - RNA, 18 nt, Artificial Sequence
  Description of Artificial Sequence: Synthetic oligonucleotide
agcccacgggagcacuag

SEQ ID NO: 5010 - RNA, 18 nt, Artificial Sequence
  Description of Artificial Sequence: Synthetic oligonucleotide
accgaagcccacgggagc

SEQ ID NO: 5011 - RNA, 18 nt, Artificial Sequence
  Description of Artificial Sequence: Synthetic oligonucleotide
cccucaccgaagcccacg

SEQ ID NO: 5012 - RNA, 18 nt, Artificial Sequence
  Description of Artificial Sequence: Synthetic oligonucleotide
caucccccucaccgaagc

SEQ ID NO: 5013 - RNA, 18 nt, Artificial Sequence
  Description of Artificial Sequence: Synthetic oligonucleotide
accgacaucccccucacc

SEQ ID NO: 5014 - RNA, 18 nt, Artificial Sequence
  Description of Artificial Sequence: Synthetic oligonucleotide
uagagaccgacauccccc

SEQ ID NO: 5015 - RNA, 18 nt, Artificial Sequence
  Description of Artificial Sequence: Synthetic oligonucleotide
gaggcuagagaccgacau

SEQ ID NO: 5016 - RNA, 18 nt, Artificial Sequence
  Description of Artificial Sequence: Synthetic oligonucleotide
cucaggaggcuagagacc

SEQ ID NO: 5017 - RNA, 18 nt, Artificial Sequence
  Description of Artificial Sequence: Synthetic oligonucleotide
gcagacucaggaggcuag

SEQ ID NO: 5018 - RNA, 18 nt, Artificial Sequence
  Description of Artificial Sequence: Synthetic oligonucleotide
ucggagcagacucaggag

SEQ ID NO: 5019 - RNA, 18 nt, Artificial Sequence
  Description of Artificial Sequence: Synthetic oligonucleotide
acuggucggagcagacuc

SEQ ID NO: 5020 - RNA, 18 nt, Artificial Sequence
  Description of Artificial Sequence: Synthetic oligonucleotide
ggccuacuggucggagca

SEQ ID NO: 5021 - RNA, 18 nt, Artificial Sequence
  Description of Artificial Sequence: Synthetic oligonucleotide
gaccaggccuacuggucg

SEQ ID NO: 5022 - RNA, 18 nt, Artificial Sequence
  Description of Artificial Sequence: Synthetic oligonucleotide
gggaagaccaggccuacu

SEQ ID NO: 5023 - RNA, 18 nt, Artificial Sequence
  Description of Artificial Sequence: Synthetic oligonucleotide
auugucccagagaacggg

SEQ ID NO: 5024 - RNA, 18 nt, Artificial Sequence
  Description of Artificial Sequence: Synthetic oligonucleotide
ccacauugucccagagaa

SEQ ID NO: 5025 - RNA, 18 nt, Artificial Sequence
  Description of Artificial Sequence: Synthetic oligonucleotide
guggaccacauuguccca

SEQ ID NO: 5026 - RNA, 18 nt, Artificial Sequence
  Description of Artificial Sequence: Synthetic oligonucleotide
aucacguggaccacauug

SEQ ID NO: 5027 - RNA, 18 nt, Artificial Sequence
  Description of Artificial Sequence: Synthetic oligonucleotide
ugagaaucacguggacca

SEQ ID NO: 5028 - RNA, 18 nt, Artificial Sequence
  Description of Artificial Sequence: Synthetic oligonucleotide
cagcuugagaaucacgug

SEQ ID NO: 5029 - RNA, 18 nt, Artificial Sequence
  Description of Artificial Sequence: Synthetic oligonucleotide
agccucagcuugagaauc

SEQ ID NO: 5030 - RNA, 18 nt, Artificial Sequence
  Description of Artificial Sequence: Synthetic oligonucleotide
cagcgagccucagcuuga

SEQ ID NO: 5031 - RNA, 18 nt, Artificial Sequence
  Description of Artificial Sequence: Synthetic oligonucleotide
cggcccagcgagccucag

SEQ ID NO: 5032 - RNA, 18 nt, Artificial Sequence
  Description of Artificial Sequence: Synthetic oligonucleotide
gugggcggcccagcgagc

SEQ ID NO: 5033 - RNA, 18 nt, Artificial Sequence
  Description of Artificial Sequence: Synthetic oligonucleotide
agggcgugggcggcccag

SEQ ID NO: 5034 - RNA, 18 nt, Artificial Sequence
  Description of Artificial Sequence: Synthetic oligonucleotide
ccaacagggcgugggcgg

SEQ ID NO: 5035 - RNA, 18 nt, Artificial Sequence
  Description of Artificial Sequence: Synthetic oligonucleotide
agaccccaacagggcgug

SEQ ID NO: 5036 - RNA, 18 nt, Artificial Sequence
  Description of Artificial Sequence: Synthetic oligonucleotide
cggaaagaccccaacagg

SEQ ID NO: 5037 - RNA, 18 nt, Artificial Sequence
  Description of Artificial Sequence: Synthetic oligonucleotide
ucgcucggaaagacccca

SEQ ID NO: 5038 - RNA, 18 nt, Artificial Sequence
  Description of Artificial Sequence: Synthetic oligonucleotide
ggaccucgcucggaaaga

SEQ ID NO: 5039 - RNA, 18 nt, Artificial Sequence
  Description of Artificial Sequence: Synthetic oligonucleotide
gcugaggaccucgcucgg

SEQ ID NO: 5040 - RNA, 18 nt, Artificial Sequence
  Description of Artificial Sequence: Synthetic oligonucleotide
gcacggcugaggaccucg

SEQ ID NO: 5041 - RNA, 18 nt, Artificial Sequence
  Description of Artificial Sequence: Synthetic oligonucleotide
cgcaugcacggcugagga

SEQ ID NO: 5042 - RNA, 18 nt, Artificial Sequence
  Description of Artificial Sequence: Synthetic oligonucleotide
cucaacgcaugcacggcu

SEQ ID NO: 5043 - RNA, 18 nt, Artificial Sequence
  Description of Artificial Sequence: Synthetic oligonucleotide
caaagcucaacgcaugca

SEQ ID NO: 5044 - RNA, 18 nt, Artificial Sequence
  Description of Artificial Sequence: Synthetic oligonucleotide
agggccaaagcucaacgc

SEQ ID NO: 5045 - RNA, 18 nt, Artificial Sequence
  Description of Artificial Sequence: Synthetic oligonucleotide
caccaagggccaaagcuc

SEQ ID NO: 5046 - RNA, 18 nt, Artificial Sequence
  Description of Artificial Sequence: Synthetic oligonucleotide
ccuaucaccaagggccaa

SEQ ID NO: 5047 - RNA, 18 nt, Artificial Sequence
  Description of Artificial Sequence: Synthetic oligonucleotide
agccaccuaucaccaagg

SEQ ID NO: 5048 - RNA, 18 nt, Artificial Sequence
  Description of Artificial Sequence: Synthetic oligonucleotide
ggccgagccaccuaucac

SEQ ID NO: 5049 - RNA, 18 nt, Artificial Sequence
  Description of Artificial Sequence: Synthetic oligonucleotide
gggcgggccgagccaccu

SEQ ID NO: 5050 - RNA, 18 nt, Artificial Sequence
  Description of Artificial Sequence: Synthetic oligonucleotide
agguagggcgggccgagc

SEQ ID NO: 5051 - RNA, 18 nt, Artificial Sequence
  Description of Artificial Sequence: Synthetic oligonucleotide
gugccagguagggcgggc

SEQ ID NO: 5052 - RNA, 18 nt, Artificial Sequence
  Description of Artificial Sequence: Synthetic oligonucleotide
ucagggugccagguaggg

SEQ ID NO: 5053 - RNA, 18 nt, Artificial Sequence
  Description of Artificial Sequence: Synthetic oligonucleotide
cagggucagggugccagg

SEQ ID NO: 5054 - RNA, 18 nt, Artificial Sequence
  Description of Artificial Sequence: Synthetic oligonucleotide
gugaccagggucagggug

SEQ ID NO: 5055 - RNA, 18 nt, Artificial Sequence
  Description of Artificial Sequence: Synthetic oligonucleotide
gagggacgucuguauccu

SEQ ID NO: 5056 - RNA, 18 nt, Artificial Sequence
  Description of Artificial Sequence: Synthetic oligonucleotide
cuggugagggacgucugu

SEQ ID NO: 5057 - RNA, 18 nt, Artificial Sequence
  Description of Artificial Sequence: Synthetic oligonucleotide
uggcacuggugagggacg

SEQ ID NO: 5058 - RNA, 18 nt, Artificial Sequence
  Description of Artificial Sequence: Synthetic oligonucleotide
caagcuggcacuggugag

SEQ ID NO: 5059 - RNA, 18 nt, Artificial Sequence
  Description of Artificial Sequence: Synthetic oligonucleotide
gaccccaagcuggcacug

SEQ ID NO: 5060 - RNA, 18 nt, Artificial Sequence
  Description of Artificial Sequence: Synthetic oligonucleotide
cugcagaccccaagcugg

SEQ ID NO: 5061 - RNA, 18 nt, Artificial Sequence
  Description of Artificial Sequence: Synthetic oligonucleotide
cucaucugcagaccccaa

SEQ ID NO: 5062 - RNA, 18 nt, Artificial Sequence
  Description of Artificial Sequence: Synthetic oligonucleotide
gaguucucaucugcagac

SEQ ID NO: 5063 - RNA, 18 nt, Artificial Sequence
  Description of Artificial Sequence: Synthetic oligonucleotide
ccacggaguucucaucug

SEQ ID NO: 5064 - RNA, 18 nt, Artificial Sequence
  Description of Artificial Sequence: Synthetic oligonucleotide
cugggccacggaguucuc

SEQ ID NO: 5065 - RNA, 18 nt, Artificial Sequence
  Description of Artificial Sequence: Synthetic oligonucleotide
ucagccugggccacggag

SEQ ID NO: 5066 - RNA, 18 nt, Artificial Sequence
  Description of Artificial Sequence: Synthetic oligonucleotide
uaucgucagccugggcca

SEQ ID NO: 5067 - RNA, 18 nt, Artificial Sequence
  Description of Artificial Sequence: Synthetic oligonucleotide
caggcuaucgucagccug

SEQ ID NO: 5068 - RNA, 18 nt, Artificial Sequence
  Description of Artificial Sequence: Synthetic oligonucleotide
uuuuucaggcuaucguca

SEQ ID NO: 5069 - RNA, 18 nt, Artificial Sequence
  Description of Artificial Sequence: Synthetic oligonucleotide
ggagguuuuucaggcuau

SEQ ID NO: 5070 - RNA, 18 nt, Artificial Sequence
  Description of Artificial Sequence: Synthetic oligonucleotide
cagguggagguuuuucag

SEQ ID NO: 5071 - RNA, 18 nt, Artificial Sequence
  Description of Artificial Sequence: Synthetic oligonucleotide
agcuccagguggagguuu

SEQ ID NO: 5072 - RNA, 18 nt, Artificial Sequence
  Description of Artificial Sequence: Synthetic oligonucleotide
ccgugagcuccaggugga

SEQ ID NO: 5073 - RNA, 18 nt, Artificial Sequence
  Description of Artificial Sequence: Synthetic oligonucleotide
gguuuccgugagcuccag

SEQ ID NO: 5074 - RNA, 18 nt, Artificial Sequence
  Description of Artificial Sequence: Synthetic oligonucleotide
agacagguuuccgugagc

SEQ ID NO: 5075 - RNA, 18 nt, Artificial Sequence
  Description of Artificial Sequence: Synthetic oligonucleotide
uguccagacagguuuccg

SEQ ID NO: 5076 - RNA, 18 nt, Artificial Sequence
  Description of Artificial Sequence: Synthetic oligonucleotide
caucauguccagacaggu

SEQ ID NO: 5077 - RNA, 18 nt, Artificial Sequence
  Description of Artificial Sequence: Synthetic oligonucleotide
cgagccaucauguccaga

SEQ ID NO: 5078 - RNA, 18 nt, Artificial Sequence
  Description of Artificial Sequence: Synthetic oligonucleotide
cguaucgagccaucaugu

SEQ ID NO: 5079 - RNA, 18 nt, Artificial Sequence
  Description of Artificial Sequence: Synthetic oligonucleotide
gaagacguaucgagccau

SEQ ID NO: 5080 - RNA, 18 nt, Artificial Sequence
  Description of Artificial Sequence: Synthetic oligonucleotide
uuggagaagacguaucga

SEQ ID NO: 5081 - RNA, 18 nt, Artificial Sequence
  Description of Artificial Sequence: Synthetic oligonucleotide
ugaaguuggagaagacgu

SEQ ID NO: 5082 - RNA, 18 nt, Artificial Sequence
  Description of Artificial Sequence: Synthetic oligonucleotide
agccgugaaguuggagaa

SEQ ID NO: 5083 - RNA, 18 nt, Artificial Sequence
  Description of Artificial Sequence: Synthetic oligonucleotide
gggacagccgugaaguug

SEQ ID NO: 5084 - RNA, 18 nt, Artificial Sequence
  Description of Artificial Sequence: Synthetic oligonucleotide
ucuucgggacagccguga

SEQ ID NO: 5085 - RNA, 18 nt, Artificial Sequence
  Description of Artificial Sequence: Synthetic oligonucleotide
cacauuccaugcucaguu

SEQ ID NO: 5086 - RNA, 18 nt, Artificial Sequence
  Description of Artificial Sequence: Synthetic oligonucleotide
gaggccacauuccaugcu

SEQ ID NO: 5087 - RNA, 18 nt, Artificial Sequence
  Description of Artificial Sequence: Synthetic oligonucleotide
uuguugaggccacauucc

SEQ ID NO: 5088 - RNA, 18 nt, Artificial Sequence
  Description of Artificial Sequence: Synthetic oligonucleotide
ugcgauuguugaggccac

SEQ ID NO: 5089 - RNA, 18 nt, Artificial Sequence
  Description of Artificial Sequence: Synthetic oligonucleotide
ccggaugcgauuguugag

SEQ ID NO: 5090 - RNA, 18 nt, Artificial Sequence
  Description of Artificial Sequence: Synthetic oligonucleotide
aucauccggaugcgauug

SEQ ID NO: 5091 - RNA, 18 nt, Artificial Sequence
  Description of Artificial Sequence: Synthetic oligonucleotide
gcccuaucauccggaugc

SEQ ID NO: 5092 - RNA, 18 nt, Artificial Sequence
  Description of Artificial Sequence: Synthetic oligonucleotide
aaucugcccuaucauccg

SEQ ID NO: 5093 - RNA, 18 nt, Artificial Sequence
  Description of Artificial Sequence: Synthetic oligonucleotide
ucacaaaucugcccuauc

SEQ ID NO: 5094 - RNA, 18 nt, Artificial Sequence
  Description of Artificial Sequence: Synthetic oligonucleotide
cgacuucacaaaucugcc

SEQ ID NO: 5095 - RNA, 18 nt, Artificial Sequence
  Description of Artificial Sequence: Synthetic oligonucleotide
uuuugcgacuucacaaau

SEQ ID NO: 5096 - RNA, 18 nt, Artificial Sequence
  Description of Artificial Sequence: Synthetic oligonucleotide
uugguuuuugcgacuuca

SEQ ID NO: 5097 - RNA, 18 nt, Artificial Sequence
  Description of Artificial Sequence: Synthetic oligonucleotide
auuucuugguuuuugcga

SEQ ID NO: 5098 - RNA, 18 nt, Artificial Sequence
  Description of Artificial Sequence: Synthetic oligonucleotide
uucaaauuucuugguuuu

SEQ ID NO: 5099 - RNA, 18 nt, Artificial Sequence
  Description of Artificial Sequence: Synthetic oligonucleotide
guagcucaacuggauaaa

SEQ ID NO: 5100 - RNA, 18 nt, Artificial Sequence
  Description of Artificial Sequence: Synthetic oligonucleotide
cucuaguagcucaacugg

SEQ ID NO: 5101 - RNA, 18 nt, Artificial Sequence
  Description of Artificial Sequence: Synthetic oligonucleotide
ccucucucuaguagcuca

SEQ ID NO: 5102 - RNA, 18 nt, Artificial Sequence
  Description of Artificial Sequence: Synthetic oligonucleotide
acgugccucucucuagua

SEQ ID NO: 5103 - RNA, 18 nt, Artificial Sequence
  Description of Artificial Sequence: Synthetic oligonucleotide
agucuacgugccucucuc

SEQ ID NO: 5104 - RNA, 18 nt, Artificial Sequence
  Description of Artificial Sequence: Synthetic oligonucleotide
ugaauagucuacgugccu

SEQ ID NO: 5105 - RNA, 18 nt, Artificial Sequence
  Description of Artificial Sequence: Synthetic oligonucleotide
ggcucugaauagucuacg

SEQ ID NO: 5106 - RNA, 18 nt, Artificial Sequence
  Description of Artificial Sequence: Synthetic oligonucleotide
acucaggcucugaauagu

SEQ ID NO: 5107 - RNA, 18 nt, Artificial Sequence
  Description of Artificial Sequence: Synthetic oligonucleotide
agcaaacucaggcucuga

SEQ ID NO: 5108 - RNA, 18 nt, Artificial Sequence
  Description of Artificial Sequence: Synthetic oligonucleotide
aaaaaagcaaacucaggc

SEQ ID NO: 5109 - RNA, 18 nt, Artificial Sequence
  Description of Artificial Sequence: Synthetic oligonucleotide
uccuaaaaaaagcaaacu

SEQ ID NO: 5110 - RNA, 18 nt, Artificial Sequence
  Description of Artificial Sequence: Synthetic oligonucleotide
cauguuccuaaaaaaagc

SEQ ID NO: 5111 - RNA, 18 nt, Artificial Sequence
  Description of Artificial Sequence: Synthetic oligonucleotide
ucaaccauguuccuaaaa

SEQ ID NO: 5112 - RNA, 18 nt, Artificial Sequence
  Description of Artificial Sequence: Synthetic oligonucleotide
agcugucaaccauguucc

SEQ ID NO: 5113 - RNA, 18 nt, Artificial Sequence
  Description of Artificial Sequence: Synthetic oligonucleotide
cagucagcugucaaccau

SEQ ID NO: 5114 - RNA, 18 nt, Artificial Sequence
  Description of Artificial Sequence: Synthetic oligonucleotide
aucggcagucagcuguca

SEQ ID NO: 5115 - RNA, 18 nt, Artificial Sequence
  Description of Artificial Sequence: Synthetic oligonucleotide
agaucaucggcagucagc

SEQ ID NO: 5116 - RNA, 18 nt, Artificial Sequence
  Description of Artificial Sequence: Synthetic oligonucleotide
aaaccagaucaucggcag

SEQ ID NO: 5117 - RNA, 18 nt, Artificial Sequence
  Description of Artificial Sequence: Synthetic oligonucleotide
agugcaaaccagaucauc

SEQ ID NO: 5118 - RNA, 18 nt, Artificial Sequence
  Description of Artificial Sequence: Synthetic oligonucleotide
aaaaaagugcaaaccaga

SEQ ID NO: 5119 - RNA, 18 nt, Artificial Sequence
  Description of Artificial Sequence: Synthetic oligonucleotide
aaaaaaaaaaagugcaaa

SEQ ID NO: 5120 - RNA, 18 nt, Artificial Sequence
  Description of Artificial Sequence: Synthetic oligonucleotide
aaaaaaaaaaaaaaaagu

SEQ ID NO: 5121 - RNA, 18 nt, Artificial Sequence
  Description of Artificial Sequence: Synthetic oligonucleotide
aaaaaaaaaaaaaaaaaa

SEQ ID NO: 5122 - RNA, 18 nt, Artificial Sequence
  Description of Artificial Sequence: Synthetic oligonucleotide
aucucaaaaaaaaaaaaa

SEQ ID NO: 5123 - RNA, 18 nt, Artificial Sequence
  Description of Artificial Sequence: Synthetic oligonucleotide
acuccaucucaaaaaaaa

SEQ ID NO: 5124 - RNA, 18 nt, Artificial Sequence
  Description of Artificial Sequence: Synthetic oligonucleotide
gcaagacuccaucucaaa

SEQ ID NO: 5125 - RNA, 18 nt, Artificial Sequence
  Description of Artificial Sequence: Synthetic oligonucleotide
acagagcaagacuccauc

SEQ ID NO: 5126 - RNA, 18 nt, Artificial Sequence
  Description of Artificial Sequence: Synthetic oligonucleotide
gggcgacagagcaagacu

SEQ ID NO: 5127 - RNA, 18 nt, Artificial Sequence
  Description of Artificial Sequence: Synthetic oligonucleotide
agccugggcgacagagca

SEQ ID NO: 5128 - RNA, 18 nt, Artificial Sequence
  Description of Artificial Sequence: Synthetic oligonucleotide
gugccagccugggcgaca

SEQ ID NO: 5129 - RNA, 18 nt, Artificial Sequence
  Description of Artificial Sequence: Synthetic oligonucleotide
agauugugccagccuggg

SEQ ID NO: 5130 - RNA, 18 nt, Artificial Sequence
  Description of Artificial Sequence: Synthetic oligonucleotide
agccaagauugugccagc

SEQ ID NO: 5131 - RNA, 18 nt, Artificial Sequence
  Description of Artificial Sequence: Synthetic oligonucleotide
cagugagccaagauugug

SEQ ID NO: 5132 - RNA, 18 nt, Artificial Sequence
  Description of Artificial Sequence: Synthetic oligonucleotide
ggcugcagugagccaaga

SEQ ID NO: 5133 - RNA, 18 nt, Artificial Sequence
  Description of Artificial Sequence: Synthetic oligonucleotide
gcagaggcugcagugagc

SEQ ID NO: 5134 - RNA, 18 nt, Artificial Sequence
  Description of Artificial Sequence: Synthetic oligonucleotide
aggaggcagaggcugcag

SEQ ID NO: 5135 - RNA, 18 nt, Artificial Sequence
  Description of Artificial Sequence: Synthetic oligonucleotide
aacccaggaggcagaggc

SEQ ID NO: 5136 - RNA, 18 nt, Artificial Sequence
  Description of Artificial Sequence: Synthetic oligonucleotide
gcuugaacccaggaggca

SEQ ID NO: 5137 - RNA, 18 nt, Artificial Sequence
  Description of Artificial Sequence: Synthetic oligonucleotide
gaacugcuugaacccagg

SEQ ID NO: 5138 - RNA, 18 nt, Artificial Sequence
  Description of Artificial Sequence: Synthetic oligonucleotide
caggagaacugcuugaac

SEQ ID NO: 5139 - RNA, 18 nt, Artificial Sequence
  Description of Artificial Sequence: Synthetic oligonucleotide
ugaggcaggagaacugcu

SEQ ID NO: 5140 - RNA, 18 nt, Artificial Sequence
  Description of Artificial Sequence: Synthetic oligonucleotide
gaggcugaggcaggagaa

SEQ ID NO: 5141 - RNA, 18 nt, Artificial Sequence
  Description of Artificial Sequence: Synthetic oligonucleotide
cucaggaggcugaggcag

SEQ ID NO: 5142 - RNA, 18 nt, Artificial Sequence
  Description of Artificial Sequence: Synthetic oligonucleotide
agcuacucaggaggcuga

SEQ ID NO: 5143 - RNA, 18 nt, Artificial Sequence
  Description of Artificial Sequence: Synthetic oligonucleotide
aucccagcuacucaggag

SEQ ID NO: 5144 - RNA, 18 nt, Artificial Sequence
  Description of Artificial Sequence: Synthetic oligonucleotide
cuguaaucccagcuacuc

SEQ ID NO: 5145 - RNA, 18 nt, Artificial Sequence
  Description of Artificial Sequence: Synthetic oligonucleotide
cgugccuguaaucccagc

SEQ ID NO: 5146 - RNA, 18 nt, Artificial Sequence
  Description of Artificial Sequence: Synthetic oligonucleotide
uggcgcgugccuguaauc

SEQ ID NO: 5147 - RNA, 18 nt, Artificial Sequence
  Description of Artificial Sequence: Synthetic oligonucleotide
ugugguggcgcgugccug

SEQ ID NO: 5148 - RNA, 18 nt, Artificial Sequence
  Description of Artificial Sequence: Synthetic oligonucleotide
ccgggugugguggcgcgu

SEQ ID NO: 5149 - RNA, 18 nt, Artificial Sequence
  Description of Artificial Sequence: Synthetic oligonucleotide
aaaagccggguguggugg

SEQ ID NO: 5150 - RNA, 18 nt, Artificial Sequence
  Description of Artificial Sequence: Synthetic oligonucleotide
auacaaaaagccgggugu

SEQ ID NO: 5151 - RNA, 18 nt, Artificial Sequence
  Description of Artificial Sequence: Synthetic oligonucleotide
uaaaaauacaaaaagccg

SEQ ID NO: 5152 - RNA, 18 nt, Artificial Sequence
  Description of Artificial Sequence: Synthetic oligonucleotide
ucuacuaaaaauacaaaa

SEQ ID NO: 5153 - RNA, 18 nt, Artificial Sequence
  Description of Artificial Sequence: Synthetic oligonucleotide
ccgucucuacuaaaaaua

SEQ ID NO: 5154 - RNA, 18 nt, Artificial Sequence
  Description of Artificial Sequence: Synthetic oligonucleotide
aaaccccgucucuacuaa

SEQ ID NO: 5155 - RNA, 18 nt, Artificial Sequence
  Description of Artificial Sequence: Synthetic oligonucleotide
uggcgaaaccccgucucu

SEQ ID NO: 5156 - RNA, 18 nt, Artificial Sequence
  Description of Artificial Sequence: Synthetic oligonucleotide
caacauggcgaaaccccg

SEQ ID NO: 5157 - RNA, 18 nt, Artificial Sequence
  Description of Artificial Sequence: Synthetic oligonucleotide
cuggccaacauggcgaaa

SEQ ID NO: 5158 - RNA, 18 nt, Artificial Sequence
  Description of Artificial Sequence: Synthetic oligonucleotide
ccagccuggccaacaugg

SEQ ID NO: 5159 - RNA, 18 nt, Artificial Sequence
  Description of Artificial Sequence: Synthetic oligonucleotide
caagaccagccuggccaa

SEQ ID NO: 5160 - RNA, 18 nt, Artificial Sequence
  Description of Artificial Sequence: Synthetic oligonucleotide
gaguucaagaccagccug

SEQ ID NO: 5161 - RNA, 18 nt, Artificial Sequence
  Description of Artificial Sequence: Synthetic oligonucleotide
gucaggaguucaagacca

SEQ ID NO: 5162 - RNA, 18 nt, Artificial Sequence
  Description of Artificial Sequence: Synthetic oligonucleotide
acgaggucaggaguucaa

SEQ ID NO: 5163 - RNA, 18 nt, Artificial Sequence
  Description of Artificial Sequence: Synthetic oligonucleotide
gguucacgaggucaggag

SEQ ID NO: 5164 - RNA, 18 nt, Artificial Sequence
  Description of Artificial Sequence: Synthetic oligonucleotide
cauaugguucacgagguc

SEQ ID NO: 5165 - RNA, 18 nt, Artificial Sequence
  Description of Artificial Sequence: Synthetic oligonucleotide
ugaggcauaugguucacg

SEQ ID NO: 5166 - RNA, 18 nt, Artificial Sequence
  Description of Artificial Sequence: Synthetic oligonucleotide
gaggcugaggcauauggu

SEQ ID NO: 5167 - RNA, 18 nt, Artificial Sequence
  Description of Artificial Sequence: Synthetic oligonucleotide
uuugggaggcugaggcau

SEQ ID NO: 5168 - RNA, 18 nt, Artificial Sequence
  Description of Artificial Sequence: Synthetic oligonucleotide
agcacuuugggaggcuga

SEQ ID NO: 5169 - RNA, 18 nt, Artificial Sequence
  Description of Artificial Sequence: Synthetic oligonucleotide
aucccagcacuuugggag

SEQ ID NO: 5170 - RNA, 18 nt, Artificial Sequence
  Description of Artificial Sequence: Synthetic oligonucleotide
cuguaaucccagcacuuu

SEQ ID NO: 5171 - RNA, 18 nt, Artificial Sequence
  Description of Artificial Sequence: Synthetic oligonucleotide
cacgccuguaaucccagc

SEQ ID NO: 5172 - RNA, 18 nt, Artificial Sequence
  Description of Artificial Sequence: Synthetic oligonucleotide
uggcucacgccuguaauc

SEQ ID NO: 5173 - RNA, 18 nt, Artificial Sequence
  Description of Artificial Sequence: Synthetic oligonucleotide
cgcaguggcucacgccug

SEQ ID NO: 5174 - RNA, 18 nt, Artificial Sequence
  Description of Artificial Sequence: Synthetic oligonucleotide
cugggcgcaguggcucac

SEQ ID NO: 5175 - RNA, 18 nt, Artificial Sequence
  Description of Artificial Sequence: Synthetic oligonucleotide
acuggcugggcgcagugg

SEQ ID NO: 5176 - RNA, 18 nt, Artificial Sequence
  Description of Artificial Sequence: Synthetic oligonucleotide
ugcaaacuggcugggcgc

SEQ ID NO: 5177 - RNA, 18 nt, Artificial Sequence
  Description of Artificial Sequence: Synthetic oligonucleotide
aacagugcaaacuggcug

SEQ ID NO: 5178 - RNA, 18 nt, Artificial Sequence
  Description of Artificial Sequence: Synthetic oligonucleotide
ccuaaaacagugcaaacu

SEQ ID NO: 5179 - RNA, 18 nt, Artificial Sequence
  Description of Artificial Sequence: Synthetic oligonucleotide
auuccccuaaaacagugc

SEQ ID NO: 5180 - RNA, 18 nt, Artificial Sequence
  Description of Artificial Sequence: Synthetic oligonucleotide
gcuaaauuccccuaaaac

SEQ ID NO: 5181 - RNA, 18 nt, Artificial Sequence
  Description of Artificial Sequence: Synthetic oligonucleotide
ugaaagcuaaauuccccu

SEQ ID NO: 5182 - RNA, 18 nt, Artificial Sequence
  Description of Artificial Sequence: Synthetic oligonucleotide
uacgaugaaagcuaaauu

SEQ ID NO: 5183 - RNA, 18 nt, Artificial Sequence
  Description of Artificial Sequence: Synthetic oligonucleotide
aucacuacgaugaaagcu

SEQ ID NO: 5184 - RNA, 18 nt, Artificial Sequence
  Description of Artificial Sequence: Synthetic oligonucleotide
uccccaucacuacgauga

SEQ ID NO: 5185 - RNA, 18 nt, Artificial Sequence
  Description of Artificial Sequence: Synthetic oligonucleotide
uagcuuccccaucacuac

SEQ ID NO: 5186 - RNA, 18 nt, Artificial Sequence
  Description of Artificial Sequence: Synthetic oligonucleotide
uccaguagcuuccccauc

SEQ ID NO: 5187 - RNA, 18 nt, Artificial Sequence
  Description of Artificial Sequence: Synthetic oligonucleotide
gcauuuccaguagcuucc

SEQ ID NO: 5188 - RNA, 18 nt, Artificial Sequence
  Description of Artificial Sequence: Synthetic oligonucleotide
gggcauuuccaguagcuu

SEQ ID NO: 5189 - RNA, 18 nt, Artificial Sequence
  Description of Artificial Sequence: Synthetic oligonucleotide
cucaagguuguauucggg

SEQ ID NO: 5190 - RNA, 18 nt, Artificial Sequence
  Description of Artificial Sequence: Synthetic oligonucleotide
ggucccucaagguuguau

SEQ ID NO: 5191 - RNA, 18 nt, Artificial Sequence
  Description of Artificial Sequence: Synthetic oligonucleotide
ugauuggucccucaaggu

SEQ ID NO: 5192 - RNA, 18 nt, Artificial Sequence
  Description of Artificial Sequence: Synthetic oligonucleotide
acgcuugauuggucccuc

SEQ ID NO: 5193 - RNA, 18 nt, Artificial Sequence
  Description of Artificial Sequence: Synthetic oligonucleotide
uuuccacgcuugauuggu

SEQ ID NO: 5194 - RNA, 18 nt, Artificial Sequence
  Description of Artificial Sequence: Synthetic oligonucleotide
ccccauuuccacgcuuga

SEQ ID NO: 5195 - RNA, 18 nt, Artificial Sequence
  Description of Artificial Sequence: Synthetic oligonucleotide
uugcuccccauuuccacg

SEQ ID NO: 5196 - RNA, 18 nt, Artificial Sequence
  Description of Artificial Sequence: Synthetic oligonucleotide
ucccuuugcuccccauuu

SEQ ID NO: 5197 - RNA, 18 nt, Artificial Sequence
  Description of Artificial Sequence: Synthetic oligonucleotide
gggaguggccccgaaagg

SEQ ID NO: 5198 - RNA, 18 nt, Artificial Sequence
  Description of Artificial Sequence: Synthetic oligonucleotide
ggaaugcagugagcaggg

SEQ ID NO: 5199 - RNA, 18 nt, Artificial Sequence
  Description of Artificial Sequence: Synthetic oligonucleotide
agauggaaugcagugagc

SEQ ID NO: 5200 - RNA, 18 nt, Artificial Sequence
  Description of Artificial Sequence: Synthetic oligonucleotide
agcacagauggaaugcag

SEQ ID NO: 5201 - RNA, 18 nt, Artificial Sequence
  Description of Artificial Sequence: Synthetic oligonucleotide
agaccagcacagauggaa

SEQ ID NO: 5202 - RNA, 18 nt, Artificial Sequence
  Description of Artificial Sequence: Synthetic oligonucleotide
agccaagaccagcacaga

SEQ ID NO: 5203 - RNA, 18 nt, Artificial Sequence
  Description of Artificial Sequence: Synthetic oligonucleotide
gggucagccaagaccagc

SEQ ID NO: 5204 - RNA, 18 nt, Artificial Sequence
  Description of Artificial Sequence: Synthetic oligonucleotide
guucagggucagccaaga

SEQ ID NO: 5205 - RNA, 18 nt, Artificial Sequence
  Description of Artificial Sequence: Synthetic oligonucleotide
uggguguucagggucagc

SEQ ID NO: 5206 - RNA, 18 nt, Artificial Sequence
  Description of Artificial Sequence: Synthetic oligonucleotide
aggccuggguguucaggg

SEQ ID NO: 5207 - RNA, 18 nt, Artificial Sequence
  Description of Artificial Sequence: Synthetic oligonucleotide
ccaagaggccuggguguu

SEQ ID NO: 5208 - RNA, 18 nt, Artificial Sequence
  Description of Artificial Sequence: Synthetic oligonucleotide
gaacaccaagaggccugg

SEQ ID NO: 5209 - RNA, 18 nt, Artificial Sequence
  Description of Artificial Sequence: Synthetic oligonucleotide
ggcaggaacaccaagagg

SEQ ID NO: 5210 - RNA, 18 nt, Artificial Sequence
  Description of Artificial Sequence: Synthetic oligonucleotide
agaaguggccgaccaggg

SEQ ID NO: 5211 - RNA, 18 nt, Artificial Sequence
  Description of Artificial Sequence: Synthetic oligonucleotide
ggaguagaaguggccgac

SEQ ID NO: 5212 - RNA, 18 nt, Artificial Sequence
  Description of Artificial Sequence: Synthetic oligonucleotide
augaaggaguagaagugg

SEQ ID NO: 5213 - RNA, 18 nt, Artificial Sequence
  Description of Artificial Sequence: Synthetic oligonucleotide
gggacaugaaggaguaga

SEQ ID NO: 5214 - RNA, 18 nt, Artificial Sequence
  Description of Artificial Sequence: Synthetic oligonucleotide
cagcugggacaugaagga

SEQ ID NO: 5215 - RNA, 18 nt, Artificial Sequence
  Description of Artificial Sequence: Synthetic oligonucleotide
cugagcagcugggacaug

SEQ ID NO: 5216 - RNA, 18 nt, Artificial Sequence
  Description of Artificial Sequence: Synthetic oligonucleotide
cccuucugagcagcuggg

SEQ ID NO: 5217 - RNA, 18 nt, Artificial Sequence
  Description of Artificial Sequence: Synthetic oligonucleotide
gacggcccuucugagcag

SEQ ID NO: 5218 - RNA, 18 nt, Artificial Sequence
  Description of Artificial Sequence: Synthetic oligonucleotide
gaguggacggcccuucug

SEQ ID NO: 5219 - RNA, 18 nt, Artificial Sequence
  Description of Artificial Sequence: Synthetic oligonucleotide
ugugagaguggacggccc

SEQ ID NO: 5220 - RNA, 18 nt, Artificial Sequence
  Description of Artificial Sequence: Synthetic oligonucleotide
gagccugugagaguggac

SEQ ID NO: 5221 - RNA, 18 nt, Artificial Sequence
  Description of Artificial Sequence: Synthetic oligonucleotide
caggagagccugugagag

SEQ ID NO: 5222 - RNA, 18 nt, Artificial Sequence
  Description of Artificial Sequence: Synthetic oligonucleotide
aaacccaggagagccugu

SEQ ID NO: 5223 - RNA, 18 nt, Artificial Sequence
  Description of Artificial Sequence: Synthetic oligonucleotide
ggacaaggccugaguggg

SEQ ID NO: 5224 - RNA, 18 nt, Artificial Sequence
  Description of Artificial Sequence: Synthetic oligonucleotide
acugaggacaaggccuga

SEQ ID NO: 5225 - RNA, 18 nt, Artificial Sequence
  Description of Artificial Sequence: Synthetic oligonucleotide
cagagacugaggacaagg

SEQ ID NO: 5226 - RNA, 18 nt, Artificial Sequence
  Description of Artificial Sequence: Synthetic oligonucleotide
gugcucagagacugagga

SEQ ID NO: 5227 - RNA, 18 nt, Artificial Sequence
  Description of Artificial Sequence: Synthetic oligonucleotide
gccuugugcucagagacu

SEQ ID NO: 5228 - RNA, 18 nt, Artificial Sequence
  Description of Artificial Sequence: Synthetic oligonucleotide
agacagccuugugcucag

SEQ ID NO: 5229 - RNA, 18 nt, Artificial Sequence
  Description of Artificial Sequence: Synthetic oligonucleotide
agggcagacagccuugug

SEQ ID NO: 5230 - RNA, 18 nt, Artificial Sequence
  Description of Artificial Sequence: Synthetic oligonucleotide
ggugcagggcagacagcc

SEQ ID NO: 5231 - RNA, 18 nt, Artificial Sequence
  Description of Artificial Sequence: Synthetic oligonucleotide
cacucggugcagggcaga

SEQ ID NO: 5232 - RNA, 18 nt, Artificial Sequence
  Description of Artificial Sequence: Synthetic oligonucleotide
cccugcacucggugcagg

SEQ ID NO: 5233 - RNA, 18 nt, Artificial Sequence
  Description of Artificial Sequence: Synthetic oligonucleotide
ccgaccccugcacucggu

SEQ ID NO: 5234 - RNA, 18 nt, Artificial Sequence
  Description of Artificial Sequence: Synthetic oligonucleotide
ccugcccgaccccugcac

SEQ ID NO: 5235 - RNA, 18 nt, Artificial Sequence
  Description of Artificial Sequence: Synthetic oligonucleotide
cagcuccugcccgacccc

SEQ ID NO: 5236 - RNA, 18 nt, Artificial Sequence
  Description of Artificial Sequence: Synthetic oligonucleotide
ugacacagcuccugcccg

SEQ ID NO: 5237 - RNA, 18 nt, Artificial Sequence
  Description of Artificial Sequence: Synthetic oligonucleotide
ggguggcgcagagcaggg

SEQ ID NO: 5238 - RNA, 18 nt, Artificial Sequence
  Description of Artificial Sequence: Synthetic oligonucleotide
acagcggguggcgcagag

SEQ ID NO: 5239 - RNA, 18 nt, Artificial Sequence
  Description of Artificial Sequence: Synthetic oligonucleotide
cuggcacagcggguggcg

SEQ ID NO: 5240 - RNA, 18 nt, Artificial Sequence
  Description of Artificial Sequence: Synthetic oligonucleotide
gggaccuggcacagcggg

SEQ ID NO: 5241 - RNA, 18 nt, Artificial Sequence
  Description of Artificial Sequence: Synthetic oligonucleotide
gugucgggaccuggcaca

SEQ ID NO: 5242 - RNA, 18 nt, Artificial Sequence
  Description of Artificial Sequence: Synthetic oligonucleotide
gcugugugucgggaccug

SEQ ID NO: 5243 - RNA, 18 nt, Artificial Sequence
  Description of Artificial Sequence: Synthetic oligonucleotide
caacugcugugugucggg

SEQ ID NO: 5244 - RNA, 18 nt, Artificial Sequence
  Description of Artificial Sequence: Synthetic oligonucleotide
gggagcaacugcugugug

SEQ ID NO: 5245 - RNA, 18 nt, Artificial Sequence
  Description of Artificial Sequence: Synthetic oligonucleotide
cgcagagcggcguauggg

SEQ ID NO: 5246 - RNA, 18 nt, Artificial Sequence
  Description of Artificial Sequence: Synthetic oligonucleotide
gaccgcagagcggcguau

SEQ ID NO: 5247 - RNA, 18 nt, Artificial Sequence
  Description of Artificial Sequence: Synthetic oligonucleotide
cggccgaccgcagagcgg

SEQ ID NO: 5248 - RNA, 18 nt, Artificial Sequence
  Description of Artificial Sequence: Synthetic oligonucleotide
ugcaccggccgaccgcag

SEQ ID NO: 5249 - RNA, 18 nt, Artificial Sequence
  Description of Artificial Sequence: Synthetic oligonucleotide
ccggaugcaccggccgac

SEQ ID NO: 5250 - RNA, 18 nt, Artificial Sequence
  Description of Artificial Sequence: Synthetic oligonucleotide
gcauuguacagggcaggg

SEQ ID NO: 5251 - RNA, 18 nt, Artificial Sequence
  Description of Artificial Sequence: Synthetic oligonucleotide
caucagcauuguacaggg

SEQ ID NO: 5252 - RNA, 18 nt, Artificial Sequence
  Description of Artificial Sequence: Synthetic oligonucleotide
ugcagcaucagcauugua

SEQ ID NO: 5253 - RNA, 18 nt, Artificial Sequence
  Description of Artificial Sequence: Synthetic oligonucleotide
aggucugcagcaucagca

SEQ ID NO: 5254 - RNA, 18 nt, Artificial Sequence
  Description of Artificial Sequence: Synthetic oligonucleotide
gagacaggucugcagcau

SEQ ID NO: 5255 - RNA, 18 nt, Artificial Sequence
  Description of Artificial Sequence: Synthetic oligonucleotide
ugcaagagacaggucugc

SEQ ID NO: 5256 - RNA, 18 nt, Artificial Sequence
  Description of Artificial Sequence: Synthetic oligonucleotide
cgcccugcaagagacagg

SEQ ID NO: 5257 - RNA, 18 nt, Artificial Sequence
  Description of Artificial Sequence: Synthetic oligonucleotide
agaggcgcccugcaagag

SEQ ID NO: 5258 - RNA, 18 nt, Artificial Sequence
  Description of Artificial Sequence: Synthetic oligonucleotide
cccacagaggcgcccugc

SEQ ID NO: 5259 - RNA, 18 nt, Artificial Sequence
  Description of Artificial Sequence: Synthetic oligonucleotide
uccuucccacagaggcgc

SEQ ID NO: 5260 - RNA, 18 nt, Artificial Sequence
  Description of Artificial Sequence: Synthetic oligonucleotide
cccucuccuucccacaga

SEQ ID NO: 5261 - RNA, 18 nt, Artificial Sequence
  Description of Artificial Sequence: Synthetic oligonucleotide
uggaccccucuccuuccc

SEQ ID NO: 5262 - RNA, 18 nt, Artificial Sequence
  Description of Artificial Sequence: Synthetic oligonucleotide
agcccuggaccccucucc

SEQ ID NO: 5263 - RNA, 18 nt, Artificial Sequence
  Description of Artificial Sequence: Synthetic oligonucleotide
acuccagcccuggacccc

SEQ ID NO: 5264 - RNA, 18 nt, Artificial Sequence
  Description of Artificial Sequence: Synthetic oligonucleotide
cccggacuccagcccugg

SEQ ID NO: 5265 - RNA, 18 nt, Artificial Sequence
  Description of Artificial Sequence: Synthetic oligonucleotide
gggcacccggacuccagc

SEQ ID NO: 5266 - RNA, 18 nt, Artificial Sequence
  Description of Artificial Sequence: Synthetic oligonucleotide
agucccugaagugcaggg

SEQ ID NO: 5267 - RNA, 18 nt, Artificial Sequence
  Description of Artificial Sequence: Synthetic oligonucleotide
aagucccugaagugcagg

SEQ ID NO: 5268 - RNA, 18 nt, Artificial Sequence
  Description of Artificial Sequence: Synthetic oligonucleotide
ccaagaagucccugaagu

SEQ ID NO: 5269 - RNA, 18 nt, Artificial Sequence
  Description of Artificial Sequence: Synthetic oligonucleotide
ggcugccaagaagucccu

SEQ ID NO: 5270 - RNA, 18 nt, Artificial Sequence
  Description of Artificial Sequence: Synthetic oligonucleotide
cacacggcugccaagaag

SEQ ID NO: 5271 - RNA, 18 nt, Artificial Sequence
  Description of Artificial Sequence: Synthetic oligonucleotide
ucgcccacacggcugcca

SEQ ID NO: 5272 - RNA, 18 nt, Artificial Sequence
  Description of Artificial Sequence: Synthetic oligonucleotide
cagcgucgcccacacggc

SEQ ID NO: 5273 - RNA, 18 nt, Artificial Sequence
  Description of Artificial Sequence: Synthetic oligonucleotide
ccugccagcgucgcccac

SEQ ID NO: 5274 - RNA, 18 nt, Artificial Sequence
  Description of Artificial Sequence: Synthetic oligonucleotide
cagagccugccagcgucg

SEQ ID NO: 5275 - RNA, 18 nt, Artificial Sequence
  Description of Artificial Sequence: Synthetic oligonucleotide
aucagcagagccugccag

SEQ ID NO: 5276 - RNA, 18 nt, Artificial Sequence
  Description of Artificial Sequence: Synthetic oligonucleotide
acaggaucagcagagccu

SEQ ID NO: 5277 - RNA, 18 nt, Artificial Sequence
  Description of Artificial Sequence: Synthetic oligonucleotide
ggacccccaaacgcucgc

SEQ ID NO: 5278 - RNA, 18 nt, Artificial Sequence
  Description of Artificial Sequence: Synthetic oligonucleotide
ucugaggacccccaaacg

SEQ ID NO: 5279 - RNA, 18 nt, Artificial Sequence
  Description of Artificial Sequence: Synthetic oligonucleotide
agggcucugaggaccccc

SEQ ID NO: 5280 - RNA, 18 nt, Artificial Sequence
  Description of Artificial Sequence: Synthetic oligonucleotide
agaagagggcucugagga

SEQ ID NO: 5281 - RNA, 18 nt, Artificial Sequence
  Description of Artificial Sequence: Synthetic oligonucleotide
cuuaaagaagagggcucu

SEQ ID NO: 5282 - RNA, 18 nt, Artificial Sequence
  Description of Artificial Sequence: Synthetic oligonucleotide
augaccuuaaagaagagg

SEQ ID NO: 5283 - RNA, 18 nt, Artificial Sequence
  Description of Artificial Sequence: Synthetic oligonucleotide
ccuugaugaccuuaaaga

SEQ ID NO: 5284 - RNA, 18 nt, Artificial Sequence
  Description of Artificial Sequence: Synthetic oligonucleotide
guaauccuugaugaccuu

SEQ ID NO: 5285 - RNA, 18 nt, Artificial Sequence
  Description of Artificial Sequence: Synthetic oligonucleotide
gaaggguaauccuugaug

SEQ ID NO: 5286 - RNA, 18 nt, Artificial Sequence
  Description of Artificial Sequence: Synthetic oligonucleotide
cguuggaaggguaauccu

SEQ ID NO: 5287 - RNA, 18 nt, Artificial Sequence
  Description of Artificial Sequence: Synthetic oligonucleotide
gucuucguuggaagggua

SEQ ID NO: 5288 - RNA, 18 nt, Artificial Sequence
  Description of Artificial Sequence: Synthetic oligonucleotide
ugaaggucuucguuggaa

SEQ ID NO: 5289 - RNA, 18 nt, Artificial Sequence
  Description of Artificial Sequence: Synthetic oligonucleotide
uuucgugaaggucuucgu

SEQ ID NO: 5290 - RNA, 18 nt, Artificial Sequence
  Description of Artificial Sequence: Synthetic oligonucleotide
cagccuuucgugaagguc

SEQ ID NO: 5291 - RNA, 18 nt, Artificial Sequence
  Description of Artificial Sequence: Synthetic oligonucleotide
accuccagccuuucguga

SEQ ID NO: 5292 - RNA, 18 nt, Artificial Sequence
  Description of Artificial Sequence: Synthetic oligonucleotide
ugaaaaccuccagccuuu

SEQ ID NO: 5293 - RNA, 18 nt, Artificial Sequence
  Description of Artificial Sequence: Synthetic oligonucleotide
ggccuugaaaaccuccag

SEQ ID NO: 5294 - RNA, 18 nt, Artificial Sequence
  Description of Artificial Sequence: Synthetic oligonucleotide
gugagggccuugaaaacc

SEQ ID NO: 5295 - RNA, 18 nt, Artificial Sequence
  Description of Artificial Sequence: Synthetic oligonucleotide
ugucugugagggccuuga

SEQ ID NO: 5296 - RNA, 18 nt, Artificial Sequence
  Description of Artificial Sequence: Synthetic oligonucleotide
cccauugucugugagggc

SEQ ID NO: 5297 - RNA, 18 nt, Artificial Sequence
  Description of Artificial Sequence: Synthetic oligonucleotide
ugucucccauugucugug

SEQ ID NO: 5298 - RNA, 18 nt, Artificial Sequence
  Description of Artificial Sequence: Synthetic oligonucleotide
ugaugugucucccauugu

SEQ ID NO: 5299 - RNA, 18 nt, Artificial Sequence
  Description of Artificial Sequence: Synthetic oligonucleotide
guaggugaugugucuccc

SEQ ID NO: 5300 - RNA, 18 nt, Artificial Sequence
  Description of Artificial Sequence: Synthetic oligonucleotide
uccaaguaggugaugugu

SEQ ID NO: 5301 - RNA, 18 nt, Artificial Sequence
  Description of Artificial Sequence: Synthetic oligonucleotide
cuuccuccaaguagguga

SEQ ID NO: 5302 - RNA, 18 nt, Artificial Sequence
  Description of Artificial Sequence: Synthetic oligonucleotide
cagcucuuccuccaagua

SEQ ID NO: 5303 - RNA, 18 nt, Artificial Sequence
  Description of Artificial Sequence: Synthetic oligonucleotide
ucaucagccagcuggugu

SEQ ID NO: 5304 - RNA, 18 nt, Artificial Sequence
  Description of Artificial Sequence: Synthetic oligonucleotide
caggcucaucagccagcu

SEQ ID NO: 5305 - RNA, 18 nt, Artificial Sequence
  Description of Artificial Sequence: Synthetic oligonucleotide
uucuccaggcucaucagc

SEQ ID NO: 5306 - RNA, 18 nt, Artificial Sequence
  Description of Artificial Sequence: Synthetic oligonucleotide
gcggguucuccaggcuca

SEQ ID NO: 5307 - RNA, 18 nt, Artificial Sequence
  Description of Artificial Sequence: Synthetic oligonucleotide
gcugagcggguucuccag

SEQ ID NO: 5308 - RNA, 18 nt, Artificial Sequence
  Description of Artificial Sequence: Synthetic oligonucleotide
aaagggcugagcggguuc

SEQ ID NO: 5309 - RNA, 18 nt, Artificial Sequence
  Description of Artificial Sequence: Synthetic oligonucleotide
aggagaaagggcugagcg

SEQ ID NO: 5310 - RNA, 18 nt, Artificial Sequence
  Description of Artificial Sequence: Synthetic oligonucleotide
guccgaggagaaagggcu

SEQ ID NO: 5311 - RNA, 18 nt, Artificial Sequence
  Description of Artificial Sequence: Synthetic oligonucleotide
uugauguccgaggagaaa

SEQ ID NO: 5312 - RNA, 18 nt, Artificial Sequence
  Description of Artificial Sequence: Synthetic oligonucleotide
uguuguugauguccgagg

SEQ ID NO: 5313 - RNA, 18 nt, Artificial Sequence
  Description of Artificial Sequence: Synthetic oligonucleotide
gggcauguuguugauguc

SEQ ID NO: 5314 - RNA, 18 nt, Artificial Sequence
  Description of Artificial Sequence: Synthetic oligonucleotide
uagacagcuccugcaggg

SEQ ID NO: 5315 - RNA, 18 nt, Artificial Sequence
  Description of Artificial Sequence: Synthetic oligonucleotide
gcguuagacagcuccugc

SEQ ID NO: 5316 - RNA, 18 nt, Artificial Sequence
  Description of Artificial Sequence: Synthetic oligonucleotide
ugagggcguuagacagcu

SEQ ID NO: 5317 - RNA, 18 nt, Artificial Sequence
  Description of Artificial Sequence: Synthetic oligonucleotide
cgccaugagggcguuaga

SEQ ID NO: 5318 - RNA, 18 nt, Artificial Sequence
  Description of Artificial Sequence: Synthetic oligonucleotide
ucagccgccaugagggcg

SEQ ID NO: 5319 - RNA, 18 nt, Artificial Sequence
  Description of Artificial Sequence: Synthetic oligonucleotide
agcgcucagccgccauga

SEQ ID NO: 5320 - RNA, 18 nt, Artificial Sequence
  Description of Artificial Sequence: Synthetic oligonucleotide
cuugaagcgcucagccgc

SEQ ID NO: 5321 - RNA, 18 nt, Artificial Sequence
  Description of Artificial Sequence: Synthetic oligonucleotide
ugcuccuugaagcgcuca

SEQ ID NO: 5322 - RNA, 18 nt, Artificial Sequence
  Description of Artificial Sequence: Synthetic oligonucleotide
cccggugcuccuugaagc

SEQ ID NO: 5323 - RNA, 18 nt, Artificial Sequence
  Description of Artificial Sequence: Synthetic oligonucleotide
ugugucccggugcuccuu

SEQ ID NO: 5324 - RNA, 18 nt, Artificial Sequence
  Description of Artificial Sequence: Synthetic oligonucleotide
agggcugugucccggugc

SEQ ID NO: 5325 - RNA, 18 nt, Artificial Sequence
  Description of Artificial Sequence: Synthetic oligonucleotide
uguacagggcuguguccc

SEQ ID NO: 5326 - RNA, 18 nt, Artificial Sequence
  Description of Artificial Sequence: Synthetic oligonucleotide
ugacuuguacagggcugu

SEQ ID NO: 5327 - RNA, 18 nt, Artificial Sequence
  Description of Artificial Sequence: Synthetic oligonucleotide
gacagugacuuguacagg

SEQ ID NO: 5328 - RNA, 18 nt, Artificial Sequence
  Description of Artificial Sequence: Synthetic oligonucleotide
gcaccgacagugacuugu

SEQ ID NO: 5329 - RNA, 18 nt, Artificial Sequence
  Description of Artificial Sequence: Synthetic oligonucleotide
ugccggcaccgacaguga

SEQ ID NO: 5330 - RNA, 18 nt, Artificial Sequence
  Description of Artificial Sequence: Synthetic oligonucleotide
cuggcugccggcaccgac

SEQ ID NO: 5331 - RNA, 18 nt, Artificial Sequence
  Description of Artificial Sequence: Synthetic oligonucleotide
ccgugcuggcugccggca

SEQ ID NO: 5332 - RNA, 18 nt, Artificial Sequence
  Description of Artificial Sequence: Synthetic oligonucleotide
uuuggccgugcuggcugc

SEQ ID NO: 5333 - RNA, 18 nt, Artificial Sequence
  Description of Artificial Sequence: Synthetic oligonucleotide
gagcgaggcagaggaggg

SEQ ID NO: 5334 - RNA, 18 nt, Artificial Sequence
  Description of Artificial Sequence: Synthetic oligonucleotide
uguuggagcgaggcagag

SEQ ID NO: 5335 - RNA, 18 nt, Artificial Sequence
  Description of Artificial Sequence: Synthetic oligonucleotide
ccaaggcccgccaugcca

SEQ ID NO: 5336 - RNA, 18 nt, Artificial Sequence
  Description of Artificial Sequence: Synthetic oligonucleotide
ccgugccaaggcccgcca

SEQ ID NO: 5337 - RNA, 18 nt, Artificial Sequence
  Description of Artificial Sequence: Synthetic oligonucleotide
agagcccgugccaaggcc

SEQ ID NO: 5338 - RNA, 18 nt, Artificial Sequence
  Description of Artificial Sequence: Synthetic oligonucleotide
ggagcagagcccgugcca

SEQ ID NO: 5339 - RNA, 18 nt, Artificial Sequence
  Description of Artificial Sequence: Synthetic oligonucleotide
cagugggagcagagcccg

SEQ ID NO: 5340 - RNA, 18 nt, Artificial Sequence
  Description of Artificial Sequence: Synthetic oligonucleotide
caggccagugggagcaga

SEQ ID NO: 5341 - RNA, 18 nt, Artificial Sequence
  Description of Artificial Sequence: Synthetic oligonucleotide
agcaccaggccaguggga

SEQ ID NO: 5342 - RNA, 18 nt, Artificial Sequence
  Description of Artificial Sequence: Synthetic oligonucleotide
ccgggagcaccaggccag

SEQ ID NO: 5343 - RNA, 18 nt, Artificial Sequence
  Description of Artificial Sequence: Synthetic oligonucleotide
cgucaccgggagcaccag

SEQ ID NO: 5344 - RNA, 18 nt, Artificial Sequence
  Description of Artificial Sequence: Synthetic oligonucleotide
auugccgucaccgggagc

SEQ ID NO: 5345 - RNA, 18 nt, Artificial Sequence
  Description of Artificial Sequence: Synthetic oligonucleotide
gccacauugccgucaccg

SEQ ID NO: 5346 - RNA, 18 nt, Artificial Sequence
  Description of Artificial Sequence: Synthetic oligonucleotide
gaggagccacauugccgu

SEQ ID NO: 5347 - RNA, 18 nt, Artificial Sequence
  Description of Artificial Sequence: Synthetic oligonucleotide
gcagagaggagccacauu

SEQ ID NO: 5348 - RNA, 18 nt, Artificial Sequence
  Description of Artificial Sequence: Synthetic oligonucleotide
ccucagcagagaggagcc

SEQ ID NO: 5349 - RNA, 18 nt, Artificial Sequence
  Description of Artificial Sequence: Synthetic oligonucleotide
ggcgcccucagcagagag

SEQ ID NO: 5350 - RNA, 18 nt, Artificial Sequence
  Description of Artificial Sequence: Synthetic oligonucleotide
gugugggcgcccucagca

SEQ ID NO: 5351 - RNA, 18 nt, Artificial Sequence
  Description of Artificial Sequence: Synthetic oligonucleotide
cagccgugugggcgcccu

SEQ ID NO: 5352 - RNA, 18 nt, Artificial Sequence
  Description of Artificial Sequence: Synthetic oligonucleotide
acucccagccgugugggc

SEQ ID NO: 5353 - RNA, 18 nt, Artificial Sequence
  Description of Artificial Sequence: Synthetic oligonucleotide
ggaccacucccagccgug

SEQ ID NO: 5354 - RNA, 18 nt, Artificial Sequence
  Description of Artificial Sequence: Synthetic oligonucleotide
gccagggaccacucccag

SEQ ID NO: 5355 - RNA, 18 nt, Artificial Sequence
  Description of Artificial Sequence: Synthetic oligonucleotide
ggcaggccagggaccacu

SEQ ID NO: 5356 - RNA, 18 nt, Artificial Sequence
  Description of Artificial Sequence: Synthetic oligonucleotide
gcugaggcaggccaggga

SEQ ID NO: 5357 - RNA, 18 nt, Artificial Sequence
  Description of Artificial Sequence: Synthetic oligonucleotide
auggugcugaggcaggcc

SEQ ID NO: 5358 - RNA, 18 nt, Artificial Sequence
  Description of Artificial Sequence: Synthetic oligonucleotide
gaacaauggugcugaggc

SEQ ID NO: 5359 - RNA, 18 nt, Artificial Sequence
  Description of Artificial Sequence: Synthetic oligonucleotide
ccggagaacaauggugcu

SEQ ID NO: 5360 - RNA, 18 nt, Artificial Sequence
  Description of Artificial Sequence: Synthetic oligonucleotide
aaacaccggagaacaaug

SEQ ID NO: 5361 - RNA, 18 nt, Artificial Sequence
  Description of Artificial Sequence: Synthetic oligonucleotide
cucccaaacaccggagaa

SEQ ID NO: 5362 - RNA, 18 nt, Artificial Sequence
  Description of Artificial Sequence: Synthetic oligonucleotide
gccuccucccaaacaccg

SEQ ID NO: 5363 - RNA, 18 nt, Artificial Sequence
  Description of Artificial Sequence: Synthetic oligonucleotide
ggucagccuccucccaaa

SEQ ID NO: 5364 - RNA, 18 nt, Artificial Sequence
  Description of Artificial Sequence: Synthetic oligonucleotide
ccacgggucagccuccuc

SEQ ID NO: 5365 - RNA, 18 nt, Artificial Sequence
  Description of Artificial Sequence: Synthetic oligonucleotide
accucccacgggucagcc

SEQ ID NO: 5366 - RNA, 18 nt, Artificial Sequence
  Description of Artificial Sequence: Synthetic oligonucleotide
cagacaccucccacgggu

SEQ ID NO: 5367 - RNA, 18 nt, Artificial Sequence
  Description of Artificial Sequence: Synthetic oligonucleotide
cagggcagacaccuccca

SEQ ID NO: 5368 - RNA, 18 nt, Artificial Sequence
  Description of Artificial Sequence: Synthetic oligonucleotide
cugagcagggcagacacc

SEQ ID NO: 5369 - RNA, 18 nt, Artificial Sequence
  Description of Artificial Sequence: Synthetic oligonucleotide
gcuuccugagcagggcag

SEQ ID NO: 5370 - RNA, 18 nt, Artificial Sequence
  Description of Artificial Sequence: Synthetic oligonucleotide
ccccagcuuccugagcag

SEQ ID NO: 5371 - RNA, 18 nt, Artificial Sequence
  Description of Artificial Sequence: Synthetic oligonucleotide
gccagccccagcuuccug

SEQ ID NO: 5372 - RNA, 18 nt, Artificial Sequence
  Description of Artificial Sequence: Synthetic oligonucleotide
aagcugccagccccagcu

SEQ ID NO: 5373 - RNA, 18 nt, Artificial Sequence
  Description of Artificial Sequence: Synthetic oligonucleotide
uucugaagcugccagccc

SEQ ID NO: 5374 - RNA, 18 nt, Artificial Sequence
  Description of Artificial Sequence: Synthetic oligonucleotide
acugcuucugaagcugcc

SEQ ID NO: 5375 - RNA, 18 nt, Artificial Sequence
  Description of Artificial Sequence: Synthetic oligonucleotide
ccccuacugcuucugaag

SEQ ID NO: 5376 - RNA, 18 nt, Artificial Sequence
  Description of Artificial Sequence: Synthetic oligonucleotide
cagggccccuacugcuuc

SEQ ID NO: 5377 - RNA, 18 nt, Artificial Sequence
  Description of Artificial Sequence: Synthetic oligonucleotide
cuccacagggccccuacu

SEQ ID NO: 5378 - RNA, 18 nt, Artificial Sequence
  Description of Artificial Sequence: Synthetic oligonucleotide
agaggcuccacagggccc

SEQ ID NO: 5379 - RNA, 18 nt, Artificial Sequence
  Description of Artificial Sequence: Synthetic oligonucleotide
ugggcagaggcuccacag

SEQ ID NO: 5380 - RNA, 18 nt, Artificial Sequence
  Description of Artificial Sequence: Synthetic oligonucleotide
gaugcugggcagaggcuc

SEQ ID NO: 5381 - RNA, 18 nt, Artificial Sequence
  Description of Artificial Sequence: Synthetic oligonucleotide
cggaggaugcugggcaga

SEQ ID NO: 5382 - RNA, 18 nt, Artificial Sequence
  Description of Artificial Sequence: Synthetic oligonucleotide
ccccacggaggaugcugg

SEQ ID NO: 5383 - RNA, 18 nt, Artificial Sequence
  Description of Artificial Sequence: Synthetic oligonucleotide
ggacuccccacggaggau

SEQ ID NO: 5384 - RNA, 18 nt, Artificial Sequence
  Description of Artificial Sequence: Synthetic oligonucleotide
gugcuggacuccccacgg

SEQ ID NO: 5385 - RNA, 18 nt, Artificial Sequence
  Description of Artificial Sequence: Synthetic oligonucleotide
ccgcagugcuggacuccc

SEQ ID NO: 5386 - RNA, 18 nt, Artificial Sequence
  Description of Artificial Sequence: Synthetic oligonucleotide
ggagcccgcagugcugga

SEQ ID NO: 5387 - RNA, 18 nt, Artificial Sequence
  Description of Artificial Sequence: Synthetic oligonucleotide
cuccuggagcccgcagug

SEQ ID NO: 5388 - RNA, 18 nt, Artificial Sequence
  Description of Artificial Sequence: Synthetic oligonucleotide
agagccuccuggagcccg

SEQ ID NO: 5389 - RNA, 18 nt, Artificial Sequence
  Description of Artificial Sequence: Synthetic oligonucleotide
gccgcagagccuccugga

SEQ ID NO: 5390 - RNA, 18 nt, Artificial Sequence
  Description of Artificial Sequence: Synthetic oligonucleotide
aggcugccgcagagccuc

SEQ ID NO: 5391 - RNA, 18 nt, Artificial Sequence
  Description of Artificial Sequence: Synthetic oligonucleotide
gagggaggcugccgcaga

SEQ ID NO: 5392 - RNA, 18 nt, Artificial Sequence
  Description of Artificial Sequence: Synthetic oligonucleotide
gcagggagggaggcugcc

SEQ ID NO: 5393 - RNA, 18 nt, Artificial Sequence
  Description of Artificial Sequence: Synthetic oligonucleotide
cccaggcagggagggagg

SEQ ID NO: 5394 - RNA, 18 nt, Artificial Sequence
  Description of Artificial Sequence: Synthetic oligonucleotide
cugggcccaggcagggag

SEQ ID NO: 5395 - RNA, 18 nt, Artificial Sequence
  Description of Artificial Sequence: Synthetic oligonucleotide
caaaccugggcccaggca

SEQ ID NO: 5396 - RNA, 18 nt, Artificial Sequence
  Description of Artificial Sequence: Synthetic oligonucleotide
guguccaaaccugggccc

SEQ ID NO: 5397 - RNA, 18 nt, Artificial Sequence
  Description of Artificial Sequence: Synthetic oligonucleotide
cucagguguccaaaccug

SEQ ID NO: 5398 - RNA, 18 nt, Artificial Sequence
  Description of Artificial Sequence: Synthetic oligonucleotide
gcgggcucagguguccaa

SEQ ID NO: 5399 - RNA, 18 nt, Artificial Sequence
  Description of Artificial Sequence: Synthetic oligonucleotide
cgcaggcgggcucaggug

SEQ ID NO: 5400 - RNA, 18 nt, Artificial Sequence
  Description of Artificial Sequence: Synthetic oligonucleotide
gagugcgcaggcgggcuc

SEQ ID NO: 5401 - RNA, 18 nt, Artificial Sequence
  Description of Artificial Sequence: Synthetic oligonucleotide
gcccagagugcgcaggcg

SEQ ID NO: 5402 - RNA, 18 nt, Artificial Sequence
  Description of Artificial Sequence: Synthetic oligonucleotide
gggcccagagugcgcagg

SEQ ID NO: 5403 - RNA, 18 nt, Artificial Sequence
  Description of Artificial Sequence: Synthetic oligonucleotide
agcacggugccgaguggg

SEQ ID NO: 5404 - RNA, 18 nt, Artificial Sequence
  Description of Artificial Sequence: Synthetic oligonucleotide
cgagaagcacggugccga

SEQ ID NO: 5405 - RNA, 18 nt, Artificial Sequence
  Description of Artificial Sequence: Synthetic oligonucleotide
ccuggcgagaagcacggu

SEQ ID NO: 5406 - RNA, 18 nt, Artificial Sequence
  Description of Artificial Sequence: Synthetic oligonucleotide
gagggccuggcgagaagc

SEQ ID NO: 5407 - RNA, 18 nt, Artificial Sequence
  Description of Artificial Sequence: Synthetic oligonucleotide
agccagagggccuggcga

SEQ ID NO: 5408 - RNA, 18 nt, Artificial Sequence
  Description of Artificial Sequence: Synthetic oligonucleotide
ggaagagccagagggccu

SEQ ID NO: 5409 - RNA, 18 nt, Artificial Sequence
  Description of Artificial Sequence: Synthetic oligonucleotide
cacagggaagagccagag

SEQ ID NO: 5410 - RNA, 18 nt, Artificial Sequence
  Description of Artificial Sequence: Synthetic oligonucleotide
gcagccacagggaagagc

SEQ ID NO: 5411 - RNA, 18 nt, Artificial Sequence
  Description of Artificial Sequence: Synthetic oligonucleotide
caucugcagccacaggga

SEQ ID NO: 5412 - RNA, 18 nt, Artificial Sequence
  Description of Artificial Sequence: Synthetic oligonucleotide
agugccaucugcagccac

SEQ ID NO: 5413 - RNA, 18 nt, Artificial Sequence
  Description of Artificial Sequence: Synthetic oligonucleotide
cgcuaagugccaucugca

SEQ ID NO: 5414 - RNA, 18 nt, Artificial Sequence
  Description of Artificial Sequence: Synthetic oligonucleotide
uaggccgcuaagugccau

SEQ ID NO: 5415 - RNA, 18 nt, Artificial Sequence
  Description of Artificial Sequence: Synthetic oligonucleotide
cguccuaggccgcuaagu

SEQ ID NO: 5416 - RNA, 18 nt, Artificial Sequence
  Description of Artificial Sequence: Synthetic oligonucleotide
auagacguccuaggccgc

SEQ ID NO: 5417 - RNA, 18 nt, Artificial Sequence
  Description of Artificial Sequence: Synthetic oligonucleotide
cgugaauagacguccuag

SEQ ID NO: 5418 - RNA, 18 nt, Artificial Sequence
  Description of Artificial Sequence: Synthetic oligonucleotide
ccucccgugaauagacgu

SEQ ID NO: 5419 - RNA, 18 nt, Artificial Sequence
  Description of Artificial Sequence: Synthetic oligonucleotide
ucccuccucccgugaaua

SEQ ID NO: 5420 - RNA, 18 nt, Artificial Sequence
  Description of Artificial Sequence: Synthetic oligonucleotide
gugccucccuccucccgu

SEQ ID NO: 5421 - RNA, 18 nt, Artificial Sequence
  Description of Artificial Sequence: Synthetic oligonucleotide
gggcagugccucccuccu

SEQ ID NO: 5422 - RNA, 18 nt, Artificial Sequence
  Description of Artificial Sequence: Synthetic oligonucleotide
gaggagggcagugccucc

SEQ ID NO: 5423 - RNA, 18 nt, Artificial Sequence
  Description of Artificial Sequence: Synthetic oligonucleotide
gaccugaggagggcagug

SEQ ID NO: 5424 - RNA, 18 nt, Artificial Sequence
  Description of Artificial Sequence: Synthetic oligonucleotide
gggcagaccugaggaggg

SEQ ID NO: 5425 - RNA, 18 nt, Artificial Sequence
  Description of Artificial Sequence: Synthetic oligonucleotide
ugcuugggcagaccugag

SEQ ID NO: 5426 - RNA, 18 nt, Artificial Sequence
  Description of Artificial Sequence: Synthetic oligonucleotide
caagcugcuugggcagac

SEQ ID NO: 5427 - RNA, 18 nt, Artificial Sequence
  Description of Artificial Sequence: Synthetic oligonucleotide
agcuacaagcugcuuggg

SEQ ID NO: 5428 - RNA, 18 nt, Artificial Sequence
  Description of Artificial Sequence: Synthetic oligonucleotide
gugcuagcuacaagcugc

SEQ ID NO: 5429 - RNA, 18 nt, Artificial Sequence
  Description of Artificial Sequence: Synthetic oligonucleotide
gcccagugcuagcuacaa

SEQ ID NO: 5430 - RNA, 18 nt, Artificial Sequence
  Description of Artificial Sequence: Synthetic oligonucleotide
gggcccagugcuagcuac

SEQ ID NO: 5431 - RNA, 18 nt, Artificial Sequence
  Description of Artificial Sequence: Synthetic oligonucleotide
caaagcagcauuuccugu

SEQ ID NO: 5432 - RNA, 18 nt, Artificial Sequence
  Description of Artificial Sequence: Synthetic oligonucleotide
ggucccaaagcagcauuu

SEQ ID NO: 5433 - RNA, 18 nt, Artificial Sequence
  Description of Artificial Sequence: Synthetic oligonucleotide
ugggaggucccaaagcag

SEQ ID NO: 5434 - RNA, 18 nt, Artificial Sequence
  Description of Artificial Sequence: Synthetic oligonucleotide
gagggugggaggucccaa

SEQ ID NO: 5435 - RNA, 18 nt, Artificial Sequence
  Description of Artificial Sequence: Synthetic oligonucleotide
ggagagagggugggaggu

SEQ ID NO: 5436 - RNA, 18 nt, Artificial Sequence
  Description of Artificial Sequence: Synthetic oligonucleotide
gcuaaggagagagggugg

SEQ ID NO: 5437 - RNA, 18 nt, Artificial Sequence
  Description of Artificial Sequence: Synthetic oligonucleotide
gggacgcuaaggagagag

SEQ ID NO: 5438 - RNA, 18 nt, Artificial Sequence
  Description of Artificial Sequence: Synthetic oligonucleotide
gccagacccacagcuggg

SEQ ID NO: 5439 - RNA, 18 nt, Artificial Sequence
  Description of Artificial Sequence: Synthetic oligonucleotide
agccagacccacagcugg

SEQ ID NO: 5440 - RNA, 18 nt, Artificial Sequence
  Description of Artificial Sequence: Synthetic oligonucleotide
cuccaagccagacccaca

SEQ ID NO: 5441 - RNA, 18 nt, Artificial Sequence
  Description of Artificial Sequence: Synthetic oligonucleotide
uccaacuccaagccagac

SEQ ID NO: 5442 - RNA, 18 nt, Artificial Sequence
  Description of Artificial Sequence: Synthetic oligonucleotide
cacccuccaacuccaagc

SEQ ID NO: 5443 - RNA, 18 nt, Artificial Sequence
  Description of Artificial Sequence: Synthetic oligonucleotide
aggcucacccuccaacuc

SEQ ID NO: 5444 - RNA, 18 nt, Artificial Sequence
  Description of Artificial Sequence: Synthetic oligonucleotide
agcagaggcucacccucc

SEQ ID NO: 5445 - RNA, 18 nt, Artificial Sequence
  Description of Artificial Sequence: Synthetic oligonucleotide
ccaagagcagaggcucac

SEQ ID NO: 5446 - RNA, 18 nt, Artificial Sequence
  Description of Artificial Sequence: Synthetic oligonucleotide
ugcucccaagagcagagg

SEQ ID NO: 5447 - RNA, 18 nt, Artificial Sequence
  Description of Artificial Sequence: Synthetic oligonucleotide
cagacugcucccaagagc

SEQ ID NO: 5448 - RNA, 18 nt, Artificial Sequence
  Description of Artificial Sequence: Synthetic oligonucleotide
gcaaacagacugcuccca

SEQ ID NO: 5449 - RNA, 18 nt, Artificial Sequence
  Description of Artificial Sequence: Synthetic oligonucleotide
uguuugcaaacagacugc

SEQ ID NO: 5450 - RNA, 18 nt, Artificial Sequence
  Description of Artificial Sequence: Synthetic oligonucleotide
gucccuguuugcaaacag

SEQ ID NO: 5451 - RNA, 18 nt, Artificial Sequence
  Description of Artificial Sequence: Synthetic oligonucleotide
gggaagucccuguuugca

SEQ ID NO: 5452 - RNA, 18 nt, Artificial Sequence
  Description of Artificial Sequence: Synthetic oligonucleotide
gagacuccgugacguggg

SEQ ID NO: 5453 - RNA, 18 nt, Artificial Sequence
  Description of Artificial Sequence: Synthetic oligonucleotide
ugcggagacuccgugacg

SEQ ID NO: 5454 - RNA, 18 nt, Artificial Sequence
  Description of Artificial Sequence: Synthetic oligonucleotide
agagcugcggagacuccg

SEQ ID NO: 5455 - RNA, 18 nt, Artificial Sequence
  Description of Artificial Sequence: Synthetic oligonucleotide
cgaggagagcugcggaga

SEQ ID NO: 5456 - RNA, 18 nt, Artificial Sequence
  Description of Artificial Sequence: Synthetic oligonucleotide
guaaccgaggagagcugc

SEQ ID NO: 5457 - RNA, 18 nt, Artificial Sequence
  Description of Artificial Sequence: Synthetic oligonucleotide
cccucguaaccgaggaga

SEQ ID NO: 5458 - RNA, 18 nt, Artificial Sequence
  Description of Artificial Sequence: Synthetic oligonucleotide
accagcccucguaaccga

SEQ ID NO: 5459 - RNA, 18 nt, Artificial Sequence
  Description of Artificial Sequence: Synthetic oligonucleotide
cugaaaccagcccucgua

SEQ ID NO: 5460 - RNA, 18 nt, Artificial Sequence
  Description of Artificial Sequence: Synthetic oligonucleotide
ggagccugaaaccagccc

SEQ ID NO: 5461 - RNA, 18 nt, Artificial Sequence
  Description of Artificial Sequence: Synthetic oligonucleotide
gagcgggagccugaaacc

SEQ ID NO: 5462 - RNA, 18 nt, Artificial Sequence
  Description of Artificial Sequence: Synthetic oligonucleotide
uaaaagagcgggagccug

SEQ ID NO: 5463 - RNA, 18 nt, Artificial Sequence
  Description of Artificial Sequence: Synthetic oligonucleotide
agcucuaaaagagcggga

SEQ ID NO: 5464 - RNA, 18 nt, Artificial Sequence
  Description of Artificial Sequence: Synthetic oligonucleotide
gccucagcucuaaaagag

SEQ ID NO: 5465 - RNA, 18 nt, Artificial Sequence
  Description of Artificial Sequence: Synthetic oligonucleotide
gacgggccucagcucuaa

SEQ ID NO: 5466 - RNA, 18 nt, Artificial Sequence
  Description of Artificial Sequence: Synthetic oligonucleotide
cgcccgacgggccucagc

SEQ ID NO: 5467 - RNA, 18 nt, Artificial Sequence
  Description of Artificial Sequence: Synthetic oligonucleotide
cucuccgcccgacgggcc

SEQ ID NO: 5468 - RNA, 18 nt, Artificial Sequence
  Description of Artificial Sequence: Synthetic oligonucleotide
agacgcucuccgcccgac

SEQ ID NO: 5469 - RNA, 18 nt, Artificial Sequence
  Description of Artificial Sequence: Synthetic oligonucleotide
gggcaagacgcucuccgc

SEQ ID NO: 5470 - RNA, 18 nt, Artificial Sequence
  Description of Artificial Sequence: Synthetic oligonucleotide
gccuccagguaggcaggg

SEQ ID NO: 5471 - RNA, 18 nt, Artificial Sequence
  Description of Artificial Sequence: Synthetic oligonucleotide
gugccuccagguaggcag

SEQ ID NO: 5472 - RNA, 18 nt, Artificial Sequence
  Description of Artificial Sequence: Synthetic oligonucleotide
ccccugugccuccaggua

SEQ ID NO: 5473 - RNA, 18 nt, Artificial Sequence
  Description of Artificial Sequence: Synthetic oligonucleotide
agccaccccugugccucc

SEQ ID NO: 5474 - RNA, 18 nt, Artificial Sequence
  Description of Artificial Sequence: Synthetic oligonucleotide
ccagcagccaccccugug

SEQ ID NO: 5475 - RNA, 18 nt, Artificial Sequence
  Description of Artificial Sequence: Synthetic oligonucleotide
guccaccagcagccaccc

SEQ ID NO: 5476 - RNA, 18 nt, Artificial Sequence
  Description of Artificial Sequence: Synthetic oligonucleotide
cuaguguccaccagcagc

SEQ ID NO: 5477 - RNA, 18 nt, Artificial Sequence
  Description of Artificial Sequence: Synthetic oligonucleotide
ccacccuaguguccacca

SEQ ID NO: 5478 - RNA, 18 nt, Artificial Sequence
  Description of Artificial Sequence: Synthetic oligonucleotide
ucugcccacccuaguguc

SEQ ID NO: 5479 - RNA, 18 nt, Artificial Sequence
  Description of Artificial Sequence: Synthetic oligonucleotide
ucggcucugcccacccua

SEQ ID NO: 5480 - RNA, 18 nt, Artificial Sequence
  Description of Artificial Sequence: Synthetic oligonucleotide
ggcaaucggcucugccca

SEQ ID NO: 5481 - RNA, 18 nt, Artificial Sequence
  Description of Artificial Sequence: Synthetic oligonucleotide
gggcaggcaaucggcucu

SEQ ID NO: 5482 - RNA, 18 nt, Artificial Sequence
  Description of Artificial Sequence: Synthetic oligonucleotide
ggguugggcaggcaaucg

SEQ ID NO: 5483 - RNA, 18 nt, Artificial Sequence
  Description of Artificial Sequence: Synthetic oligonucleotide
ccugcaugagugcccggg

SEQ ID NO: 5484 - RNA, 18 nt, Artificial Sequence
  Description of Artificial Sequence: Synthetic oligonucleotide
uccugcaugagugcccgg

SEQ ID NO: 5485 - RNA, 18 nt, Artificial Sequence
  Description of Artificial Sequence: Synthetic oligonucleotide
gccucuccugcaugagug

SEQ ID NO: 5486 - RNA, 18 nt, Artificial Sequence
  Description of Artificial Sequence: Synthetic oligonucleotide
cacaggccucuccugcau

SEQ ID NO: 5487 - RNA, 18 nt, Artificial Sequence
  Description of Artificial Sequence: Synthetic oligonucleotide
cccgacacaggccucucc

SEQ ID NO: 5488 - RNA, 18 nt, Artificial Sequence
  Description of Artificial Sequence: Synthetic oligonucleotide
gugaccccgacacaggcc

SEQ ID NO: 5489 - RNA, 18 nt, Artificial Sequence
  Description of Artificial Sequence: Synthetic oligonucleotide
ugcacgugaccccgacac

SEQ ID NO: 5490 - RNA, 18 nt, Artificial Sequence
  Description of Artificial Sequence: Synthetic oligonucleotide
aggccugcacgugacccc

SEQ ID NO: 5491 - RNA, 18 nt, Artificial Sequence
  Description of Artificial Sequence: Synthetic oligonucleotide
ugggaaggccugcacgug

SEQ ID NO: 5492 - RNA, 18 nt, Artificial Sequence
  Description of Artificial Sequence: Synthetic oligonucleotide
gacgcugggaaggccugc

SEQ ID NO: 5493 - RNA, 18 nt, Artificial Sequence
  Description of Artificial Sequence: Synthetic oligonucleotide
gggaggacgcugggaagg

SEQ ID NO: 5494 - RNA, 18 nt, Artificial Sequence
  Description of Artificial Sequence: Synthetic oligonucleotide
gggcagggaggacgcugg

SEQ ID NO: 5495 - RNA, 18 nt, Artificial Sequence
  Description of Artificial Sequence: Synthetic oligonucleotide
cgagcgggcagggaggac

SEQ ID NO: 5496 - RNA, 18 nt, Artificial Sequence
  Description of Artificial Sequence: Synthetic oligonucleotide
uccaccgagcgggcaggg

SEQ ID NO: 5497 - RNA, 18 nt, Artificial Sequence
  Description of Artificial Sequence: Synthetic oligonucleotide
ugccauccaccgagcggg

SEQ ID NO: 5498 - RNA, 18 nt, Artificial Sequence
  Description of Artificial Sequence: Synthetic oligonucleotide
acugcugccauccaccga

SEQ ID NO: 5499 - RNA, 18 nt, Artificial Sequence
  Description of Artificial Sequence: Synthetic oligonucleotide
ugcuuacugcugccaucc

SEQ ID NO: 5500 - RNA, 18 nt, Artificial Sequence
  Description of Artificial Sequence: Synthetic oligonucleotide
ggcucugcuuacugcugc

SEQ ID NO: 5501 - RNA, 18 nt, Artificial Sequence
  Description of Artificial Sequence: Synthetic oligonucleotide
cccagggcucugcuuacu

SEQ ID NO: 5502 - RNA, 18 nt, Artificial Sequence
  Description of Artificial Sequence: Synthetic oligonucleotide
gccuccccagggcucugc

SEQ ID NO: 5503 - RNA, 18 nt, Artificial Sequence
  Description of Artificial Sequence: Synthetic oligonucleotide
ugcgagccuccccagggc

SEQ ID NO: 5504 - RNA, 18 nt, Artificial Sequence
  Description of Artificial Sequence: Synthetic oligonucleotide
agcccugcgagccucccc

SEQ ID NO: 5505 - RNA, 18 nt, Artificial Sequence
  Description of Artificial Sequence: Synthetic oligonucleotide
acagcagcccugcgagcc

SEQ ID NO: 5506 - RNA, 18 nt, Artificial Sequence
  Description of Artificial Sequence: Synthetic oligonucleotide
gagggacagcagcccugc

SEQ ID NO: 5507 - RNA, 18 nt, Artificial Sequence
  Description of Artificial Sequence: Synthetic oligonucleotide
gaccagagggacagcagc

SEQ ID NO: 5508 - RNA, 18 nt, Artificial Sequence
  Description of Artificial Sequence: Synthetic oligonucleotide
cuccugaccagagggaca

SEQ ID NO: 5509 - RNA, 18 nt, Artificial Sequence
  Description of Artificial Sequence: Synthetic oligonucleotide
gccuucuccugaccagag

SEQ ID NO: 5510 - RNA, 18 nt, Artificial Sequence
  Description of Artificial Sequence: Synthetic oligonucleotide
aaccagccuucuccugac

SEQ ID NO: 5511 - RNA, 18 nt, Artificial Sequence
  Description of Artificial Sequence: Synthetic oligonucleotide
ccgagaaccagccuucuc

SEQ ID NO: 5512 - RNA, 18 nt, Artificial Sequence
  Description of Artificial Sequence: Synthetic oligonucleotide
ggccuccgagaaccagcc

SEQ ID NO: 5513 - RNA, 18 nt, Artificial Sequence
  Description of Artificial Sequence: Synthetic oligonucleotide
gacguggccuccgagaac

SEQ ID NO: 5514 - RNA, 18 nt, Artificial Sequence
  Description of Artificial Sequence: Synthetic oligonucleotide
gcccugacguggccuccg

SEQ ID NO: 5515 - RNA, 18 nt, Artificial Sequence
  Description of Artificial Sequence: Synthetic oligonucleotide
cccuggcccugacguggc

SEQ ID NO: 5516 - RNA, 18 nt, Artificial Sequence
  Description of Artificial Sequence: Synthetic oligonucleotide
ccaggcccuggcccugac

SEQ ID NO: 5517 - RNA, 18 nt, Artificial Sequence
  Description of Artificial Sequence: Synthetic oligonucleotide
cugggccaggcccuggcc

SEQ ID NO: 5518 - RNA, 18 nt, Artificial Sequence
  Description of Artificial Sequence: Synthetic oligonucleotide
uccaugaccacggcggag

SEQ ID NO: 5519 - RNA, 18 nt, Artificial Sequence
  Description of Artificial Sequence: Synthetic oligonucleotide
ccuccuccaugaccacgg

SEQ ID NO: 5520 - RNA, 18 nt, Artificial Sequence
  Description of Artificial Sequence: Synthetic oligonucleotide
acuucccuccuccaugac

SEQ ID NO: 5521 - RNA, 18 nt, Artificial Sequence
  Description of Artificial Sequence: Synthetic oligonucleotide
cccggacuucccuccucc

SEQ ID NO: 5522 - RNA, 18 nt, Artificial Sequence
  Description of Artificial Sequence: Synthetic oligonucleotide
ccucgcccggacuucccu

SEQ ID NO: 5523 - RNA, 18 nt, Artificial Sequence
  Description of Artificial Sequence: Synthetic oligonucleotide
aggaaccucgcccggacu

SEQ ID NO: 5524 - RNA, 18 nt, Artificial Sequence
  Description of Artificial Sequence: Synthetic oligonucleotide
agcacaggaaccucgccc

SEQ ID NO: 5525 - RNA, 18 nt, Artificial Sequence
  Description of Artificial Sequence: Synthetic oligonucleotide
ccaccagcacaggaaccu

SEQ ID NO: 5526 - RNA, 18 nt, Artificial Sequence
  Description of Artificial Sequence: Synthetic oligonucleotide
gggcuccaccagcacagg

SEQ ID NO: 5527 - RNA, 18 nt, Artificial Sequence
  Description of Artificial Sequence: Synthetic oligonucleotide
ucaacguccuccaacccu

SEQ ID NO: 5528 - RNA, 18 nt, Artificial Sequence
  Description of Artificial Sequence: Synthetic oligonucleotide
cugccucaacguccucca

SEQ ID NO: 5529 - RNA, 18 nt, Artificial Sequence
  Description of Artificial Sequence: Synthetic oligonucleotide
uagcgcugccucaacguc

SEQ ID NO: 5530 - RNA, 18 nt, Artificial Sequence
  Description of Artificial Sequence: Synthetic oligonucleotide
augccuagcgcugccuca

SEQ ID NO: 5531 - RNA, 18 nt, Artificial Sequence
  Description of Artificial Sequence: Synthetic oligonucleotide
uguccaugccuagcgcug

SEQ ID NO: 5532 - RNA, 18 nt, Artificial Sequence
  Description of Artificial Sequence: Synthetic oligonucleotide
gcgccuguccaugccuag

SEQ ID NO: 5533 - RNA, 18 nt, Artificial Sequence
  Description of Artificial Sequence: Synthetic oligonucleotide
uccgugcgccuguccaug

SEQ ID NO: 5534 - RNA, 18 nt, Artificial Sequence
  Description of Artificial Sequence: Synthetic oligonucleotide
aggcauccgugcgccugu

SEQ ID NO: 5535 - RNA, 18 nt, Artificial Sequence
  Description of Artificial Sequence: Synthetic oligonucleotide
gcuguaggcauccgugcg

SEQ ID NO: 5536 - DNA, 1099 bp, Homo sapiens
cacgcagtggaagcactctggaaggcggtcgcggatctgttgcagccggagcggccgctggaggcccggcacgcggtgctggctctgctgaaggccatcgtgcaggggcaggtaaggcccagggcgacgctgggatgggtgacgtcaggctgcccactgactgtcctgtccctgctgggccgtgtttggactcctgcctcggtgagttgctgggcacagggtctaggggctgatgggctctggagctggatggcctgtggggtctcctggtgtcatgaggtctgtgtgaccgtaggcactgcctcctcgcctgtaaacagatggtcactgcaccttcctcttatgggatgttctggggatcatatgaggcagttctcgcagagtgctgagatcgtacctggcagctggtgtggggctacggtgttgttttgcccttgcaccctttcggggccactcccctgctcactgcattccatctgtgctggtcttggctgaccctgaacacccaggcctcttggtgttcctgcctcccctggtcggccacttctactccttcatgtcccagctgctcagaagggccgtccactctcacaggctctcctgggtttcccccactcaggccttgtcctcagtctctgagcacaaggctgtctgccctgcaccgagtgcaggggtcgggcaggagctgtgtcatcccctgctctgcgccacccgctgtgccaggtcccgacacacagcagttgctccccatacgccgctctgcggtcggccggtgcatccggccccctgccctgtacaatgctgatgctgcagacctgtctcttgcagggcgcctctgtgggaaggagaggggtccagggctggagtccgggtgcccctgcacttcagggacttcttggcagccgtgtgggcgacgctggcaggctctgctgatcctgtggcttttgtctttagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctgg

SEQ ID NO: 5537 - DNA, 2706 bp, Homo sapiens
ggcctgcggtccaatgtcctcttgtcttttgatgacacccccgagaaggacagcttcagggcccggagtactagtctcaacgagagacccaagaggtacggcctgcgggggtgtgcctggagtcggtgtggggtggggaaggacatggggctgtggcctgcctgacggtgcctccaagtcagtgagtggaaatgggtcctgtgtgccctggagtatgtgaggcagggcaggacctgcaagggccgctaacacccctcagcccctcagcaggttggccgtggtggcctgggtccgggctgcgtgtgccacgggcacctacttgtggaattgggggttggggtgcaagctttaggcgcctgagcccctcgaaggagccggccttgtctggggctgccccctcctctgcagcccccagcctgctgctagccggggactctgcttcatcaccgccgccttgccggaccgcaaagagctgagccagcctctgtgttcttgtttgcatttcatttgaacggctttctcctcctgtcccccaccttcctgcccgagctattttggctttccctagatgggaatacggcattttccagcgtgacctcaactcggaagctgttgtctccagcccctgggggccgggggccaagctcggccattacggccagagactactttctggggtcttggtctcttttcctagtgaccttcagggcctggccactgaggcctcagtgccgcctcggtcagagctgggcggtgcctgccttccgcgggtgggtgggattgcctggccagcacagcctggaatctgccgtgggggtgacccacacacgtttaatttgcactgacgttgtttgttttggtgtcatgcgtgaagccttacttgttctcagtcatgtttaccagacgtattatcatgcatttttgttttctgtctcttccccgctaactgccctttggcatggctctttttgctcatctcacccgcgggatctctccatcctgaccctgtggcctgggacctttcctcctcacccctccactggcttgttctccccttcccgggagctgggctctctggggcgttggggctccttcctcacccgatagtctgaggatagccagaccccccaaacaaggcttgaataactctccacccgtgaaagaattcaaggagagctctgcagccgaggccttccggtgccgcagcatcagtgtgtctgaacatgtggtccgcaggtagcgggactgtcgggtggggggcacggaccctggagcttggccccgtgagcacctgggtggcagtgcatggggctgcttgcatgacctcatcgtctgcccgtgtcctccctggccagcccagggggagccggtgacgaggggtggaaaggttgcattctgtccccaggccccgtatgagcacgggctggttgcacgcatccccaggccccctcggggtgccgctccgagagagccaggcgtgccgggcagcagcctccccaggctgtccccaagggccgcagtgtgggttgggggagacaccactcctggttttggccttttcgtattctctagaatggacgtttttcttcgggctttcttctcaacaaggtttattttttgttgtagctgaaagggaacaaggggcatttgtggagggtgctggggtggggcagcctgggagggcctgggtgggggctaggatcctgcagggcatgggcatgggcctgggccccaggccatggtcttagttctccccgcagtgtctgggtgcaggtgtgggctctcgggctctcggctgtcacctgcctgtgggtcatcgctgctggcactggcagaggggatacctgtctcctcctggaagcccgttgcaggccaaggggtcccatggccctcagtccatccacctcctcacctcaggccggcctctgctgggtgggacttggccaggggttggggtggtagaggtgctcggtgaggcttaaagccattttctagcacattctgtatcatgagcaaaatattgcctaggggctatgaaatttgtatcagaatgaactcccataagcctcttccctgtcactgggtgtggagctcaggcagccgctcgcctgcctgagggtgacggtggaaggccacatggggatcccagacctctgtgtgcttgccggaggcagcctgcgggcagaatgcaatctgggcctgtctgtgtggcctccgcctctctgcatgactacaccgtttcgccaggaggccgtaacctagtgctcccgtgggcttcggtgagggggatgtcggtctctagcctcctgagtctgctccgaccagtaggcctggtcttccccacccagcgtctccccgttctctgggacaatgtggtccacgtgattctcaagctgaggctcgctgggccgcccacgccctgttggggtctttccgagcgaggtcctcagccgtgcatgcgttgagctttggcccttggtgataggtggctcggcccgccctacctggcaccctgaccctggtcacggcctctccctccagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagag

SEQ ID NO: 5538 - DNA, 1599 bp, Homo sapiens
tctgaggatagccagaccccccaaacaaggcttgaataactctccacccgtgaaagaattcaaggagagctctgcagccgaggccttccggtgccgcagcatcagtgtgtctgaacatgtggtccgcaggtagcgggactgtcgggtggggggcacggaccctggagcttggccccgtgagcacctgggtggcagtgcatggggctgcttgcatgacctcatcgtctgcccgtgtcctccctggccagcccagggggagccggtgacgaggggtggaaaggttgcattctgtccccaggccccgtatgagcacgggctggttgcacgcatccccaggccccctcggggtgccgctccgagagagccaggcgtgccgggcagcagcctccccaggctgtccccaagggccgcagtgtgggttgggggagacaccactcctggttttggccttttcgtattctctagaatggacgtttttcttcgggctttcttctcaacaaggtttattttttgttgtagctgaaagggaacaaggggcatttgtggagggtgctggggtggggcagcctgggagggcctgggtgggggctaggatcctgcagggcatgggcatgggcctgggccccaggccatggtcttagttctccccgcagtgtctgggtgcaggtgtgggctctcgggctctcggctgtcacctgcctgtgggtcatcgctgctggcactggcagaggggatacctgtctcctcctggaagcccgttgcaggccaaggggtcccatggccctcagtccatccacctcctcacctcaggccggcctctgctgggtgggacttggccaggggttggggtggtagaggtgctcggtgaggcttaaagccattttctagcacattctgtatcatgagcaaaatattgcctaggggctatgaaatttgtatcagaatgaactcccataagcctcttccctgtcactgggtgtggagctcaggcagccgctcgcctgcctgagggtgacggtggaaggccacatggggatcccagacctctgtgtgcttgccggaggcagcctgcgggcagaatgcaatctgggcctgtctgtgtggcctccgcctctctgcatgactacaccgtttcgccaggaggccgtaacctagtgctcccgtgggcttcggtgagggggatgtcggtctctagcctcctgagtctgctccgaccagtaggcctggtcttccccacccagcgtctccccgttctctgggacaatgtggtccacgtgattctcaagctgaggctcgctgggccgcccacgccctgttggggtctttccgagcgaggtcctcagccgtgcatgcgttgagctttggcccttggtgataggtggctcggcccgccctacctggcaccctgaccctggtcacggcctctccctccagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagag

SEQ ID NO: 5539 - DNA, 2706 bp, Homo sapiens; identical to SEQ ID NO: 5537

SEQ ID NO: 5540 - DNA, 2222 bp, Homo sapiens
ggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacaggtgagtggcatggcgggccttggcacgggctctgctcccactggcctggtgctcccggtgacggcaatgtggctcctctctgctgagggcgcccacacggctgggagtggtccctggcctgcctcagcaccattgttctccggtgtttgggaggaggctgacccgtgggaggtgtctgccctgctcaggaagctggggctggcagcttcagaagcagtaggggccctgtggagcctctgcccagcatcctccgtggggagtccagcactgcgggctccaggaggctctgcggcagcctccctccctgcctgggcccaggtttggacacctgagcccgcctgcgcactctgggcccccaccccactcggcaccgtgcttctcgccaggccctctggctcttccctgtggctgcagatggcacttagcggcctaggacgtctattcacgggaggagggaggcactgccctcctcaggtctgcccaagcagcttgtagctagcactgggccccgtgcgcgcccctgccggccgctggccctgccctctctcctctgcaggcacggggcctgtgctctctgctcgacctgtgtgtagcccctcctcctgctgacgtggccgcacacggccttcccttgcagtggcctctttctcctccctgtaccagtccagctgccaaggacagctgcacaggagcgtttcctgggcaggtatcgcctctcagagggaagcggttggctgcagagcgccactctgcctcataggtgctgtgctcgtcgcctcatccgcccacccccatggtccgtctgcctccattgccctggggagcaggtcccgactcgcatgaggacgtctgtgcagaatgtctttggcttggccagcgggatccccttgacttggtccctttgtggctgagccctgttcccacgctgtgcgagcactcccggcccagcttcaggcctgaggggtgggggtggcctgagtctccatggtgacatcagctgagctgcagactctgatgggtggcagctgtttagggggaagcccacccctgggcctgcaccgagcgggccttgccctggcctttggtggctcccctggcctctggaacccacagatggggctgcctcaagtcccaggttgaccaggggccctgcagaccgacctctgcctgttgcccccaagccctggtggggagtgctgtgacctgcatggtgctcccctgccaggtctccacgtgcagacgagctggtttggaagggctgcgtgggacgggccctggggtggctgactgcgcgtgtgcagggctgtggggcgcccgggggctgtgatggtcccctctgttgctgcttctacttcctctccccctgtcctgacgctggcacaggaaatgctgctttgggacctcccaccctctctccttagcgtccccagctgtgggtctggcttggagttggagggtgagcctctgctcttgggagcagtctgtttgcaaacagggacttcccccacgtcacggagtctccgcagctctcctcggttacgagggctggtttcaggctcccgctcttttagagctgaggcccgtcgggcggagagcgtcttgcccctgcctacctggaggcacaggggtggctgctggtggacactagggtgggcagagccgattgcctgcccaacccccgggcactcatgcaggagaggcctgtgtcggggtcacgtgcaggccttcccagcgtcctccctgcccgctcggtggatggcagcagtaagcagagccctggggaggctcgcagggctgctgtccctctggtcaggagaaggctggttctcggaggccacgtcagggccagggcctggcccagccccacatccagcagccccgtctgtgtcctcccagactccgccgtggtcatggaggagggaagtccgggcgaggttcctgtgctggtggagcccccagggttggaggacgttgaggcagcgctaggcatggacaggcgcacggatgcctacagcagg

SEQ ID NO: 5541 - DNA, 4041 bp, Homo sapiens
gaactgagcatggaatgtggcctcaacaatcgcatccggatgatagggcagatttgtgaagtcgcaaaaaccaagaaatttgaagaggtaggtttatccagttgagctactagagagaggcacgtagactattcagagcctgagtttgctttttttaggaacatggttgacagctgactgccgatgatctggtttgcactttttttttttttttttttttgagatggagtcttgctctgtcgcccaggctggcacaatcttggctcactgcagcctctgcctcctgggttcaagcagttctcctgcctcagcctcctgagtagctgggattacaggcacgcgccaccacacccggctttttgtatttttagtagagacggggtttcgccatgttggccaggctggtcttgaactcctgacctcgtgaaccatatgcctcagcctcccaaagtgctgggattacaggcgtgagccactgcgcccagccagtttgcactgttttaggggaatttagctttcatcgtagtgatggggaagctactggaaatgccccgaatacaaccttgagggaccaatcaagcgtggaaatggggagcaaagggattaggcttttctagcaacaccagaaaggatttctatgccgagcgggggtgcgggggcttatgcctgtaatcctaggactttgggaggccgaggtgggtggatcacgaggtcaggagttcaagaccactctggccaacatggcgaaaccccgtctgtactaaaagatgatgagccgggcatggtggcacatgcctgtaatcccagctacttgggaggctgaggcaggagaatcgcttgaacccgggaggcacaggttgcagtgagccgagatcgccccactgcactccagtctgggtgacggagcaagactctgtctcaaaaaaaaaaaaaaggaagagtttgtagtggctgatagaaacgcatgctcactcgctctctcctgttacaagttcaggccaagaaaaatcaagaaagggtttgttccacagagaacaatcctaggcacgctggtcttggtgccattttgggagggtgactggtcggtggtattgggcgacctcacggacatagaaatatttattttgggcaaacattgccagactttcctgatgacttgtggacaggacaggaagtggtcattttgggagtgcaggttgctggtagagcacctgagggctctgcccttgccttgcccagcatttgtgtgtgggagagcagtgagacctggacctctcatgctcagatctgctaagaggagagtgattgctacctctgcagcagctcatctgaaacgtgctggccgtacgctaccaaagataggtgtaaagaacaggtgtccttagccgggcgcagtggttcacgcctgtaatcccagcactttgggaggccaaggtggatggatcacctgaggtgaggagttcgagacccgcctggccaatgtggcaaaaccctgtttctactaaagatacaaaaattagctgggcatggtgtcgggcacctgtaatcccagctacttgggaggctgagggaggagaatcgcttaaactcaggaggcagaggttgtggtgagctgagattgtgccattgcactgcagcctgggcaacagagcaagactgtctcagaaaacaaaaaaaagaacaagcgtcctgcatcctgttctgaaagttgtttgtgtgggtacggggcagcctgtgagtggataaataggcctccgaggctgggatggtcccgggccctgtgtccacggatctttgcagctcaggttgcaacggtaagagtattgtcaatgagacaaaggaggtgagagtgccagttgtctgaattggttgggatgttggtcagatgacatctaaaagaacacggccattttgttattatttggttagagacaaggtctcactctgtcacccaggccggggtgcagtgtcacaatcatggctcactacagcctcaacctgccaggctcacgtgatcctcctactttagcctctcaagtagctgggactacaggcatgcagcaccacgcctggctaagttttgtattttttgtcgtgacagggtctcactgtgttgcccaggctagtctgaaactcctgggctgacgtgaccctctcccctctgccacccgaagtgctgagattacaggtgtgagccaccgcacttggccagaacacggccattttagttcccctccttagaggagtaaggccaggaatgagcctgtggtctgaaagccgtggctgttggttaatgtggagaagggaaggtggtgagagccagcccaaacccctgccgagtgagactgattctggcagctttagggagcagggatgagcccctcacaggctgggtggtagttagaggaggcagatttcagaaggccacgcagcgctctttctcagcaggtcaggcaggcagcagaggtcgggcaggggcatggggtcgagggcccgatgctggtgtgttcactagaggagagccacaagcagggattctgggtcaggtgcaggcctagggcttagtgtgcacttgtggttctgagactgtcccatgacttcctgccagcattccggcagctctagtgggactccctcctggtccaggtgaggccaccattgctgccctggcttgctgctgtcctctcagcccccagtctgtcacctggtgggagttaaagggacctgctggggtttgaggaagctctgagccgttccctgtacgaagcctgtggtcatctcaggctgcaggagacacaggagatacgagctttggaggtggggctctcagtcacaagcccccgttgttcctccctgtcctccgctcacggcactgctccagttgccggggccagggttcttggagagcacatcctcaccgctgtcccctctgctggtgacagcacgcagtggaagcactctggaaggcggtcgcggatctgttgcagccggagcggccgctggaggcccggcacgcggtgctggctctgctgaaggccatcgtgcaggggcaggtaaggcccagggcgacgctgggatgggtgacgtcaggctgcccactgactgtcctgtccctgctgggccgtgtttggactcctgcctcggtgagttgctgggcacagggtctaggggctgatgggctctggagctggatggcctgtggggtctcctggtgtcatgaggtctgtgtgaccgtaggcactgcctcctcgcctgtaaacagatggtcactgcaccttcctcttatgggatgttctggggatcatatgaggcagttctcgcagagtgctgagatcgtacctggcagctggtgtggggctacggtgttgttttgcccttgcaccctttcggggccactcccctgctcactgcattccatctgtgctggtcttggctgaccctgaacacccaggcctcttggtgttcctgcctcccctggtcggccacttctactccttcatgtcccagctgctcagaagggccgtccactctcacaggctctcctgggtttcccccactcaggccttgtcctcagtctctgagcacaaggctgtctgccctgcaccgagtgcaggggtcgggcaggagctgtgtcatcccctgctctgcgccacccgctgtgccaggtcccgacacacagcagttgctccccatacgccgctctgcggtcggccggtgcatccggccccctgccctgtacaatgctgatgctgcagacctgtctcttgcagggcgcctctgtgggaaggagaggggtccagggctggagtccgggtgcccctgcacttcagggacttcttggcagccgtgtgggcgacgctggcaggctctgctgatcctgtggcttttgtctttagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctgg

SEQ ID NO: 5542 - DNA, 1236 bp, Homo sapiens
ggcctgcggtccaatgtcctcttgtcttttgatgacacccccgagaaggacagcttcagggcccggagtactagtctcaacgagagacccaagaggtacggcctgcgggggtgtgcctggagtcggtgtggggtggggaaggacatggggctgtggcctgcctgacggtgcctccaagtcagtgagtggaaatgggtcctgtgtgccctggagtatgtgaggcagggcaggacctgcaagggccgctaacacccctcagcccctcagcaggttggccgtggtggcctgggtccgggctgcgtgtgccacgggcacctacttgtggaattgggggttggggtgcaagctttaggcgcctgagcccctcgaaggagccggccttgtctggggctgccccctcctctgcagcccccagcctgctgctagccggggactctgcttcatcaccgccgccttgccggaccgcaaagagctgagccagcctctgtgttcttgtttgcatttcatttgaacggctttctcctcctgtcccccaccttcctgcccgagctattttggctttccctagatgggaatacggcattttccagcgtgacctcaactcggaagctgttgtctccagcccctgggggccgggggccaagctcggccattacggccagagactactttctggggtcttggtctcttttcctagtgaccttcagggcctggccactgaggcctcagtgccgcctcggtcagagctgggcggtgcctgccttccgcgggtgggtgggattgcctggccagcacagcctggaatctgccgtgggggtgacccacacacgtttaatttgcactgacgttgtttgttttggtgtcatgcgtgaagccttacttgttctcagtcatgtttaccagacgtattatcatgcatttttgttttctgtctcttccccgctaactgccctttggcatggctctttttgctcatctcacccgcgggatctctccatcctgaccctgtggcctgggacctttcctcctcacccctccactggcttgttctccccttcccgggagctgggctctctggggcgttggggctccttcctcacccgatagtctgaggatagccagaccccccaaacaaggcttgaataactctccacccgtgaaagaattcaaggagagctctgcagccgaggccttccggtgccgcagcatcagtgtgtctgaacatgtggtccgcag

SEQ ID NO: 5543 - DNA, 910 bp, Homo sapiens
ggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacaggtgagtggcatggcgggccttggcacgggctctgctcccactggcctggtgctcccggtgacggcaatgtggctcctctctgctgagggcgcccacacggctgggagtggtccctggcctgcctcagcaccattgttctccggtgtttgggaggaggctgacccgtgggaggtgtctgccctgctcaggaagctggggctggcagcttcagaagcagtaggggccctgtggagcctctgcccagcatcctccgtggggagtccagcactgcgggctccaggaggctctgcggcagcctccctccctgcctgggcccaggtttggacacctgagcccgcctgcgcactctgggcccccaccccactcggcaccgtgcttctcgccaggccctctggctcttccctgtggctgcagatggcacttagcggcctaggacgtctattcacgggaggagggaggcactgccctcctcaggtctgcccaagcagcttgtagctagcactgggccccgtgcgcgcccctgccggccgctggccctgccctctctcctctgcaggcacggggcctgtgctctctgctcgacctgtgtgtagcccctcctcctgctgacgtggccgcacacggccttcccttgcagtggcctctttctcctccctgtaccagtccagctgccaaggacagctgcacaggagcgtttcctgggcag

SEQ ID NO: 5544 - DNA, 1381 bp, Homo sapiens
tggcctctttctcctccctgtaccagtccagctgccaaggacagctgcacaggagcgtttcctgggcaggtatcgcctctcagagggaagcggttggctgcagagcgccactctgcctcataggtgctgtgctcgtcgcctcatccgcccacccccatggtccgtctgcctccattgccctggggagcaggtcccgactcgcatgaggacgtctgtgcagaatgtctttggcttggccagcgggatccccttgacttggtccctttgtggctgagccctgttcccacgctgtgcgagcactcccggcccagcttcaggcctgaggggtgggggtggcctgagtctccatggtgacatcagctgagctgcagactctgatgggtggcagctgtttagggggaagcccacccctgggcctgcaccgagcgggccttgccctggcctttggtggctcccctggcctctggaacccacagatggggctgcctcaagtcccaggttgaccaggggccctgcagaccgacctctgcctgttgcccccaagccctggtggggagtgctgtgacctgcatggtgctcccctgccaggtctccacgtgcagacgagctggtttggaagggctgcgtgggacgggccctggggtggctgactgcgcgtgtgcagggctgtggggcgcccgggggctgtgatggtcccctctgttgctgcttctacttcctctccccctgtcctgacgctggcacaggaaatgctgctttgggacctcccaccctctctccttagcgtccccagctgtgggtctggcttggagttggagggtgagcctctgctcttgggagcagtctgtttgcaaacagggacttcccccacgtcacggagtctccgcagctctcctcggttacgagggctggtttcaggctcccgctcttttagagctgaggcccgtcgggcggagagcgtcttgcccctgcctacctggaggcacaggggtggctgctggtggacactagggtgggcagagccgattgcctgcccaacccccgggcactcatgcaggagaggcctgtgtcggggtcacgtgcaggccttcccagcgtcctccctgcccgctcggtggatggcagcagtaagcagagccctggggaggctcgcagggctgctgtccctctggtcaggagaaggctggttctcggaggccacgtcagggccagggcctggcccagccccacatccagcagccccgtctgtgtcctcccagactccgccgtggtcatggaggagggaagtccgggcgaggttcctgtgctggtggagcccccagggttggaggacgttgaggcagcgctaggcatggacaggcgcacggatgcctacagcagg

SEQ ID NO: 5545 - DNA, 70133 bp, Homo sapiens
gcgccgggaagaaaggaacatggctcctgaggcgcacagcgccgagcgcggcgccgcgcacccgcgcgccggacgccagtgaccgcgatggtgaactccagtcgcgtgcagcctcagcagcccggggacgccaagcggccgcccgcgccccgcgcgccggacccgggccggctgatggctggctgcgcggccgtgggcgccagcctcgccgccccgggcggcctctgcgagcagcggggcctggagatcgagatgcagcgcatccggcaggcggccgcgcgggaccccccggccggagccgcggcctccccttctcctccgctctcgtcgtgctcccggcaggcgtggagccgcgataaccccggcttcgaggccgaggaggaggaggaggaggtggaaggggaagaaggcggaatggtggtggagatggacgtagagtggcgcccgggcagccggaggtcggccgcctcctcggccgtgagctccgtgggcgcgcggagccgggggcttgggggctaccacggcgcgggccacccgagcgggaggcggcgccggcgagaggaccagggcccgccgtgccccagcccagtcggcggcggggacccgctgcatcgccacctccccctggaagggcagccgccccgagtggcctgggcggagaggctggttcgcgggctgcgaggtaagagcgcgcgacccgcagcggcagatgcacgaaccagaacggccggcgccggccggggccatcgcccgctgcggcagctccccgggctccatctcgcatcccctctgcgttccgcctcccttggaagcgcattccccacctccgctagtgctgccctatttccggtacccagcgcggaattccactgctcttttgttggtgcatatttattggatacctccttcttcaggatatgtcaccatagtcttttttactgaaaattagtgaaagcctaattagagtgaaagagtacatctgggttttgtttttttttttcttgtagaggaaaaaatgaacattacttgtgtaactgatggtagttgcaactgcatatttgccaatgtcacaaaatctaaaggaaaatgttatagtcacccgtggtttccttcttgcctggacactccattgtcccgggctgaaaagggtagcagtacagtgcatataatgtcaagttgtgggaggagtgtggcagattgtcattggtgcatttttttggtgatgtgtgtggttgttttgaggagtgggagctgttaagaacaccacaaatagaataaaataatatcgtgaagttatttggccgtttctaattctagacatttttctaaaaacagttgcaaaggaaagattacattgttttaaaaaaatttgaagtatgtttttaaataactaaattaatgttctttgaaattccaccaaaatgatgaagtcaccagatagcagctgataaatgtgtctgagcccagtgcgcccagctctacaaaaggcagaagaggaattttcaaatttgccagtgcccagtaagaggacatgaattttctagtaccagaggaaattctctttttacaaattttgtcagaggtatccttgggaaagtatttcatttgcttttaccctccaaattattttaatctatatttttaagagtttccattctcagttgagtttttcttgttcttctccttctgtcagttttgaaagtcttgcacaaaaacaatccaggtgttgttacagcagtgtgattaaaaccaggtcaggcctacactgaaatcccagttccaccactcattagctgtacgaccttgagcaagttacttatcctctctgatacccaatttttggattttttttttttttaaagagatgatcataacgcttaggacttgactctttgggagaattaagtgagttaagacataaaatgtgcagcatgtatttgtcatgttattagcgcttcagaaatataaatgtaaacattttggtacttcgtttatggagattcttatactagttaattttattaaaagcatgatggggaacagaagatccttttcggataacctgtgtgagtaaattaataaaacactaacactttttaagattcaaaactggattaattatgttattttacaccatttaaaatgtgcatttaaaaaatattcactgaagtgagagagaagttccttttaagttaataaataatggtaagttgcatgatccttttaactcagtttaagcatttgataacacccctaaccttgtttgaataaactcaataacagaatatagagaaataaaatatatatttcatatgagtatgtatgtaaatttatttcttttaaaggaaaatttcaggaaacaaaatgaataagctcatagtcataaaacctctagccaaagtgtgtcaatggtctgatttgtaggagagcagactcaggaatcgggaattttttttttttttttaagagtcggggtttcactctgtcactgaggctggagtgcggggaagcaaacgtagctcactgcggcctcaaactcctgggctcaagctgccctcccacctcagcttcccaagtagttgggattacaggtgcaagctgctgctcctagctgaaaagttttaattatataaaatgtttaaataaattgttattcctttcttttatgaagaaatataattgatattcttgtcacttattaaataagcaacattttaaaatgtttagcacctactgtgaagatagcactgtgctagctgctatgaataaactagaatagcatatcactgttttcctatggacaaaaacccagaaatgtaaaataaatagccatgaatgggttgagattccccctgccccctttggatactgatgacagaaatcttatatgcactatgtaagcagtgccctaggatcagaacagaaagtaacttgcaatttttaaaggtgggagaaatgactgaagtttggagtggtcaggagtttccctggaagtctcttgcctttgtgactttgtatagctccctcaaactacctgagcctgagctcctcatttataaaatggaagaattgaacctagcttccaaggtcctttctagcttcaccatgctctggtctgttgtttaatgacatgaatccaagatggacaacaaatggtcgattttgctccttctacagtaaatagatctatcttcttagcagaagtaaaatagtaaagaaagaagacatgtttgaggcctgttgaggcctgtttgctgtatgcattgtatctaatcaaggaattgagaatgtagccctaaatattaggaaggagttgaaagtttctgagcaggaacagaacatgctgaaaggaaattgtgtcagcagcatggtgtacaggagagcttggcagagagaaaggaggcaagaagacctgtgggaggcagccagtaaggaggtgaagagggcctggaccaaaggaagccaaggatgaccgaaagatttaaagatgaagcccagatttaaaagtatcctcaagtatttgtttattcttttcttagcaaattctttttagtacaaagataaaatatggcactctgagtcataaaattttctgaatttcagaagttgaatgtttttctgaatgtatcaacctgttaaagtcagttcctgtttgttattttaggcgtatattcttgggcttttttttttttttcctagagaaactatgaagtactagctgtgcaagtcagggtgggctaagctgctaaaacagatacctccctccccttcaataccctgaagaacaagaagttaattttttgctcgtgtaacattttagagagggtattccaggttgaatacctggaataatgaatgaaataataagtcgactcttatttctcctaaaataattggatcttgacattgaaattggtgtgctgattgtatttaataagtgacctccaatgcagttatttcattttgccatactttatgtaatttttattttttctgccttccctttcgatgtctaaagggaagcataattagttattggaaaggttattgagacttaaaaaaagatttgaacatggctttggttgatgctaccacacagaaactgcaaacatccaactcaccgctcttagttgctgttcatgatagtctatgcacagtgactgatgaatttagcctgtcttgaggcttcagaacttagtcttatgtcatcacgagcagagctttatcctaaattacaggttttcaatgggggggggggggaggggcagttttgcccctcaggggacatttggcaatctctggagacatttttgattgtcatacctggggggatgcccctggcatctcctgggttgaggttaaggatgctgctaatctacaatgcacagtacagccaccccacacacacacactacaaagcattctcccacccaaattgccaggagtgaggactttgagaaaccctgccctagactgttaaattcaaaaggaaataatggtttattgctcacagtgtgccaggcactgtgttaaactccttatattcatagttttgtttttatcctcacaacaacctgtgaagaaagaactctcatccgtcaccactttactgttgagggcactaagccttctaaaggttaaatgacttgcccagggccgcaactattagatgttgcagtcaggatttaattccaggcactttgtgttcaaagtgtttctcatccactgtgctatatgccagtagtgcccaaacctaactttagccagcaattgtctgcatctcttcagtttatgaacatttatttattaggacatgcaggataatcataccaacacagtccgtgtatccagaattctaattgatctagggagtgggagagcctgcctctctattttttttaaattggtgtgaaatatacataacataaaattggccattttaaccattttaagtatataattgagtgacattaggtagatttattatattatgtaaatggacttaacacaatttatttccagaacttttttatcatcccaaacagaaactctgtactcattaaacagtaactccctgtttccccactcccccttgccccagacgctagtaacctccattctacttcccctttctgtgagtctccctgttgtagctacctgatgtaagtgaaatcagaccatgtttgatcttttgtgtctggcttattcacttagcatagtattttcaaggtttatccatgcgtgcaaattcccttcttttttatgacgaaatactatttaattgtgtgtgtacatgtgcacacacaatgaaatactatttcatcataaaaaggaagtttgtacacatatatacacacacaccaaattttgtttatccattcatcagttcatgggcatttgcggtttttttccacctttcgactgttgtgactttccgtttatttttaatctgaactttactccatcacttcctccctttccttttttattcgcaccataattttgaacaagcagactttgtattttcattactctggggatttttttgagggaggcttgctaccctttggggttgtggtaaggttgtgccagtaacagaattcatgcagtaaaaaacattcatgggactttcttttgtgataggtactagggatgcagagatgaataatacaaggtctcgaccttcaaggagctcagggtttagtagggaaaacagaggtataagtaagtcattgcaatgccaggtcccagatatgggaggattccagcaaagagaggataaggccaggcacagccgctcatgcctatagtcccaacactttgggaagctgagatgggaggatcacttaagcccagcagttcaaggctaccctgggcaacatagtgagtggcaaaaaatacaaaaattagccaggcagggtggcacatgcctgtggtcccagttatttgggagtttgaggtgggagaatcacctgagcctgggagattgaggctgcagtgagctgtgatcacgccactgcactccagcctgggtgacacagtgagaggtgagagcctgtatctaaaaaaaaaaaaaagagaggatcagatttacctggagaggtcagagaaggtttccagagggagtaaaacttgagcttcattttgaagaatgagaggggaatacaaggagggaaaaataataggaacaagacctgttcctgttacagcaaacctgtaactcccaccatggaatgggcacgttttcctgtagacatttggagccagtgtgggcttcaagcctagggggctgatatgatcatttgtcaatctgaagatgactcttggaacaacgtagaggatagggtgaggtgggtaggctggtggctgacagactaggtcaggagagggctgaccaagaggaggaggggtgacgagggctggaactaaggcatatgagctgggatggaaagaagctagatagaaaggaaacaaaaaccatcagaactgtggaaccaactccatgggagggataagaagagggcctattctagggtgaaacccaaatttctggcatggtaccattaacccaaacagaaagaggagatttccagagaaagaaaagcaaattttgcgggaggtgagtgtgagctgtctagagaatatgcaggtagaactacatgttaactgtaacatatacttgtctgcacctcaggagatggctgattaagaattcaggattcaggccaggcacggtggcacacgcctttaatcccagctgcttaagagactggggcgggaggattgcttgagcctgggaatccgagatcagcctgggcaacatagcaagacactgtctctaaaaaaaaaaaaaaattcaagattctggagtcaatattacttaaggtagcaactgtctattctatagaaaatggacaaatatagataaaaagccacttccctttctaaaagtgtccctgcaattcaagtgaatactaggaaggattgtgttcattcttctaaacaagactcacatgtatcttagcacaaaaagaggattcttttatgatacaaatgcactgagaatttggtcaggctatcacaatgaactgatagttcagatggatttgagtctttataccactctggaatctggaccaactgggcctcctaaggccattttgcagatctgggcttgtttctgaagctacagacaggcctcttccaagcactctaagtgctccacaaataatatttctgtttcccagaacaaccccacaaaaaggtactcttactccatttttagatgaggaagtggaggctcatgatgtcaggtaagctttctcagctcccaagtggttaagccctcagtttaatgtcatttgactccagagccctatgttgcaccatgccttgataataggccatatgggtttcatgtatttcagatggggaaggttagtgtgaggtgaaagatacacaattaaccttttaaccatggaactgaaatatttacagatgaagtgatacaatagctggaattaattccaaaataattggggtggtactggtccatggcctgttaggaactgggccgcagagcaggaggtgagcagcaggctagtgagcattgctaccccctatcatatcagcagtggcatcagatgggtgaggatgtaaatgaactaggattggcattgagttgatattgttggatctaggtgatagatttatcattataatattctctctttgtgatatttctgatattttctaaaataaaaagttgtagttatttatttatttagacggagtttcactcttttgcccaggttggagtgcagtggtgtgatctcggctcactgtagcctccgcctcccgggttcaagcgattctcctgcctcagcctcccgagtagctgggactacagcctcccgagtagctcaccaccacacccagctaacttttgtatttttagtagagaggaggtttcaccatgttagataggctggtctcaaactcctgacctcaggtgatccacccacctcggcctcccagagtgctgggattacaggcgtgagccagtgtgcccagccaataaaaagtttttgaaaggatttagataaaatagttggggaaatggcatttttgttcaaagccaattatttatgtttggaatatcttttgtgcttggagttctccattacagagttccccagtgttcctattaataagtaacattgagcagaggaatgcactgtttagatcagcagtccccaacctttttggcaccagggaccggcttcatggaagacaatttttccacagacctggggtaggaagtgtttggggatgaaactgttccacctcagatcatcaggcattagtgagattctcataaggagcaggcaatctagattcttcacatgcgcagttcacaatagggttctcactcctgtgagaatctaatgccacccctgatctgacaggaggcggagctcgggcggtaatgctcacttgcctgcggctcacctcctgctgtggggcccggttcctaacaggccatggaccagtacccgtctgcagcctggggactggggaccctgctttagatgatgtactctggctttgcattctggcattagctaagcaccctcttaaaggaaattgggtctatactctcagtccgtgttctccctaacacctggaaacattgaataccttcaatgctgggaagttaactcccaccacaactagaacagctatgggaaagacaacagttgattttgaagagtgtcaccaatttgcacatgattccatccttaaccattcttatcctatcagctctgccaaacatggagaatagttggctgcaggacagctatttttcctacttgtagatgcaactatttctcacccaccaggatgtaaaaggtccctgtaccctaagattggtcctacatacacacccaatgggaaaatgagatgaaaaatttaaagcagtaaatatttgaggaagtagatagagtaatttagaaaaagaaaatacacagggccaagcacagtggctcacatctgtaatcccagcactttgagaggccaaggtgagaggattgcttgagctcaggagtttgaggccagcctaggcaatgtagtgagaccccacctctacaaaaaattaaaaacttagttgggcttggtagtatgtacctgtagtttaagaaacttgggaggctgagctgaggcaggaggattgtttgagcccgggtggtcaaggctgcagtgggccatgattgtgccagagtactccagcctgggtgatagagtgagactctgtctcaaacaaaaaaaaaaacagagacagaaaaaaagaaagaaaatatatggatgtatatcatataaaaatataaataagggaggccaagtgcagtggcatgcctgtaatcccagcactttgggaggctgaagcaggaggatcacttgaggccgagaattcgagaccagcctgggcaacgtattgagacctcatctctgcaaaaaatcaaaaaatgaggcggaaggatggcttgagcccaggagatcaagccttcagtgagctgtgatcgtaccactacactccaggctgggtaacagagagagaccctgcctcaagataaataaattcatacatacatacatacatacgtacatacatacatacataagaagacttgtttctttccatttgcaatgtttcattcaaaggctagaattaaattgccgtaggccatcacaagtttagcttgaatattattattttttcaagatggagtctcactctgtcacccaggctggagtgcagtggtgtgattttggctcactgcaacctctgtctcccgggttcaaccgattcttctgcctcagcctcccatgtagctgggattacaggcgcccgccaccacacctggctaagttttgtatttttagtagagacagggtttcaccatgttggccagactggtcttgaactcctgacctcaagtgatctacccgcctcaccctcccaaagtgctgggattataggcttgagccactgcacccagcctagcttgaagaaaatttgataggagtttgtttttttctatttataggccaagcaataccacgtataaatattaagaatcatggctgttccttagtgcctagttgtttataaaccatgggaaagaatgaaatcattgaccaaatgagacagggtaacagtcttccctgggagtaaagagactagcagtctctattgacatatattttaggcctggcctccaaaataaatttacccaaagaagtgatgtatttgtgtccagggctaccgagcctaatctttggctgcctctgtgttattctaagttgtaattttccatgtcatctaaatttgtaataattctttaatatgatagtgtttcagtgaacaaacattctgcttgctgcatttcttctgagtgagtaattccctgacaactaccagatcttggcagaagcaaagttggtcataagttatgctccactctcagtgctggtgaaacgtatgatgcgtaacacagtgtttttgaattcagtgctgattttcctaaaggacatttggaaggaaaaaagaaaaggaaaggaaatacccaaattcaggaatagaacttacatattattataagacttaaaaaatacatgaacactaatgatgaactcatttcttcgaagtaaaaggccttatgctattttttcccatttccctatgtggcttgattgtggcgaaagtggctgtgtgagtttccattattgaaggagttaaggtctgtggaatcaaagcatgagacaacatgcaaggaccaggttggtttccatttaacagccaacctaatctaactgaaaggattgagaggtttgtcttttttggaaagtgttaaggttcttccaagtaaccagcaatgtgactttaccacactgttcattaacggggctttggatggccaccatgtctgctgctggctgagtccaaaactgcggtcactctctccagcaagctcatggagggttacgtcatcttcactcagccagcccaacgctttttccatctgctaaaatgtagaacatggttgttgattctactctttctacaaagaaagagagggaacatggatgagttgctgcttttaaagattatatgttaattgctgttttaaaaatctgctcagctaagcacgcttagtgtaatcagtcaccatggagttttttaataggacagcttctgctcttacagagcagagtttttatgccagtaggttagaagcataacatgtttctatattgaagtgattctccaacaaggacttcttttcatcaggggtgacctaaaagttattacttgaaatataattacatcatgttcttaactgggtttagtagtaggataattacaaggttgtatccacctcaaataggaagaactgataagttttgcacaattatttaactcctctgttaggccttccttatttcctgttctctttttaaaatttgactaagatattgctaatgggcttgggagcctataaaatgatcagaattgttgccttatgttttgcatgtttggggtaacattggagccagatgtactcttaaataaaaggtaggcctacaaaaccagtttctcagttgcattcaaaatgtgattaaaaaaaaaaaaaggagaatctcccttataggtgaactttttaatttgtgctttattttcccttttgccattcatgagatttcttaaataaaatgatatcttttcttttcttcattattattttaaaggtctctggggaacaagactcatggaggaaagcagcactaaccgagagaaataccttaaaagtgttttacgggaactggtcacatacctcctttttctcatagtcttgtgcatctgtaagtagaatatttccttgcactaatgggaaagttttgaaaagatttgacctatccaaatcataattaaaaggaagtgtgtatgcaccagaggggcaactgggaagttaccttcttacctttgtttttaattctaatatttttatttgggcatttgtttattgactatcttcctatggtagaatgcaagctttataagagaagggacgtgatttgttctctgctgtacccccatttcccaaaactgcagatggcaacagaaggctctgaaaaatatataagaaagaatttttctaattgtgactaaattgtgaccaaatgctaagtgactgtggacttgcgtttaacacaggacgggagaggcaaagagttcaattccaatttagaatttggtcaagttctcttctgcactctggtaaacattaattaaaaatcagcattatctgaccagccagttcatcgtcagtggtggtgattttcactatgagatacgcgtggcaacttgccagacaccaagaaaccaagttagaggatttttgtattagattccttaacaatgaatacagtatcaccattattacagtatcatcattattgtcatactattattatatcagttaacataaagtctgcataagaattgtttccagaaaaatgactttccaaatttaactttcaggaaatacaaataatgctactaatattgcttttattggcgtatacatgtaatatccccttcttttggatttggatatgttgtgtcattgcctcattttaattcattatttcttctcaatctttaataattgctggacttttactccacaagaaacttgctataggcccatctctttcgtcttctttccttctttcagttcgtcttcccatcctctggtagggggaggggagggatgcctgagcgagagactagctgtaggaaccatttgtctcaaagtccagaaagccacaggtgatggatttgtcctctgaatcaaagggcgttcgatgatggatttctgtcatgtctcatctaaagtcttcacgagaacagatgaggaagcagttttatgaccccagagcctcctaccaaactcctctgagaaaaggtttccttttttttttttttttttaaattagagacagagtcttgatctgtttcacaggccggagtgcagtggcacaatcatagctcactgcagcctcgagctcctaggcttcagtgatcctcccacctcagtcacccacgtagctgggactacagctgcacaccaccatgcccagctaacttttaaaacatttttgtagaggtggggtctcactttgctgcctatactggtctccagctcctagcttcaagtgatcctcctgccttggaagttctgggattataggcatgagccactgcacccagcctggatgtgatatttttatgttttaaattgttagagtttagaaacttgagattgagtttgctgcctgcattaaaatgatgcttaaacattaaactgcagtggccttaaatattaacaagttgattagaattactaagttcttttcaagctttacatatacagacaaatttcttatgcaaaatagaaggtaacccctgtacgtaagtctagaatttcagcagtccccaaaactgactgagcattagaatcactctgattttaaaatacatatgtggttttccgagatctactaacagagcctccataatgtagcctagagaaacgagttttcagatgtagtgataaatttggaaggtaagtcagagaagtaagctgaagacagagttttaggaaatatgcctaaagtcacataatgaattggttttcttgtttatttgagaatattgtcgctttttgttctttttcatgcaaatcacattttatttcttatgtgagtagctatatatttaaaaattttgtttttggaatattgtagaatctctacttaagaaagtatcttagcagtcatatggtctgacctcactgaatgctaaattctctttaaaacatccgtctcagatggttactcatactgcctctgattgaacaagagtcccaggttaagggacttacttctttgaaatcgttcatttcatttttctacagctatgttagaaagttcgtccttagcagtgaagccagagtctatctcttataacttctacccagttgcaccctccaagcctacctataccaagtatcttttttccacgttgcttttccaattcagctcttcgcaagtttggagacaaatacctaatctcctctaagccttctccaggttaagcctttccagttcatccagctgttgattatgtgattggagacacaagtttgagtaactcccatgatggaaagtccctctggtgaatgttctgttcatcagagtccctaagaaagcacatgagcctcaccatggtgagtggggccatgagattcctaaaccagacactacactgtggcttgtgcaacctaccatggccagactcatgaggctgtttcatcatataaataattccttagtctcttcaccaaaaactgtgaagcactgtgtcccccagctgtatgtgagctagcctgggaccatagtggaggactcctctttcaaccctgttaaatttcatcttgttaggatctgcccatttttccattctgttgaaattatcttggaactggattcattcatctcacatcagctactccccgaagcctcacagtatcagcagagttattatctctatccatatccttgtaaattattaaactaaaaaagattggtctaagaacatcagtccattaatcaaggctctttggttggagttcacttcattatattatcatccagctcagagtgttcataaacaagatgataggaaagacttttccaaatgcctgtctgagtaattcccccattcctgtgatctgtgagctgttgaccagattaaaaaggaagtgagaataaccaggcaagatttactcctagcaaaaccttactggcttctagtgactgagtcctttccctattgcttaccagctatctttttaattactagttttaaaatcttgccagcaatgtcaatatcaaatgaccaagaatatcaaactcattactctgtatgtaaatgagatagtgtacttacccctatggcttaagtattaggctgttcttgcattgccctaaatacctgagactgggtaatttataaaaaaagaggtttggccaggcactgtggatcaggcctgtaatctcagcactttgtcaggctgaagcaggtgtaatggtgagccaagagttcaaacttagcctggacaacaaggtgaaaccccctctctgcaaaaaatacaaaaattatctgggcatggtggcatgcacctgtagtcccagccacccaggaggctgaggtgggaaaattgtttgaagctgggagtcagtgattgcagtgagccatgattgcaacactgcactccatccagcctgggcgacagagcaagaccctgtctcaaaaaataaataaatgaataaataaataaaataaataaataaatagaaaagaaaaagaaagaaaagagatttatttgcctcatggttctgcaggctgtaagggaagcatagctccagcatctgcttctggggaggcctcaggaagctgttactcatggcagaaggtgaagcaggagcttgcacatcatgtggcaaaagcaggagcaagagagagagaatggggcagggaagaagccccacacttttaaatgaccagatcgcatgagaaatcactcgttacctcaaggacagtaccaagaggatggtactaaattcctgagaaatccacccccatgatctgatcacctcgtaccaggccccgccttcagcattggggattatgtttcaacatgagatttggatggggacaacatccaaactatatcaccttgcatagtaggtagggttttaaaaagcagtttggcacagtaagaaaagtacagattttttttgcatcagacagacctgagttaaaatcccagcttcactgctaacatgctaggtaaatgtgggcaagttaattaacatttctaagcctttgtttcctcactggtaaaacaagtatttggaaatatcattgtgaagattagaaataatacatgaaaagatcctaggatgctgtctgtcatacagtagtagtagtaagaagttattcttgccaaagattgttgagaatggcagaattatctcagttctaagagctatagtttctaattatttgagcctagactcagattcatttggagcagctaactgctcaccaagagcttattttccatcttaccaatgaggttatgtgccctgtgtttttaaaatcagtctacttaaccaagagaacagaaatgacatgagaattaagtaatctcactttctctgttatttaggatttattcctactcaaaacctgagagttgctatgaattcaccattaaagcacttattaatatacatgggttactgttataaatagcaatagtattgctattgtgtgagttaggtgttgaagttcaagaaaggaataaagaatatttagaagatctttgaaaacagtgtctgggtacggtggctcatgcctgtaatctcagcactttgggaggccgaggcaggcagatcacttgaggtcacgagttcaagaccagcctgggcaacttggcgagacctcgtctctacaagatatacaaaaattagccgggtatgttggcatgcacctgtaatcccagctacttaggaggctgaagcacaagaatcacttgaacctgggaagcagaggttgcagtgagccaagattgtaccactgcactccagcctgggcaatagagcaacactctgtctcgaaaaaaaaaaaaaaaaaaaaaaaaagaaagaaagaaggaaggaaggaaagaaaaaaaaaggaaaaaatgcaaggaaggtatttggtgaatctataataataaaaatgtatttgtcatttcctttttctgtgctctcattctataaaattgagtaaaaaatctatatatagtttaaacacattaatagaaatcacaaaagttagctgagtcaacattgtagaaacataatatttctgtatgtcaaagaaatagacaacattaaaaagcagaaagcaattacaaagaatgattataagaaacatcacaaagggttaatattttaacacatttgaaactcaaaaatcactgagaaaagcagtagacttccataaatattttatagagtagaaaaaataggccaagcacagtggctcatgcctgtaattccagcactttgggaggccgaggagggtggatcacgaggtcaggagttcaagaccagcccggccaagatggtgaaaccccatctctactaaaaatacaaaaactagccaggcgtggtggcaggtgcctgtaatcccagctacttgggaggctgaggcagggaattgcttaaacccttaaacccgggaggtggaggttgcagtgagccaagttcgcaccactgcattccagcctgggcgacagaacgagactctgtctcagaaaaagaaaagaaaagaatagaaaaagaatccatgggcaggcacagtggctcatgcttataatcccagtactctaggaagccaaggtgagaggatcaattgaggccaggagttcaaggccagcctgggcaacatagcaagactttgtctctattaaaaattttaaaattagccaggcatggtgacgcacacctgtagtcccaattacttgggagcctgaggcaggagaactgcttgaggctgcagtgagctatgattagaccactgcactccagcctgagctacacagtgagaccttgtgtcaaaaaagtaaaaaaataaaaattagccaggcatggtggcacatgcctgtagtcccagctactcaggaggctgaggcaagaggatgacttgagtctggaagatggagactgcagtgagctgtggtcatgccactgcactccagcctgggtgacagagcaagaccctgtctcaaaaaaaaaaaaaagaaaagaaaagaaaaataaataaaatttattcaaatacaaaagtgatgtggtttgactctgtgttgccacccagatctcatctccaattgtaatccccgtgtattgacggaggttcctggtaggagatgattggatcatggggatggtttcccctctgctgttctcatgatagtgagtgagttctcatgaaatctggttgtttggtaggtgtctgtcacttaccccttctttttctctctcctgctgccttgtgaagaaggtacttccttctcctttgccttccaccatgattataagtttcctgaggccttcccagccatttggaactgtaagtcaattaaacctctttcctttataaattaccgagtctcaggcagttttttatagaagtgtgaaaatggtctaatacagagacttggtaccaggagtggggtactgctataaaaaataacctgaagatatggaagcgactctggaactgggtaacaggcagcaattggaacagtttggagggctcagaagaagacaggaagatgtgggaaagtttggaatttcctagagacttgttgaatggctttgaccaatacactgatagtgatatggacaatgaagtccaggctgagatggtctcaggtggagatgaggaacttattgggaactggagtaaacgtcactcttacatgttttagcgaagagactggcagcatttttcccctgccctagagatctgtggaactttgaacttgagagacatgatttagagtatctggcagaagatatttctaagcaccaaagcattcgagaggtgacctggcttttcctgaaagcatacagttatatgtgctcacaaagagatggtttgaaattggaacttatgtttaaaggggaagcagagtgcaacaaaagtttagggagtttgcagcctgaccatgtggtagaaaagaaaaacccattttctggggagaaattcaagctggctggagaaatttgcataagtaacgaggagctgaatgtgagttgccaagacaatggggtaaatgtctccagggcgtttcagaaaatcttcagggcagaccctcacaacacaagcctggaggcctagaagggaaaaatggtgtgagccaggcccaggcccaggccccagctgttctgtgcagccttgggacatggcaccctgtgttccagccactccagctccagctgtggttaaaaggagccaaggtacagctggaccattgcttcagagggtacaaatcccaagcattagcagcttccatgtggtgttgggtctttgggtgcacagaagacaaaagttgagctttggaagccgctgcctagatttcagaggatgtatggaaacacctcgatgtccaggcagaagtctgctgcaggggcagagccttatggagaacctctgctagggcaatgcaggggggaaatgtggggttggagctcccacacagagtccccactggggcactgcctcatggagctgtgagaaaaggaccaccatcctccagactccagaatggtagatccaccaacagattgcactctgcgcttagaaaagctgcaggcactcaatgccagcctgtgaaagcagctgcaggggctgtaccctgcagagccacagaggtggagctgtccaaggccatgggagcccaccccttgcattagcatggagacaggggatcaaaggagattttggagatctaagatttaatgaatgccctgtcgagtttcagacttgaatggggcctgtgacccctttgttttggccaatttctcctatttggaatgggaacatatacccaatgcctgtacccccattgtatcttggaagtaactaacttgcttttgattttacagactcaggcagaagggacttgccttgtctcagatgagactttggacttgaacttttgagttaatgttggaacgaattaagacattggggttctgttgggaaggcgtatttggttttgaaatgtgagaaggacatgagattttggaggggccaggggtagaatgatatggtttgactctgtgtctccacccaaatctcatctccaattgtaatccccatgtgtcaagggagggacctgatgggaggtgactgaatcataggggcagtttcccccatgctgtttgcatgatagtgagggagttctcatgagatctggttttttggtaagtgtctgggcttcccccttttccctctctctcctactgccttgtgaagaaggtacttgcttctcctttgccttctgccatgattgtaagtttcctgaggtctccccagccattcagaactgtgagtcaattaaacctcttcctgcctattctcaggcagttctttatagcagtatgaaaatggactactacagaaagtgtgtaactttaaactcagtagtatccaaagaagtaatgaaaatggagaaacgaacaacaaaatcatagtacaatatggtgtatgtactaggacaggaagagcccttttaagaagagatctatgtatttccatttgtttatctctgaaagaaagcaactttgccttgtattctgaaaaagaaaggaatattttattttacttgtaaaaatcttacaaggatgctagtctaaatatagttttcctaatttgccagagaatccatgaagatcgagttgataacaagatcagtgaagtaaaggtcagtgagttaatctcacagcagctgcaggctaattccatttccagtgaaaaacgtcttgattgctcaccacatatcttttcaccacaaacagtttcagtcttaagatcacatgttgcaatccatgagaagtaactattaagccttcaactatgactggagggctcctcgccctttctgataaattgactggacaaaaactcaattttaaaatgacaagaaatagaagatgtataaatgtactttaaatgtgaccaaaatgggttgtgaaaacacaagacacaatatccaaaaatgctggcaacacagtacactgtagagtattggttgtttatttacccttgctattgtgtggctgagcttactgccactgcccagcattgcaagggcatcaaactgcctatcactagcctaggaaaagatcaaaattcaaaattctaagtacagtttctactgaatgcttatcacttttgcaccattttaaagtaaaaaaatcagtaagttgaaccatcatatatccaagattgtctgtatataaatattatacatctttctctcacttttaaaacaaaataatactagccaatactaccattctcaaaagcacttgtgtcaacagcctttaccccttaaagattttcctcacaattttaaaattgttacttactattttctttgaaatgttgaccaaacctggattaaaagatttgggggttttagtgactgtatttcacaaactctcttattgattctgcagcctcacttctgcctcctaaaaagccctcaccaaggtcacgggggatggctcttttcagcctcttcctggcatttggtccagtggcatttggcattctaggacttccctctttgtctttgataactccctctcttcctgtgttcctccttgctgtgttcacttgcttcgctttcttctttctgaagcatgtttacacagtgttttctctgattgggcctgtgacgttctttaggtcatcttttccacaaataatgcttcaactagtacttgcgtgccagtgactccacgtcccactcatgagctctgaacctagtaccagcttctgctggacatctacaatgggatctctcacaggcctctctcattggtaacatgccccagcctgaactcatctcccacccatctatccagccatgctctctagttcacctgaacacttgggtgtcatcctagatgctttcccttcccagtcttctgtgatcattctgcctcatcagaggctctctaatctgtcttctttcctatatcgctcttgtccctattttaatcctaatcatctatttcctgacttattcattccttaagttggtcagtaatttaattaaaaacagatttaggccctgaccttaaatgtgataagtgatatgaaaggagatgactggggaaaaggatttccctcaaggaaggcctctgtgaagcctgaagcaagaatgaaaacgagtcagacgaagagagaattgtatgaatgaaggctctgaggcaggaaaacactcagatcattccagaatcacttagaagccaagtgaagccagttcctggagagcagatcatcaaatgaagatggaaaggtgaccaggggccagacctgtagttttggtgggccttggtgagggatttacagtaggacaccccatggtttaagtatgaaagtgacaagattcctttaagttttaagaggcctcgaaatatgaaccacagattagatggaagctactctccctgtgtctggactttttagaatttccaagagctgctgtttctggaaccagattaatacaagtcagtcttccatttatttatttatgtatttatttgagacagggtctcactctgtcacccaggctggggtgcagtggcatgaacacagctcactgcagcttgggggctcaagagatcctcctgcctcagcctcccatgtagttgggaccacaggcacctaccacccagctaattttatttgttgtagaaatgaggtctcattttgctgcccaggctgttcttgaactcttgggctcaagcgatcctcctgcaacatcttcccaaagtgctgggatcactcttccatttaacatgctatctcaacgtcaagataaactttaaaatctttagataataggctggcattttacttaaacgatctttacttcttcagaactgccattccctataaatatctggttcttcaaccacatcaaaccacttgtgatctcaaaaagcctcagcgtacactgtcctttctgtcattctaattcctcctcatccttcaaaatcaactcaaggaccagatccagggagaagcttagtggtgcccacccgaaccggccccctccttcgagttgtgctgccattcgggcccacctcttcacacagggttgtcagaccagaccagctcatgcgttcaccgcccttgcagggatgggatgcagctgtgcacctctcagtgccgacacctggagagtctcacgaaatgttgacaacatggcctgtttccatttcttgttcactaggacttctcatttactaacacacagaatttcctgtagtatgtccacttaatcagttcaagcctaataattccttgatttgggtatagtgctttgcatttatatactgatggtccccaacttacgatggttcgatttatgatttttcaacttcatggtgatgtgaaagtgatacacattctatagaaaccacactttcaattttgaattttggtctttttccaggctaccatactctaaagatagagccacagatcccagtcagccatgtgattatgagggtaagcgaccaatactctacagtgtattgtattgccagatggttttgcccaactagcctaatgtaagtattctaaacatgtttaaggtaggccaggctaagctgtgttgctcattcagtaggttaggtatattaaatgcattttcaacttatgatattttcaatttacaatgagtttatcaggatgtaactctactataagtcaaggatcatcttgtatagcacttttaatttatagagtcccttcaaatgtttgtttgtattttatttccactgcatccctgtgaggataccataagttatacagctaacaaaacagttagttttcctgtgcaaagtgatggcttcatcttgtggcagattacctggaatactgtggccaaggcatcttagttctactgtctttatatatctagtacagttatatttttatggcagctctgatttcttctttggcccaagggttattaagagagggaaaaaatttaatttcttaacagatatatatatctatgtcaagtcatatatttaattcaaacccttaatattcctaggtaatttttgtctactttctctgtcaaagattgaaagatacagggttttaagtttccaactgtaattgtagttttggtaattgttttattactaacaggtattgctctgtatattttgatgttctgttattcaatacataagaattcattacagttgaatcatcatgtatagtataatttaccaatgtaaaataacctttttatcaaactgagtattcaccttataatgtcctctgtcagaggattataataccacttaaaaccttttaaaaaatattttgttcctgataattttagctttgagtggttttcttataacaattctagagatgcgtttttattttttaaccaagatttaaagctttgtgatttagtaagagtctaaaccattcacagttcatgcttttttgtcaaatttctattatttagtattttcctctcttttatattttcctgttattttccatttctattcttttgttagactggaaattttttctttgctttcttttatcctagtgatttgaaatttatgtaatatatactattctacaataccctttatttgttttcaatatttgaacctatatttttcaacattattaagaataaaatagtatttgttgctattttgaaatgatagaccatgtttttaaggcaggttggtggttgttaaggcaccagtatcggccaggcacgatggctcacacctgtaatctcagcactttcggaggccgaggtgggcagatcgtttgagcccagcactttggccgatactgtggtttactgtattttgttctagtttattttatggaaaatgggaattcagtggttaagacaaggattaaatagcagaagaaagatgtgtacatatgtacagatgtatgtgtcctttatatgttttttagtactcttgtctcctttctggtcctcatttaaggttatctatttcatgcagtaaatttttcttcacaattcatttcatttagagagtgaatgctaccttccaagtgggctttctccagttttcctttcagggacttaaaggagaagtgatgttaacagttttatatttccattgcattttacagtgtgcagatgtcttcacatatatttccccatttgagctttacaaaagcccttagtattattctcattgtctagattccaaaatcaggcttagaggagttaaatagttgtccaggatctcaagatgcaagacccacaatcatgaacagaggcagatgttcaggatggaggcaagctgaaactcaaaaccaaatcattatgactccaaattcaggagtcttttagctgccacctgcatgggctcttggtgtagctgaccaccagagtttgtagagctgtcattcaggtgtgccatggactttcctgggacctggcacaggagaaggactgagttaatgtttgctgattaaatatctgttacaggctgggcgcggtggctcacgaccgtaatcccagcactttgggaggccgagcagggaggatcacttgagctcacaagtttgagaccagcctgggcagcatggcgaaaccccgtctctacaaaaaatttgaaaattagctggccatggtgatgcatgcctgtagtcccaggtactcaggaagctgaggtgggaggatcacatgagcccatgagattgaagctgcagtgagctgagatggtgccactgcactccagccttggccatagagccagaccttatctcaaaaaaaaaaaaaaaaagttacaataatcttcccttcaaagctggaaggcattatttacctgtctgtccagcagatggtgctacataaccaagggaatctgttgcttgcccttggtgaagctattaaagccaatacagatcttgagaatttcaaaagcaaaaatcaatactggattatgagtgctctaggaaaataaagagataaattttcaatttacatacttatatatagttataccatatttgtaaataaaaatatataaataatttatcaaaattcctttttaacagcaacaaccacagtaaacccacaggttaaaaactccacaacagtctatattaatcagtcaatgcaaagtacattccaattccaagttaactgaaaataatcaacttaatcatttggttggctctgagcagccttcactgcttgctcttgtgtcatgtttctttctgtcctcgattggctatagacttacagacggcttttgcagaggacagtgtactcatgtccatcctttgcatcctttgtgggagttggctaggcagcactctccctggggacactatgaactcctcttcttgagtgcagagatcacgtcttgttcatcttcatgcccaataccttgttccataaatatgaatggattagaattctaaactcttaactctgccccaagacagttctgagaggtagtaagtcatataacacctgaagaggactgttcttgtcctaattacattaggttataagatgacaggtgagggagccaaaccagggggcctggaaattattcatacatctctagatacagtatacaagttgtgtgtattatgtgtatttactctgtaattgattgcttgagatgaacccccaaacacactcgtgtttggatcattattatctacccttctccttaaataatcttaatttcctatgatgcttgaaagggaaagaggggccaggtgtggtggttcacacctgtaatcccagcactttgggaggctgaggtgggagcatcacctgaggtctggagttcaagaccaacctgaccaacatggtgaaaccctgtctctactaaaaataaaaaatcagctgggcatggtagcacatgcctgtaatcccagctacttgggaggctgaagtgggagaatcgcttgaacctgggagggggaggttgcagtgagccgagatcactccattgcactccagactgggcaacaacagtgaaactccgtctcaaaaaaaaaaaaaaaaaaaaggcagagtggggaagagagctgcatgaaggagagatttactaaatagtacttaatcccaaaataatttctataggtttgaatatgatccctgaaatttattataggttcaggtaagtattaatcacgggtattcagaactgtggtttaaaaaatgtatagaacatgtttccttccccttgaaactttttatcagctaattataggaattatattatacctgcaatcattaaagtccagaatgagacagtacttggtaaagtgctgaaatttataataaatgcattatagcaatccagttaaggaggaagagccaccattattgaacatttgttaagtgtcagccattgtactagataaattttagttattatttttatttaggcaccaaaaaatccatgggatagttggttatccccatcttactgaagaggaaactgaagctcagaaagtttaagcaacttgcacaggtcacatagcaagtaaggagcatggccaggaatcagaccctgatctcctttggtctactaagcttgcaaaggatcttcccgcctccttccaagaccattcaatattatcagtaaatgtccatggcaaggatgtagttcgagttatagggttccattcaagatatgattggtaggtgggaagcagatatgtctgtgtcaatcagtatcctggaagaaggagatgatgaactcaagtggtgattaagggaagtttaatgaagggactatttacagagatgtggtggggttaagagaaccaacaaggggaagtgatgcactcaaaaagttactacctccaggctttaggggattgggggagggagtggcacagtgtgaacccagtgtggttgtgagaaaagggattccctcagcagccatggccaaggttagagtctccactgccaaactgcatccaggtggtgagggaatggagaataggggtggggtaacaaactctgacctcggtatccccaaagggcaaaggattccaggtggtacagttcgtaaagattagcctcagggcacagaacagggcagagaagaatggagaattgatctggaggaaacaaacaatggcttgcccatgttattgcagggagagtaggctggtgtgcacagcaggagggtggggagcccagcatatagctgtgttggggcctgtgcagatcagcctcactggcagggaggatctgagccgagaggtggtggaagatgaaatcgagtaggcatgttggtagtcctaaatatcaagtaaacgttcctgatcttacattgatactcaatagtaagccaattttgtttcccataagccaatattaatattacgtatttcttttataagccagagatatagagagataccctagaagaatgataggggaaaggaaggcaagggtgagagaagaccttgtgtgaatttgtccaaaatgtttatccacaggaacaatccctttgtgaaggctgctggtatgtgaatgtgtgccggttcccttggggcgttcatttggatctttctgtgttccagtgacctacggcatgatgagctccaatgtgtactactacacccggatgatgtcacagctcttcctagacacccccgtgtccaaaacggagaaaactaactttaaaactctgtcttccatggaagacttctggaaggtatttgcaaataactttgaaagtacctctctatcacagaaaattgttcatttggcttcatcatttcaatgcatgagtatcgacaggacctgctttgcatttaacactgtgtgagacgtaagttatggtgagttgttagaagttactgttcctactctcaaagggggtaaactaacattgagaactttgcctgtgccttgcactgtgctgagtgtttcatatcttaccttatttaatttctatagtctaactctataaggtaagtactaagactatgccctagtttgttaatgaggaaaatgagattcaggatgtttaaatgcgtatggtcacatggctagggaacaagaaaaattgatttttttctagcctgacagctacttcatcctagtttgtaattcattccatgagtcaagattcaataaatatttattgagaatctcctagaatgtaaggccaatgaagggcagtgtggttcttctgtcttgcttcgccttttgtgttttgtctctttgttgatgatggcatgtatccccagctcttagaacagtgcttgattcaaagtaagcacattctttcaaaggtctgctgttggtggggcttggtggctcacgcctgtaatcccagcactttgggaggccaaggcaggaggattgctttagcccaggattttgaaaccagctgggcacaacatagtatgactttgtctctccaaaaaagttaaagaattagcagggtgtggtggtacacacctgcagtcccagctactcaggaggctgaggtgggagaatcacttgagcgattgcttgaggtcaaggctgcagtgagccatggccatgctactgcattccagctggggcaacagagtgagaccctttctcaaaaaaaatcccccccaaaaaaaaacccaaaaacaaacaaaaaaggtctgctgttgtgaagttcaacccaatccagccccttcccaagttgtcacaaattccaacgtagttaacagtataccaatgagtgataccacaggaaaaatattaaactgatctgagggatatggggcttggaatctaagaaaattggaagggaaattgaaaaggaaattattatttctccttggggagatagtttctaaaattcttactacaccctggggtcagagctgttgattttaaggatagagacaactgagtcacaggaaactattcatatataaaagtacctggcatccaaaaccacacttgtataatatgaatctttcaccatctgagtagggcaaatcagtctatctctgttgatcatctgacaaggatagcacactgagaaatagatctgtcttccctacaggcatagctagttgtacaaactaacaagagacttttgtatacacattccatgatgataaatgccaatcactaaagggacgaggagggattggagagttcaccatacagcaaaatagtccagacaggtgaaaggtctatcaaatgccaggctggtaatcaaaactgtagccttttctctaaacaaagtttagaaccatgattgtgtgggacattattttaataagggaaagtgcagttaatcatgaccccacctttagtccaagaacaaaaatcagagctgccacgtattaagtacccactctgtgccaggtgcagtaactatgcaaaagatgggttttccagatgcaagaaccttggttcagaggaccctgctcaaggcctcatagctaacaaatgatggggcaagatgctatcccaaatctctctgacaacaaaactcattcttatcactctactattttcatagagttgccaaatgcttggttatgcaaacgatgcaggcaggggcaagacagcggctgagcttggaactttttcagagatgtttcctttgcttttagttcacagaaggctccttattggatgggctgtactggaagatgcagcccagcaaccagactgaagctgacaaccgaagtttcatcttctatgagaacctgctgttaggggttccacgaatacggcaactccgagtcagaaatggatcctgctctatcccccaggacttgagagatgaaattaaagagtgctatgatgtctactctgtcagtagtgaagatagggctccctttgggccccgaaatggaaccgcgtaagtgtctgtgactcattgccactcggtgatattcattcatttattctctgaactcccaccattcattcattcattccctgacaccttcaccaaggcaaaaataagttcagtgactcttcagtgcttatatttaaaccttggccaacttgacctttgacttcttaagttttcactacttcttagccttcttttagtttctacatgcatatttttcagaagactaaatcgttgaccatataacccctcaaaaattaattatctgagcgtttgaaaatttcatttaagatgccctgggccctgtttttacaggtgcagtaacatcatccactaagttatttaacacaagttttctggttcaggaactctttttataggtcttgcaaacaggtttttgttcagaatggagttatttaatgtgtaagcttgtgaggcaattttttgttaggtttaaagcccattttgttcaaatgtttgagattttaggtatatatttgtacacgtgcatatttacaggggctttttgtacactttggtactcctacttcaaacatcttgtgtattaagggaggtcacttactattttagaagtattgtagttattataaagaaacaagaagacctccaaggccgtttcagggtgggcctttgcggttgctgtccctgggtacgtcactggtcggagtcatcttctaagctttgctcagctaattctgtcggttcatctaggttcttttcttggaaactgagttgcccagaatccacatttgttactatacaatgggcaatcaccttttcaattagtatattcttcttgtaccttccagtatacactctatttaataccagaacccataagaaacaaatttagtaaaaatccaggttgggcacagtttctcatgcctgtaatcccagcactttggaaagccaaggcggacagatcacttgaggtcaggagttcaagaccagcctagccaacatggtgaaaccctgactctactaaaaatacaaaaattagctgggtgtggtgacatgtgcctatagtcacagctattcgggaggctgaggcaggagaattgcttgagcccgagtggtgggggttgcagtgagctgaggtctcatcattgcactccagcctgggcaacagagcaagactccccctcaaaaaaaaaaaaaaacaaatttagtgaaaatccagagctttagaacaaaggaactaaatagtctcaaaggacattatcatccaagttatgatagtgatttcgctttctttaaaaaaaaaattattacagatagagtttcttgatgttgcccaggctggcctcaaactcctgggctcaagcagtcctccagcctcagcctcccaagtagctgggactatgagaatatgccaccatgcccagctttattttgctttctaatgtgcctttttgtagttcctgcaaagcataagcatgccttcatctgtggtaccctttccaatattttatttatctcacatcactaataagataaatttatacagccactgctctgtgccagacattatttaagaagttatttcacgcattatctcatctgccttcacaaaacaactctaaaataggtatcacctccattttatagatgaaaaaactgaggctcacttgcccaaagtgtcacagctaacaaattggactgaaccaagatttaagcagcctgactccaaaacccatgtttcgcctactaaacctcttccatattaattcctcctccatattaattgcgtcgttagggtggcttgtcgacgctctcagctccccatcagtactcaagcttcctgagggcagggattctattttgttaactgctgtattctcaaagccttgaacaatgcctcatatgtaaagatactaataaatatgtgctggatgcattcgagtgatttctactccagggtggattgccaaaggggaccttccctgtcatatctaaactatccttttattcttctacattctcaagtcactcccatttcttcttcccttcaactccaaacttcttggaagaatagtcttcatttgccacttccatttccttaccatcaattcacgtcttaaagcttaggttcttgcttttgacatctcaccaggaagctactagggacctctagttagcaaatccactgaacaaatctcagtttttatccccttcatactgtctgcagaaagtggcagtgttgaccgctcattcttttgacttccatgaagaactctacactttgggttcttttaactctgaaacccctttctctcacttctcttattcccaggttctatattcatatctccgtcttttctttcttttctctctttcccatgacattcagatggcttccactgacatctttatttggtgactcatcatttcttcaacaatgtgccaggcatgttcccattgctagaagtcccccctcttctagtagtgcccttgatgctggagaaacaaagcagcaggaaacagaagaaacgtcctttcttcacagagcttgcattctagtgatacaagacacatctctattccacctggatgtcccacacctcttgtgatttaatatgccccaaactaaactcatcgttttcttatgagatctgctctttgttctgttaatggcactgccgtcttcctattgccctgaaagagactccagagtcatttttgagccatgtttcctccttgccccaacttccaaatcagttaccaagttctgctggcagtcactgtggttacgacactctctcactccttcctttcccttcccatcttcactgagtgacttcaggcctcattacctcttggttattgcagactttgctaagggagctgtgtcaggggtccctaagaccacccccaggttcagtgattcactagaaggactcagcatagaggcatccttacagctaaggtttattatggtgaaaggatacaaaagaaaaggcacatggcaatatctggggaaaacctggtgtaggcttccaggagccctctcccagtgaggtcacataggatgtgctgaatttctccaggaacgagttgtagcaacatgtgtgaaatgtctatcagagagattaattagagactcagtgcctggggtgttcactgggtactggtactggtttatgactagcatgtgccaaaattcccgactctcagaaggaaagcaggtgttgagtgtaagccacattgcttatacaaatagcacaggcacagcaagcctctcttaccggtcagggaaagttgaatactggtgcagggagctgtttatcagtcaagttcccagatgccagccaaagtccaaccttgcaaacaggccttcctaaagaaaggccatctcaggcctgctgtgttaactcttttctgcacatgagccctctgttcctccccactccagtcttccctgctgccaccagaccagccctgttgtgtgcctcttagaactttcccttcacagactccttcatgtttgcccttcacaagctgaccacagaccacctttcaatctgccattctttatcttatgggagccaaactgaactacttcttctcttgaccaatggctcacggttgaaaatgcccttcccatttgtattagtctggtctcatgctgctgataaagacatacctgagactgggcaatttaccaaagaaagaggtttaatggacttacagttccacatggctggggaggcctcacaatcatggtggaaggcgaggagcaagtcacgtcttacgtggatggcagcaggcaaagagagagagcttgtgcagggaaaatcccacttataaaaccatcagatctcgtgagacttactcactatcatgagaccagcatgggaaagacctgcccccatgattcaattacctcctaccgggtttctccaacaaaacatgggaattgtgggagttacaattcaagatgagtttggttggggacacagccaacccatatgaccattcacctgtgcaagtccagatcctactcacctttcatggttcaggtccaacacagcttcttcctaaagccttttctaatccatccctccactgccagatccccaaataaggacagctttcctctgatctgccagccttatttcttttctcttttgcttcttattattatccaccttgtattttacttgtttaattataactcttatttccctacttgttataaatttgggagggaaaggacctttatatccccattagtgctgaagaagcatctgttttctaagagatcctctgaatatttgtggatgaaattcccaaatgctgacaatgccacttgatgaacttgtccctcttttggctgtaattttctctggggacctcaagtcgtctagtccctgagcacagttacccagagaaggcagccgtataaactgagcagaggctctagagcagagcagaggctctagggacaaacagccctggcattggttcccgagtctgccctcaaaagctttgggactacattgacctcactaagcctcagggccctcattcctaaagaggctaataacagtatgagaattaaccaagaaaacatgaactgccaggtcaggcacagtacccagcttgataggccttaatacatactttattttacaaggaaccagctgtccttgtaattgcctcaagtgttccactgattgtaactgtttgttttttggttttgtttttaatcagttggatctacacaagtgaaaaagacttgaatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcaggtgtgtactgaggacatgcatccctcctatttctgtgtggttgtacatacatcctattctggggttagccagaaaaacctttgcctgcagttagctacatgaggatgccaaggacccagacggatagcaagggaggggtaaaaactgaaggcttaccgaaataaaggatatttgaggaagggagttgggatcctagaatattacgagttggaaagaaccataactctggtccaagttcatctcaatgctggaacctttccagaaaaagtattgtgtttttctaacatctgtctttacccattataaggatggttagtgccacatgttccatcaccaagtcccccggccatcaaatcttgactcatttcctggagtttctcactctcagatgagcctctgctattagcacacaagcacagtaaccggagtgcttgtaggatgctcagtaggatacccaggttacctgctcgtgctcagggctaccaaaggcacgtaaagttccttccacagatcctgggatgttgccatgatgacccctctgtgagatagtaacaaaaatgacaaagattccactggcttgtctgggactcttcttcattcatttattcagcaaacattcattggacacttaatatgggctaggcattgttctcggctcttgggacatgtcagcaaacaaaataaagatccgcaccttggcagagcttgcatccaaccaggaggagactagagaataaacattaaacaatacaaataaatagtatagtatattagaaggtaataggtactattaaaaagaaagaaaaagcagagcaagaggaagtcagagttcacccactttaatcttcctggtgagcatgtcagcaacacccaaacatcactaacatggattattgcatgtatatttacacataagataagaagtgtttattctcataatagtctttgtcatcattcttgaggttaagttcaattctgctttatgtggcttgttggattgtcccagtccttgtatttaacaacatttgcagaaaatagtaccacattaaatcaattatagattatcccttatccaaaatgcttaagaccagaatgtttgagatttaagaaatttttcaggttttggaatgtctgcatatatataatgagatatcttggggatgggacccaagtctaaacacaaaattcatttatgtttcataaatgaaacttaatgcacatagcctgaaggaaattttatttttcccttagggatgttgaatcaactgttgtgtgccagcatgttgacaatgacctgtcacatgaagtcgggtgtggaattttccacttgtgcgttcatggcggtgctcagaaagtttgggattttgaagcattttatatttcagattttcacattagaaatactcaagctgtccttgctcacagtggccaaaaaaaaagaaagaaagaaaagaaatactcaaccagtagtccagtagtagttatcactagaaatgaatgaaaatctattgcagtattattgagtttttcctaattattccagtgcagataaaaagaaaagaataaaaaggaagagaataaaaacagagaggcaactctgatattttagtaaattctatttatagaaggtcttgagtatttcttctgcttcctcccttactttaaggatgaacattgttaagacaactgcttcatttctctatactgtttttctaagtttctggaagtggttgactactgcagggccagaatgggccagagaaatgacttgacacttgaaggccacttccttcccttttgagttcccaatgaagctgtcacatacaaggctcttggcttcagagttgctctcctgagtttttgattctcacccctactctctaacacatcaaataggaaagaaagaacaggagaactgacaatgaaaaggaaggaaaattttcacacttctctgaccagttctaatttaccatagtcctgtttttacttgattattgctcatgcatgtgtcctgtatgctcaggttccaggtgcggctacctgtcctgtaatggcagagatagtgatggctagtagctgactaaagggcttttaaatgtctcaaaatgaagcagctagagattctatttctagttagaaaagaagtctgtatcattaactgaatcacccagctttctcagtgtgacacctacaaaatgggcatttgacaagaaaaaaaccctcagtccagttatggtaaagcagtaaagatcagagccatcagtatggatgtaaaatagtgtatgttttagacaatcagacatctattgagtacccacctattaactataaggctctgggaagaagagagaaaactaccctggaggacaaactatttgatgctatttaggtgttacataatgaatgaatgactcagttcctatctttatatatgtacaaaatatatcctacttctcaaccagattacacatgttttgagtggatggtttatatttctttatattcttcatgttgcctagtagaaggacttgaatttaatagaagtcctagggccaggcatggtggctccttcctgtaattccagcactctgaaaggcccaggcaggaggatcatttgagcccaggagtttgagaccaacctgggcaaaagggcaagactcagtctctgccaaaaaaaaaaaaattagttgggcatggtgctgcacacttacattcccagctactcaggaggctaaggcaggagaatcccttgagccctggaatttgaggcagcagtgagctatgattgcaacactgcactccagcctgggcaacaaagcgagtccctgtctcttaaaaaaataataacagaagtcctagaaaagtttgtgtgttgatttacttttacattaaaagtatatggcatgttgagcagcgtaaatatagaaaagtgtagggaagactgagcaggaagtactcctttgggactgaaagacctcaggaagtcttattcctttgatggcacaaaattctccaagtatggaattattagctatgataaaaatgttttgccgctagtttggggggactcatggtagcagtttcattaccttgtaatgcatgaacagaacagatggacatccattcctggctgtattcatgtgttgttgttgttattgttttaattgttcttatttacatgcaggttattggttgaattcccagcaacaggtggtgtgattccatcttggcaatttcagcctttaaagctgatccgatatgtcacaacttttgatttcttcctggcagcctgtgagattatcttttgtttctttatcttttactatgtggtggaagagatattggaaattcgcattcacaaactacactatttcaggagtttctggaattgtctggatgttgtgatcgttgtggtaggtttgagaacaacaccaaatttcctattctattctacaagcatgttaactagagtctttgatctcctcagcattgtggatcttgatattcccaaaaaagaatctaaaagtccccctcaattatatcaacttctgttactaattattttctcattttgcatgagtaactttgctgagtatgaagtggagaggtatttacagtatgctctcagccacgctaataacaagagtatctcagtaattcatatttggctttagtatgccgtatgagatgtggaggagaaaacagttttttttctttgtttttttttccactaatgatatttttcttcaactgctggtaaaaatcaatttatattttcctgcacatgtgtgaagttacagcaataaaaaaacttgtcggccaggtgtggtagctcatgcctgtaatcccagcacttggggaggccaaggcaggaggatcacttaagccccagagttcaagcccagccagggtaacatagtgagaccctgtctttacaaaaaaaaaaaaatttaattagtcaggcatggtggcacacacctgtagtctcagctattccagaggccgaagtgggaggatcatttgagcccaggaggctgaggctgcagtgagctataaatgcaccactgcactgcagcctgggtgacagagtgagaccttgcctcaaaaagaaaagaaaaaagaaaaatcatcctgaaaatattttgtgcggcagagaaaactttctgcagtttaaaattttctgcaaatagtctgcagagtacaaatgtaagttatattcatcaaagttttctgtatgaggtataagaaatcaaaggcaggccatgcacagtggctcatacctataatccctgcactttagggaactgaggtgggaggatcacttgagatcaggagtttgataccagcctgggcaacatagtgagaccccatctctaaaaaataaaaataaaaaataaatcaaaggcagagtcataatcaagaccatgacaccatgtaaattctgtgtctgctcttgactctattataacttctaagatttttttcaagatgttttcccttcatccttatcacttaattaagcatccgtcacttccttcctgtggtttcagtgtataaaagaatttttacaagcttttctcccttcagcaataacaggtaacatttcgctaagtccagttgtacatttaagcatataacaacatgcttaattattagatgcttacaagctttgcttggcataggtgtaccatgtattattctatgtctttccttcccactgtcctatgatagccattaccttctgaaatctcagtaaatgatgcactaccctattagcattctctcttctgttagccctccttatgagagttattctttccctcatcccactcctaaaaattcatttggcctttgtggagtatttagatcaagtcattattaaactattccccactagaattattaatagttgataaaatatggaaaatatattattcatatgtgagtgaaagaacacttaaagcataaaaaagaactacatggccatatattgcatggcaataactatattagcagcaataataattgtaatagtaataataataatggctaacactttagaagcttctgtgttaggcatttccgggtgcttttcatggtacagaagctcatttgttcctcatactaaccctcttcactactctgccactgcctctcaagccatggatatgtgcactttagagtttttacttaaagtaaaaattcctgtagaatagatggtgttgaccccatcagaccgtgatgcagttagaagtgcatcccgtcttttacgatggccatacaacatcacacaaatcaaggtaaacccttgatccccaaattctcaatgtattaataatgaacagagttacacaagaattttagcatttaaggaaacaggagagacgataatactggaaataatttttcagaatatttctgttcggattgatggcagagtgcaggccatatacattgacaattattccagaacacaattattgtttggagctaaaaggatgcaaaccctgcctcttggcttatatggatttatttatgtttaggccattgaaataatggtagaaaggtaagtatgatatgctaattaagaacagacttcctttttatattttaaccaaagaactcaatatcaacaaaagactagtcagtggtattcaccctttttgatcatacacacctatcagtgaaagctttgactactacacaccctaatttattatctttatttgtaaattgtgtgcctactttggtgtaacaggtacatccgtaaaacatacacatacatagaattttaaagattggaataaaagttaatacaaatagaattccaaaactttcttaccacctacctagaagttgtaacattttcttcccatagcccagtgaattgccttgcacctgctttggcgaccaataggaagaaaggcaatgatatcatggaaattgtctctttggctcaacagccacagcattttgcaagtgtttctttgaaaacttgcttcactgtgtttttcaattttttttttaaacaacacttaatactgccagacaacaattcagacagtgtgctttttgtttataaagaacaaggaagggctactggaatctcacttgtcctttgaaacttttgctgaccaagtgtagaagtgagggcatgccttctgctcacccacaaaacacaccctgtgctccactggaccttcaaaccagtggaaagacccaacgctttttgttttatctagccaaaatttgcttatgcttacccaaaacctgaaaagaaattatattcttaatataaatacaatcacatcttgaaatcactttgaaattttctttattttccttttttctttccccaacatatgttctgaagtacacaggctgcatcagtcagccatttgtcctgagcaatagtctttcaaaactagaagaattacttgaaaaaaagaagactattaaggaatttaaactcaaataatttattgaccacttgctaggttgtacagggtaaatttttttttttttttttttttttgagatggagtcttgctctgtcacccagactggagtacagtggcaccatctcggctcactgcaagctctgcctcccgggttcacgccattctccctcctcagcctcctgagtagctgggactacaggtgcctgccaccatgcccagctaattttttgtatttttagtagagacagggtttcaccgagttagccaggatggtctcgatctcctgacctcgtgatccgcccacctcagcctcccaaagtgctgggattacaggcgtgaaccaccgcgcctggcccgactaattcatttattcagcgagtgttttctgagcacctactatgtacttgccactgttctaggcactggggatacaggaatgaacaaaatcacccaaatctctgccctcccaattttctggtatggagagaaagttcttttgtagatagggatgagaatcccacagaaaactcaggagtgatgtaacaatgcaaatgctcacaaaatctctttcctcatctttcattccctatttggaaggaaaggtttcaaagacattgatgttgtataaatgaccatcttcttcattattttataaacatttgtcctgtgcagagtaaaaacaactggactgcataacaaattatacctattgagagttgggtaaagagttaccattggatccagtccaccaacccaaatgtttttctacatgtattagctgagatgagctcctcatctcaggagaagcctattcccactgcaggccttcttgagtctgctgtgttcatcattcccaccaccaacacaaaaatacaagattggctctggaaatccttcacagagaaggaaggaaaggaagatggtgaggttggctttttagctgtgatcagcaaccaagctggtctttgctatgagaatcagtgggaccatgatctctatggtcatctcaggaagggagggctaatgaagtggtctctggccatgattcctaagaagagagaatggacagcaaagatcgcagcacctgccacagcccacctgctgcagattcagaccccctggtggggccaggttgttatgactaacccctagcactgtctacatttagtggtgatggatgccaaggagggggcagtgtccccttggatctgattgtaaagcttagaaccaaagcatatgtggaaagttgtagggtcatgagttaagggacagaaatgagcaagagagaagcccttggctcatatattcccactgcaggccttcttgagccctctgtattcatcattcccactgtctttcaagcccaagctcatgctttgttctcatgggcactcatttttaggatatcttttgtccctcttgactttatgttgtgtgataccaactctttagtagttttttgtattatttaacttcatgtgtttatctgctcttgagtctcgagggcaggatttatgcagtttacttctgtttattcctcttagcccttgcacagtgctgtatacatagacatctactatatttttgttaaacagagcaaagaatggctggcaattggagaatgcagagaaaccgaaaaattttaaatttaaaaatcacaaataaaaacagcaggatgaaggcaagaaagcaaaagggtggaaagtgattaaaatgaaggtggcagaaaaaacagaaagcattcctctttgagtttgagtctgttatagtgtgatctcttctgtgtatgcatgtatgtgtgtgtaatgtatatgtgcacacacatgcatgcatgccttcgttgagtttctattccgaactaaggaaatgcaagcaatatactgttttacttattttatggcagggcttaacactttccatttgagtgagtgacttttaagaatgacatcgggtaagtataatggtgagcccttataattaatacattggtgaagaaaaatatactagtcatattaaggtaagtttcatatttctaaaacactgtaataaaatataaatattttgcttttcagctgtcagtggtagctataggaattaacatatacagaacatcaaatgtggaggtgctactacagtttctggaagatcaaaatactttccccaactttgagcatctggcatattggcagatacagttcaacaatatagctgctgtcacagtattttttgtctggattaaggtaatttataaatttcatgttctacattttaaataatattttctttaaaaaaaatgagttccacaaaatcatggaatacttgaatttgaaattcaagtgaccagccaaagctgctcaatatttactttgagacagggtctcactctgtcacccaggctggagtgcagtggtatgattacagctcattgcagcctcgacttcccaggcccaagcgatcctcccaccttatcctccgaagtcactgggactacaggcatgtgccaccatacccggctaatttttaaattttttcgtagagacaaggtctcattatgttgcccaggctggttttgaactcctgggttcaagcaatcctcccacctcagcctcccaaagtgctgggattacaggcatgagccaccgtgccaggcctcatattttacatataaagtaaactattgagactcatgtgatcattcctctcactgtcaatgacatacttctgctatctgaattagtgcaagatcagtccctataggttttgtttaacaaatgcagtaagaggcctttcagtgtgttagctgggcctggggccccaggctgctaacagatgagatgaacaggtgaaggaaaaggaacttagagaaagagagggaaggagcaggtggagggaaggggagagttgctgcacttggaaatgcttgctagaagggatcgcctcttttccaggtagaggctgtaagggaagctttacctagaattaaggttggaacagacactgcttccaaatagttccttgctcactattttccttattgtcccaagatataatgtgcatttccatgtgtgtgaaaggttatgacatttcatatacaacaagcctcaattctggagatgcaggaaatttcaataattctcaggcagcagctgccattcggtcaccagcacaggctctgattgtgctgtccagacagtaagtactagccacatgtgcctatttaaattcaaatttaaattagttaagcttaaatacaattaaaaacgcagttccttggtcctactggccacacattaagtgttcaatggctactgtctaggacagtggaaatgtagaacatttccatcatcacagaacgttctcttgaaaagcactgttctggaaggtacttacccgttatgtacttttctgagttggtattcatacctagaagacctgaggtttatcacaagacatagacttggaccaggcgcagtggctcatgcctgtaattccagcattttgggaggccgagataggtcccctgagcccaggagtctgataccagcctgggcaacatggcaaaacctcatctctactaaaaatacaaaaattagctgggggtggtggcacgtgcctgtagtcctagctacttaggaggcttaggcgggaggattgcttgaatccagaaggcggagggtgcagtgagccaagatcgcaccgctgcactccagcctgggcaacagagtgagaccctgtctcaaaaaaaaaaaaaaaatgcatagactttatcctgtatttctcatgctatttatttattgacatgcttgttcaagagaaaccatcactaaagcacaaaaccttgatcataacatagtaataataatcaaacagcaaaaataataatagtaataagaatgttctgtggtgatggaaatgttctatattttcattgtcctagacagtagccactaaccatgtataggcatggaacacttaacatgtggctagtaggaccaagggactgaatttttaattgtatttaatcttacttaatttaaatttgaatttagatatccacacatgtttggatagcacagtcagagcctgtgctggtgaaaggatggcaggtgctgcctgagaattactgaagtttccttgattattattagtttaataataataatcaagatagtaataataatcaagatagtaataataatcaagatctcagctgggcacagtggctcacgcactttgggaggctgaggcgggcagatcacctgacgtcgggtttgagaccagcctggccaacatggtgaaaccctgtccctactaaaaatacaaaaaaaaaaaattagctgggtgtggtggcacgtgcctatgatcccagctacttgggaatctgaggcaggagaattgcttgaacccaggaagcagaggttgcggtgagctgaatcatgccactgcactccagcctgggcaacagagcagcacttcgtctcaaaaaaaaaaaaaaaagatctcaaatgaattgggattgtattaagtaatgattaagtaatgtgattacagcaatcctcaagaaatatttcactgtggccagtaacaatgtgtaacagacctttaaacttctagagattttcctacaacatgtgtctcaggctgatgtgttttatttagtgcttctcttggaaatgtcttgcccctcgatactttatcattaaggtctttaaggcagggatcatgactctacttttttttttttttttttttttgggacggagtcttgctctgtcgcccaggctggagtgcagtggcacaatcttagctcactgcaacctccgtctcctgggttcacgccattctcctgcctcagcctcccgagtagctgggactacaggcggctgccaccacgcccggctaattttttatatttttagtagagacggggtttcaccgtgttagccaggatggtctcgatctcctgacctcgtgatccacccacctcggcctcccaaagtgctgggattacaggcttgagccaccacgcccggcctcatgactctacttctaatatctcatcatgtgctcttccactgaggcttctacttagagctacacaatctgggcagccatcctcagtgccttatctaccaacatgctcaatatggctttgcagggttcactgtctaccagcagggttcactatctaccaacatgctcaatatttctttgcagtcaggcagagcaggctttgcagttcaggcagggcagctggctgcaggccccagctgactcctggggatagaatgccaatatttcagacattgcagagatttgaggcaatgtacataaagccctccacatataactgatgcacaataaatgacagttaatattatgcaacaagaatttcctggggggttttataattaatttttatttgtgtgaagttttttccctcccttttactttaatcctttttggggggaaagcatcactagtcacagttcacggcagcctcgacctcccaggctcaagcaaccctcccacctcagcctcctgagtagctgaaaccacaggtgtgtgccaccacacctgactaatttatttttattttctaatgaaacagaatcttgccatattgcccaggctgatcttaaactcatgggctcaagcgatcctcctgcctcagtcttccaaagtgccgggattatagatgtgagccactgcactcagcctttttttttttttttttaattgtagatagcataaaacctactgttttaaccatgcttaagtgtacaattcagtggcattaagtacattcacagtgttgtgcagccatcgccattatgctgcattattttcagaactttttcattattctaaactgaaactttgtatccattgaacactaactcccaattcccccagtccctggtaacctccattctactttctgtcactgtgagtttgactattctaagtacctaatttaagtggaatcatacagtatttgtccttttgtgtcaggcttatttcactttgcatgatgttttcaaggttcatccatgttgtaacctgtcagaatttaatttcttttcaggatgaaataatgttttattatatacagtcacaccattttgtttatccattcatctattgatgtcttctctctcttacagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatgtaagtatatatgaaattaagaagaaaaatttaatcagagttgtcactgcttctcaagaataaatcttcatatgaggttgctatatgaccaccaattatttaaaaccagttattttaagtaagaattaattaccttttcccaaaacattgatctacccatgcaaagaagacaatgcatcctgaaatgctgatgcttaagatagcagcccaaagtagtaaaatacagttaacagacataggaaaccaacactgttctgaagactgagtttttctttgcaccaaatgcagatggtagcttctagaaggctgtttgcctatattcttactcctgttgaatattgttgccatatatttagaacttcaagttattttctaaggaaaaaaacaagatatttctaatattctaaggtaaactcagaccagtacaagaattttcagtttttttttccaaagatcccaaatgtgaaataaaacaacaaaaagcagccagtgtcagatttctatgccatttagaaaggagttagtttaaaaaggaatggaagtaatagggttttgtgcatagatatctcgaattaatattgctgttgataaaagtgattttgctaagacccagcactgacaacacttggccactttgatcccattttaagtacttgtcagaatattggatctttgaactcaaaccattttgggtttttggggtttttttgttttgtttttttttgttttgttttgtttttgaggcacggtcttgctctgttgcccaggctggagtgcagtggtgcaatcatagctcactgcagccttgaactcctaggctcaagcaatcctgctgcctcagcctgctgagtagctgggactacaagtgtatgccaccatgcctggccaatttttaactttttttatgagaagggatctcactgtgtagcccagggtggtattgaactccagggcctcacactgtcctctcacctcagcttccaaaagtactgggattacaggcatgagccaccacaccaggccctgttgttttttttttaaagaaatttttaactttagaccgagggtgactgttgtcaaggtttagggttaagatgttttacctagattatgtgttgaaatgttatagccaattgctttataagttattgaataataattgtattttctttttttttttttttttgagatggagtctcgttccatcgcccaagctagagtgcagcggtgtaatctcagctcactgcaacctctgcctcccgggttcaagcgattctcctgcctcagcctcccgaatagctgagattatgggcgcacgccaccaagcccagctaatttttgtatttttagtagagacggggtttcactatattggccaggctgttctcgaactcctgacctcgtgatccgcccgcctcggcctcccaaagtgctgggattacagacgtgatccaccgtgcccagcttgtgttttctttttaaccaaatggaaataacctctgtagcatgaaagcattttattattattgcagaaggctttaattgctgatacaagtagcaagactttgtaaatgggattgacaattttctgttattcggcagctacctatactgctaaaaggtccaaaaataatgaaatcatctttaagaaatgttgcatcaactagtggacattctttgtttttgtattgtggtgttttgttttatttttatagcttcactcaattccgtatcattttgggcgatatcaactttgcagagattgaggaagctaatcgagttttgggaccaatttatttcactacatttgtgttctttatgttcttcattcttttggtatgtacatttttatttatagtgaggttcaatttaaacttcgtaaatccttgtcttctcttttctctcacactttatgtcctatcaattttaaataaagacccaggaagtagaaaaaagtgtggatgttggaaaacttattttccttttattaattcacagttttgagactcatatcaaatgtcttttctgtggtctttcattgatccatgtatatgtgtctattcaatgcaaaaaaaattagatctcttccatggtctttcatttctctctctatatatgtatctattccatgcaaaaaagaaattagatcaagtacaaatttataaagatacctaaaatagtgctttgcctaaaaagtagaatatgcttacatgctttttaaactcatatgtcagcactttcgtagtcacttgctagcatgacttttctctctttcttcttttctttttaaaaaataagaacggaaaagcaagctagatctaagatgtcgagtaatagttgagtgaatcattgcatgtcaaaattaggatattctgttttaaattatttatatcccattcatctagagactgcctacagagaatattcaaataattaagtttaaaactaaatgtaacaatgaatggaaattgcattaaaattattttcaaaaataatttttttattctcttgatttggtacaaatgaacatttttaatgtttttgccctaagtcaattaagtttttttaaggtgttttgttctttttcttaacatttatatattcaattgtctactgagaaggtgttaagccagcttaatttaggcaatatttttcatctaaacactaacagtcatcttaagaacaattttcttaagaaaataacattttttccatttcagtaaattgtgtaaagatcccttgaggaaggttaagtgatcacattttcagtaattcagtgtaataactctaaagtcagtccaggtattactggttaagtatatggtatttattgattgggtattagatgtactgtattaatttcctgtttaaaaaaaattttttttccggggagacacagcctctggtgtaaaacaaaggtgtgttccctagctgtactttaacaggactgaaaaggtcaggaatatcattcaagttcatatgtatcttgctgtatgcatggtttatggctcatttttaaacttacacctcttaagcttcttcttcctatcatatattaaaacaatggagagaagaataagcctctgttactctaccattgatagtacttcggattctagagtacctgaatctctactaagaaggcaaaaaccaggaattgagagtcctgcacctgacccttcagttgatctcaggccacctagttttctccgtttatcaatctgccaaacaaggatggatagagtcgtggcaactggaaaggctcaaatgtggaattgtttgaatgtggtcctttagtaggcagccatcttaccagatctagagtattcagtcatcttaccagatcagtcaccagaacatgaaaagaagctcttagtttctatctttatactaaaattgtttttttgtacgactgcacaaaaaagaattgctctccttgcacctcccagagatataggtggatagatacatacatacgtacatacatacatacatacatacatacatacatacatagacacatacatagatagaagtctactttcaatacaaacctgtcttttaaggaaatgacaagctgagcatagggttggccacctttctgagccgattgcctggtattagtttattgcccctgtttagcaagaaggcacagtgttaagaagtggctcagctgaaccaggataaccccactcttcccccacatcaacaggaaagacatcctggtgcagatgtccatctgataattcagggaacctcgggagacaggatggagaggagggtgagctagcttcctcttcccacaccttcaagagcctttctcaagcactttctattttttgaaatctctttagaggtcccagactttgatctgtttcaattaaggtattggcaggcattagttaacagccacttggaagcaaaaatagaacattagatccctgagttggaagagagaaggtagaaggtgttacttggactgcaattatctgcacttggaattgagcatttagtcaaaaacttatatgtattctatattctattctcatttctgctacagaattgtaaacaatattcttccttaatacagaaattcatagcccactaaaataagagcgttctcatttgttcatttctcaatcatttaataagtatttactaagccactatatccatatatatatatatatcatatatactgtataatacacactgtagtgttttttgtggattgtgtactatgaggtagtatgttagatactgccagtactggggtaaggaaaacagcctgattaggcccttacgaagattcctcagacttgtggggaaaacagacattatcaaatagaaatacttgcaaaccacagttatgtgttaaaaaggaaaaacaaagtaaaaaaaaagttggtgggggggaacctgatctcctggatacagtgcttcgagaaagtttgttgttggaaatgcaaaccattactactgtggaagggaaaggtcagaaaaatgaactcaccattactgaatagtaatagtagctatcaattaggtggcacttacctgcatcaggacctgtcctgagcactttacatagattgtctcactaaccagcccaacaaatatgtaagggagatactattatttttcccattttattaatgtaaaacaattaaataattctttaaaattagacttagaaaagtggagcaacaatcttagcagtgctaggactgaaatccaagtttgcttgactccaaagtctatctctcttccagaaactttttctttactatctgcctagtaggcctgctgtattcctatttgcaacagccttttaaactctttaaaaatgtgtcctgtaaatttcatatatgattatacaaaaaaacttggaataagcatacaattctacttatctgtgttaactgttgaaatttgaagagctttttggaattctatacccttcagtagtgtatgtaaaagtttctaaatatagagaacatagataagcaaaaataatattaaataaaataatcgcaccattagtaggtaaatatactaatattttgttgtattttattcttgtatgttttcacaaagtatatcataaaatttttcctgtggcatgacttaacggagaaaataatcttcccaaaacatgtggcagcaaaactgttaatttattacatcaggctgggcacagtggctcacgcttgcaatcccagcactttgggaagccgaggcgggcagatcacttgaggccaggagttcgagaccagcctggccaacgtggtgaaacactgtctctactaaaaatacaacagttagccaggtgtagtggcacatgcctgtaatcccagctactcaggaggctgagactcaagaattgcttgaacccaggaggcagaggttgcagtaagctgaggtcgcgcccctgcactccagcctgggcaacacagtgagactctgtctcaaaaaaaaaaatttttttttaaataaataaataataaatttatgtcttcataaagcactcagattaggaaaaaaaggataaacaaaaaggcatgtgtcatttttttgattgataattccaaattatgtttcttcctttaatttttgccctcctttcatttacaaacagaatatgtttttggctatcatcaatgatacttactctgaagtgaaatctgacttggcacagcagaaagctgaaatggaactctcagatcttatcagaaaggtaggaaaaaccttaattctcagaattcttctgtttctgacataaaatgagcattgtttcacccagattttcaaatcaacattgatccattgaaattgtttgaaataaagaatacattgctatatttcaggaataatttaaatgttccctatcttggagtcttgatggatatactgctatcttgaattttaattctgggaatccttttatgccctggaattaaattctcaacaatcttttgacactttaagagctgagctgaaggttcatcaccttcattattttgacatctcctgtagctggctctcacttcaggatcctgagttgagaataaactagaagggaagattatataaagggatttccacctcttctgtctcaattaccattttaaaaaaataaaaagttttagaggaaaacacttagtagttcaccctttacccttgaccttccacggcagttttaaaataagcaaaggaaaagattcatgaattcaggccatagcctggggcctgagaacttttacttatgcaccttctcaggaagggtttcattgttaaatagaagggcaggacaggaaagttgggcctctttgttcttctcaatgtaacttctttatttggtttaaagtataaaatgtatacaacaacaaataaccacatttaaaatacacagtttgtttcccaacatcattttgctaagtcatagtggctccttaactgtaatttttttttttattagtccaagccttaggattatgttatctgtgatatatgttataatagaaaacttaagcctcttaaaacaaagtccttgggatgggacctaagattcacattatcttgattccgcataacagttgcttacattttagcaaatctccagtgtgtatgcaagcactcctcacttggcacaattctgatacacacaaactttggttaccccagttttgttatgtaacaccaccttcaacaacacagttcaaatttcagttatcatagtatattaactctgagtaacagcacaaagtacaaactccactgctagctcttcagtgtatagatcagttacctgagtaacagatgtgcaggctgagcaggctcactggtcagtcatgacactattttcagtctgttactaattggtcactgagcatctgctatccaattcacaaacaaagaaagcatgtagtgttgcttccttgtgttccagtaataagcccatgtgacattttacaaaaatggataattgaaaaagagaatgggtgcagtggctcacgcatgttgggaggccaaggcggatggatcacctgaggtcaggagttcgaaaccagcctggccaacatggtgaaaccccatctctactaaaaatacaaaattagctgagtgtggcgacagatgcctgtaatcccagctactggggaggctgaggcaggagaatcgcttgcacctaggaggcggaggttgcagtgagccgagatcgtgccattgcactccagcctgggtaacaagagcgaaactccgtctcaaaaaaaaaaaagaaaagaaaagaaaagaaaaagagaatgggctagcaaagaaatgaaaaatggtaacactggaagtgaaaatcaaaacagagtaatggatttatagaagaaatagctgagtgaagaagaaataggagtgttgacactgcgatcattcaagagatccagatatggagccagaagaacttagggcaggtctatcaacttaaatgaggaaaatagctgtgataaaacagatgaagatgtcttgaggaaatgatgcctgcaaaaaacttcacattaagggaagtcttattagagatatttcacaataatgaaagtacaaaagaaaaaatgttggggctggacatggtggcttactcctgtaatcccagcactttgagaggccaaggtgggtggatcacttgaggccaggaagtcgagacaagcctgatcaacatgatgaaaccccgtctctattaaaaatacaaaaattagccagacatgatggtgcacacctgtaattccagctactcaagtggctgaggcacgagaattgcttgaaccagggaggcggaggttgcagtaagctgagattgcaccactgcaatccagccaggtgacagggtaagactgtgtctcaaaaataaataaaagaaaaatatgttggaagctcatccacatttaagaaggaatatgacaattcactaatgcatagaaaagaagttcactccacattgtaaagtgtacagtgtaatattatacaatgaaaacaaggcaagtgctgtttaaactactctggatacattttttacaaagaaataaaacactttagtttttaatgtttctaatgttttacattttagtgtattaaatcaatattagttttcttcttttttaagctccctatacatttataactgacactaagggagtgtttaatgttttgattaaaagttgtaaagatcacagaacaattgtaattcttcccactgattattcagatcattttgcacaatttcagcttgcatggtcacttacagtgccgcactatgtgcaaagcaaggtcaggtctaaagttcgctaatgaaaaatcctcggccaggggcagtggctcacccctgtaatcctagcactttggaaggcgaggcaggcagatcgcttgagctcaggagttcaacaccagcctgggcaacatggtgagaccctgtctctacaaaaaaaaaaaaatagcaaggcgtggtgactcacacctgtagtcccagctacttgttgggggctgagttgggaaaatcacttgagctcaggaggtcgaggctgcagtgagccagaatcacgccactgcccttctgcctgggtgacagagtaagatcctgtctcaaaaaaagggaaaatcctcatctacatttcactgggttttttgtttgtttgtttgtttgtttatacacacttaaggaaattactgtctagaagatagataatataaaaaataaaaatgcaattcatgattcgggtttcttggtattcctaagaactgttgcacagtactttatgctctgaggcagacagctatagcatatatagtaatttttgtttctatcacataaacttgaatacacatatgagtaaaagacctttagttcttcatgacttactgaaagaccctgactttttccatgtaactgttccacaagtgttttatggaaaactggatacattaattcttcattcatccagcacgtacttgttgaatggccaatgtacaccaggtttgtagtagttactactgtgaatggaaagtaaaacagatgcaaaaggagaatacactaaaccaagtcttttattttttctctctctgatagggctaccataaagctttggtcaaactaaaactgaaaaaaaataccgtggatgacatttcagagagtctgcggcaaggaggaggcaagttaaactttgacgaacttcgacaagatctcaaagggtgagaatcatgcttcctgaggttctgaaaaattcctgcttctaaagataaattcctggtgataagagtatttctagcccaagggctcatacagatactttttttttttttttccagaggcaggtatctttctggaacatgttataagaggaaaacttgcccccatttggtgatttctcctttcctcctgcattttgatgtctctgtgttgagggtgaactgggtacaaggaatgatttttatctgtatcctctctctaatttcaggaagggccatactgatgcagagattgaggcaatattcacaaagtacgaccaagatggagaccaagaactgaccgaacatgaacatcagcagatgagagacgacttggagaaagagagggtgggtctggtttaggagaaccggatttgatttggtacctacaacaccacagatgtatcaaacactatagaagtagtgggttattgagtctcttgcccattccccaccacactctctctctctctcagtcggtttatgtgttagtaccctgtttattccagaaagaatatataacacaattatgtataaaaatgggtggttagcatgatataaaaacgtcaaaatgaaaagcaagcaaaacaaaagtaaaaataatggattattaatgaagcttaaaaatgcattcataaaaacacatatgcttattaagattgggctacaaattgggccctaagcttgctggtaatcagcttgaaaagagaagcctgattagctgcagagtccacaatgtccgtgagagtgaagaaaacaaaaaatgacttaccaagagatgtgaaattattctggttagttagtggctatttaaattgttaacttttttttcttttttttttttttttgagatggagtcttgctctgcctcccaggctggagtgcagtggcacaatcgcgactcactgcaacctccacctcccgggttcaagcgattctcttgcctcagcctcccaagtagctaggactacaggcacatgccatcatgcccggctaatttttgtatttgtagtagatatggggtttcaccatgttggtctcaaactcctgactgcaagcaatctgcccaccttggcctcccaaagtggtgggattacaggcagtagccaccgtgcctttcctaaattattaacatttataataaaattaacagccgccttccatttgaatactttttacaaaatagttaaaaataaacataagtgggcttttatagtcagaaaaaaaaattcaaagctttaccattaactttcaaaaataaatggttagacagcaacaacaaaaatctgtggtaactgaggtacagagaacacagatgaatgttattacaaaagccactttcctatgagaagtctaggacagtggtttctaaatgccactccacagacagtgctagtaggtgacagacttctccagtcacagtgaaatttaagcataaagaaaatgaggaaaatttttacaaggctctatttagacaaagttcttattctgacattacatctttcctactttggagctgttgaatgtattatcttttatgaaaagaaggcgatccaggttgagcatccctaacccaaatatgtgagtctgaaatgctccaaaacctaaaacttcttgagcacaaacatgatagtcaaaggtcatgcttaaaggaaatgctgtcattggagcagtttggattttgggttttcagattagggatgctgaaccagtaagtataatgcaaacattccaaaatatttttgaaaatcccaaatccaaaacacttctgatcccaagtatttcaaataagggatactcaacctgtaatatatttcttcatttctttatttattttattattattttaagatggctcatggcccactgcagcctcaaactcctaggctcaagtgatcttccgacctcaacctcccaggtagctcaggtagctgggactgcaggcatgcatcaccatgcctggctaattttttaaaaaattttttgtggaggcagagtctcaccttgctgcccaggccagtctcaaactcctggcttcaagcagtactcctgcctcagcctcccaaagtattaggattacaggtgtgaccactatgcctggcccatatttcttcatttagttttttctttgcctgctgtgtttttaatgttctttcttgttcaaacaaaaagttggctattccttgctgttagttaaatttgccaatctatgaaactgaaaaatgcaggagtcccagcctggtgttaaatacaaagaaatcccaggtaaatggcatgcacccagttcctgcttgcccaagtccttggtgaggcttctgtggggtctcagtgttctgctcctcactcagtgaccccttgttcttcaggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtgtaagtataaaggaattggcagaatttgcgttgacaagagtccacatgagaccaggcagttccctcatctctctgaattcactcctttccattactaatcatccagcttttaaaaataacttatactggccagacgcagtggctcatgcctgtaatcccaccactttgggaggccaaagcaggcaggtcatgaggtcagaagttcgagacgagcctggccaacatagtgaaaccccatctctattaaaaatacaaaaaattagctgggcatggtggtgggcacctgtaatcctagctacttgggaggctgaggcaagagaattgcttgaacccgggaggcggaggttacagagagccgagatggctccactgcacaccagcctgggcgacagtgcaagactctgtctcaaaaaaaaaaaaacttgtcaattggtgttttgtttcttacataatatgtttactataaaaattagcaaataagagcaaaagaaaacattaacatttcacatatttctaccaatgaaaaatgtttattaatatatcagtgtttgtgtctctatttgcatgtgtttatcaatgtttctatatatttttatggcctaacatatggttcgtcctgaagaatgttccttgtgcatttgagaagaatgaatattctgctgttcaagtgttctgtagatgtttgttaggtctagtttgtttacagttttattcaggtctcccatttcctggttgatcttagatgtgcctagatgtggtattcacgtttgaaagtggggtattaaagtctccaagtattattagttggagttcatcccttcaattctgtaaggttttgctttgtgtattttggaactctgttgttgggtgcatacatatttataactagtatattttcctaatatattgaccctattttctctctcaacttaatgaggctaaagaaaaaaaagaattgaccctgttttcattacaagatgttatccactttatctctagtaaaattctttgttttaagtattttttgtttgatattactgtaaccactccagctttcttttggttgctgtttgcatgataaatctttttccatccttttactttaaacttatttatatctttcagtctgaagtatgtctctcctgtagacagcatataattggatcttatctttttatccagtttgacaatttctgtttttgattagattgcttaatccattcatttaatgttatcattgatgtagttgatttctgtctgctattttattttttgttttctagcttacttttttttgttcctctttcactgctttcttgtacattaagtgaatattttcaagtataacatttaaatttttttaatgatttttcattttttttagtcaggagttgctctaagacttagtttatacaattaagttatgaaaaattacttcagatatatattaactgaatccagtgagatatagaaatcatttctatttagcttttttcctcttccctctttttgtgctatatattcatctatctatatgtatatatagtcatctacatatgttgcaaatcacattgttagaacaatgttacatttttataacacactgtgtaatatatagtatataattttatatctcttaatgaagctgagagaagaggaagtatatatttataaatgtgtatattaacctacttttttaccatttctaattctcttcttttgctcctctggattcaagttatcatctgtcgtcattctctttctccgatacagctttgctactgcctacctcctattattgtcaaatatattacatttctattatagaccttcagatccaattatgtacatatttttacacaactgctttttaaatcagttaaggaacaaaaggagaaatgtacatatatactatattttatacctacacagttatctttaccagtgttctttgccttttcatgtggattctgattactatctggagtcacttgctttcagcataaagaatttcctttagtattttttgtaaagcaggtttgctagcaatgaattctttcattttttgtttatctgagaatgtttttctttctccttcatttcctctggcttgtattgtttctgatgagaagacaggtgctaattttactgtggtccccttgtacatgatgactcaattttctctcaccactttcaagatttttttgcttttgtctttcattatttttactgtgatatgtctgggtataaatctctgagttcatcctacttagaaagtgttttttctgcttctttcactttctcttctcctttgggacccgcattatgcatatgcttaggggtatcacatatttctcttaggctctgttcgtcgtcattttttttccctctctgttcctcagagtgcatagtctgtattgatgtatcttcaagttcactgacttgttcttctgtcagcttgcttaaatctctgttgagctcctctagttatttatttatttatttatttattttatatatatatatatatatatatatatagagagagagagagagagagagagagaaagagagagagagagagacagggagacagggtctcactccatcacccaggctggagtacagtggtgtaatcatggctctctacagcctgaacacctgggctcaaatgatcctcctgcctcaacctcccaagtagctaggactatgggcacatgctgccatgcctggctaatttttaaaaaaaaatttgtagagatggcatcttgttatgttgcccaggttggtctcaaactcccggcctcaagtgatccttccgcctcggcctcccaaagtgctggggtcacaggtatgagccaccgcacttagcctgaattttttatttattatacttttcaactccagaatttctatttggttctttttagcaatctctgtctctttattctgtatttgatgatatcctgtatttgatgagacaatgtcatcataacttccttttttttttaagagatagggtctctctctgtcacccaggctagagtgcagtggcatgatcctagctcactgcagcctcgaactcctgaactcaagcaatcctcccacctcagcctcctaagtacctgacactacaggcatgagccactgtacccagctaatttttattttttgtagagatggggtctaagttgcccaggctggtctcaaactcctgggctcaagtgatcctccctgctcaggctcccaaagtgctgggattacaggcatgaaccactggacccagcctcctttatttctttaaccatggtggggttttttattatttgtttgtttgttttaacctgtttgaatatatttataataggtaccttcaggtctttgtctgctaagtctgacatctgggccctctcaaagacagtttcagttgtctttttttttttcttcttgtgtatgggaacattttcctgtttttttgttttgttttttgttgttttgttttgttgttgttgttgttgttaaagattggacatgttagataatatattgtaggaactctggctagtgattccctttcctccccaggacttgtttttatttctctttgcttgtttactttttcatacagtctgtttccccacagtgtctgcctctgactttattccttagagggcgcagctgtggccatgtacgtagtcactctgggaagacagtggttttagcagcgtgctcattaactttctctgacctctttgttatacctcctgcctctgtggatattagacccagttattacatttcattgtttactgattggtctattgttttccagaatgccttgggatgtaatttgctccacagtctgatccacttaaattcaggcctctttgcagggctagttttagaggccagtctttttttttttttttttttttttttgagacagagtctcactctgttgcccaggccggaatgtagtggtgcagtctcagctcactgcagcctcaatctctcaggctcaagcaatcttcccacctcagcttctcaagtagctaggactacaggtgcacgccaccatgcctggttaatttttgcattttttatagagatggggttttaccatgttgccccggctggtctcaaactcctgagttcaagcaatccacccacctcagcctcacaaaaggccgggattacagatatgcaccaccacgcctggcccctgaggccagtctttaactgtcttcttagctgtctctttccctggttctctctggtgaactagctggtaatttgtttatctcataaggctaccagattccttgtaaatgcttatccccacaatctccattgttttcaagagcatcgttagtctttaatttcctcacgcttcattccaaataaagtccattcacttgagaagagttctatattcctatgacctgtgtctccccatgagcaaaactgctactgctttacagagccagggacagtggcccacctctctgtggcatcctgctttatgaacaagtcactgggctcagatggcagtctctgattttctcaccttgcttcttctggcatggaaactccaccctacaagtgggaactgagtggaagaagagagccccattccccttagccactcttaacaggattagaacctctgcaacatgcatttaagaatgggaacaggctgggcacagtggctcacgcctgtaatcctagcactttgggaggtcaaggcaggaggattgcttgagccaggagttcaggaccagcctgtgcaacatggtgagaccctcatctctacaagaaatagaaaaattaactggtgggttgtgtatacctgtaatcccagctactcgggagcctgaagtgggaggattgcttgaacctggaggcagaggttgcagtgagtcaagattacaccattgcacgccagcctgggcaacagagtgagactctgtctcaaaaaaaaaaaaaaaaaaagagtaggaacattgaggctgggcatggtggctcatgcctgtaatcctagcactatgggaggccaaggcaggagtatcacttgacgctaggagttcaagaccaacctgggtaacatagcgagactttgtctctattaaaaaaaaaaaaaaaaaaggtgtaaaaaacttttgtaacaagagtgggaaagccgggcacagtggctcacacctgtaatcccagcactttggaaggccaaggcaggcaggcggatcacctgaggtcaggagtttgagaccagcctggccaacgtggtgaaaccccatctctactaaaaaatagaaaaattatctgggcatggtggtgcacacctgtagtcccagctactcgggaggctgaggcaggagaatcacttgaacctacgaggcagaagttgcagtaagccaagatcacgccactgcactccagcctgggcgacagagcaagactctgtctcaaaaaaaaaaaaagagtggaaatgttaggatgagaaatgctggcagcctgcccctccctgggagatactgtagccctagactggaagttgggggaggagggagccctgtgctcttagctgcacccatgtgaagttgtgcttctatcacatgagctggggacaggagagaaggctcagattatggcttcagtgccacagaatctcttcatactaaaatttagtagattttcttgaataaatgctttttcatttgctgtacacccttaaaagtttctagaaatttttaatatttgagttttaaaaaataattttcaacagttacagttatttcactaaagagagagtctacagaaccctcttgccaccattgcagaggttgtctttggcttacgagtttttaaagtatttgtatacattttttaagttcaaaataatagaattgtaagtgaacatgctgttttcatactgtttttcaagctttatttaatatattgtaaatctaattctattttattaaatagtctgccacagtataatgtctgatgtctccttagaattttattgtatggatgaacaatgattatttaatttcctaccaattgttgggtgttttttgtttgtttgtttgtttttgagactgggtctcactctgtcacccaggctggagtgcaggagtgcggtggaatgatcacggctcactgcagcctcaacatcccaaggctcaggtgatccttccacctcagcctcgcaagtagctgggagtacaggcacatgccaccatgcccacctattttttagagatgaagttttgccatcctgcccaggctggctcgaactcctggcctcaagcgatctgcacacttccgcctcccaaaatgccaggattacaggcgtgagccatcatgccctacccccccatcaattgtttgatgtagccatttttcaatgatccgcgattaagaagcagcactcttttatagccaaaaattacacatatataaaattttcctttagaaaatgttctaaaaatggaatgtctaactaaagggttaggcatacattcttaagacttctgatacgcgctgacttgcaggaaagttgtttcagttaacactcctaccagcggcatccgagagttaatctgtaaagcttgagacaacttagaaagtgtttcaaatgattgtgttgcttaagaaaaaaatcttagcacttccttttgaaaagccagtggggctgaaaagacaatgacaagcactttgtccctctgtactgtgttttccttgcagcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggtcagtagtcatgagctgaaaacaccgctgctgagcatggtgttattaatgaaaatatatgttgctgacagttgtatttgaagtattgaagaagagtaaaaaaaatttacgtttatagaaattcacaatgatgtttccatttactctcattttcagatttttttctctgaaacagaaacactctttctataaaatctcttgctataaaacatcaatgtagtcatattgtctaacccttaggctgagatgtttatctttctccataactacagataaaattataatctggaggtgttactttcttaatactccatatgctaatggtcctgccttcactgcagggtagaattaagtgaaaaattactccagcaactctgagatttgctattatatgctgtaaatctccagccttaccaaactacagattatttggtccctggacttcctaaggcatttccttctactgcccccaacaccagtttctttttccctttttaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttacccatggttcaaagatttttttttctttttctcatataagaaatctaggtgtaaatattgagtacagaaaaaaaatcttcatgatgtgtattgagcggtacgcccagttgccaccatgactgagtcttctcagttgacaatgaagtagccttttaaagctagaaaactgtcaaagggcttctgagtttcatttccagtcacaaaaatcagtattgttatttttttccaagagtgtgaaggaaaatggggcattcctttccactctggcatagttcatgagcttaatacatagctttcttttaagaaaggagccttttttttcaactagcttcctggggtaaacttttctaaaagataaaatggaaaggaactccaaactatgatagaatctgtgtgaatggttaagatgaatgttaaatactatgcttttttgtaagttgatcgtatctgatgtctgtgggactaactgtatcacttaatttttaccttattttggctctaatttgaataagctgagtaaaaccaccaaagatcagttataggataaaatggcatctctaaccataacacaggagaattggaaggagccctaagttgtcactcagtttaatttcttttaatggttagtttagcctaaagatttatctgcatattctttttcccatgtggctctactcatttgcaactgaatttaatgttataactcatctagtgagaccaacttactaaatttttagtatgcactgaaagtttttatccaacaattatgttcattttaagcaaaattttaagaaagttttgaaattcataaagcatttggttttaaactattttaagaatatagtactcggtcaggtatgacggctcacgcctgtaatcccagcactttgggaggccgaaacaggcgaatcacttgagcccaggagttcaagaccaacatgggcaatgtggcgaaactccatctctacaaaaaatgcaaaaataaaaaatatagtactcaagtattcttgatcctgtgtttcaaaactagaatttgtaatgcaaatggagctcagtctaataaaaaagaggttttggtattaaaagttcatacattagacagtatcagccaaaatttgagttagcaacactgttttctttacgagagggtctcacccaaatttatggggagaaatctatttctcaaaaaaaaaaatcttcttttacagaaatgttgagtaaggtgacattttgagcgctaataagcaaaagagcatgcagtgctgttgaataaccctcacttggagaaccaagagaatcctgtcgtttaatgctatattttaatttcacaagttgttcatttaactggtagaatgtcagtccaatctccaatgagaacatgagcaaatagacctttccaggttgaaagtgaaacatactgggtttctgtaagtttttcctcatggcttcatctctatctttactttctcttgaatatgctacacaaagttctttattactacatactaaagtttgcattccagggatattgactgtacatatttatgtatatgtaccatgttgttacatgtaaacaaacttcaatttgaagtgcagctattatgtggtatccatgtgtatcgaccatgtgccatatatcaattatggtcactagaaagtctctttatgatactttttattgtactgtttttcatttcacttgcaaaattttgcagaattcctcctttctacccataaattacatatatttttcttctttagtcatggagaactccccccctcatctcttccctattatctttccctgtgtactggtattattaaaaagacattacatacgcaagtctttctcgacaatcaagaatgttattaatgtgtaatactgagcactttacttcttaataaaaacttgatatagtagcaga

SEQ ID NO: 5546 - RNA, 70133 nt, Homo sapiens
gcgccgggaagaaaggaacauggcuccugaggcgcacagcgccgagcgcggcgccgcgcacccgcgcgccggacgccagugaccgcgauggugaacuccagucgcgugcagccucagcagcccggggacgccaagcggccgcccgcgccccgcgcgccggacccgggccggcugauggcuggcugcgcggccgugggcgccagccucgccgccccgggcggccucugcgagcagcggggccuggagaucgagaugcagcgcauccggcaggcggccgcgcgggaccccccggccggagccgcggccuccccuucuccuccgcucucgucgugcucccggcaggcguggagccgcgauaaccccggcuucgaggccgaggaggaggaggaggagguggaaggggaagaaggcggaauggugguggagauggacguagaguggcgcccgggcagccggaggucggccgccuccucggccgugagcuccgugggcgcgcggagccgggggcuugggggcuaccacggcgcgggccacccgagcgggaggcggcgccggcgagaggaccagggcccgccgugccccagcccagucggcggcggggacccgcugcaucgccaccucccccuggaagggcagccgccccgaguggccugggcggagaggcugguucgcgggcugcgagguaagagcgcgcgacccgcagcggcagaugcacgaaccagaacggccggcgccggccggggccaucgcccgcugcggcagcuccccgggcuccaucucgcauccccucugcguuccgccucccuuggaagcgcauuccccaccuccgcuagugcugcccuauuuccgguacccagcgcggaauuccacugcucuuuuguuggugcauauuuauuggauaccuccuucuucaggauaugucaccauagucuuuuuuacugaaaauuagugaaagccuaauuagagugaaagaguacaucuggguuuuguuuuuuuuuuucuuguagaggaaaaaaugaacauuacuuguguaacugaugguaguugcaacugcauauuugccaaugucacaaaaucuaaaggaaaauguuauagucacccgugguuuccuucuugccuggacacuccauugucccgggcugaaaaggguagcaguacagugcauauaaugucaaguugugggaggaguguggcagauugucauuggugcauuuuuuuggugaugugugugguuguuuugaggagugggagcuguuaagaacaccacaaauagaauaaaauaauaucgugaaguuauuuggccguuucuaauucuagacauuuuucuaaaaacaguugcaaaggaaagauuacauuguuuuaaaaaaauuugaaguauguuuuuaaauaacuaaauuaauguucuuugaaauuccaccaaaaugaugaagucaccagauagcagcugauaaaugugucugagcccagugcgcccagcucuacaaaaggcagaagaggaauuuucaaauuugccagugcccaguaagaggacaugaauuuucuaguaccagaggaaauucucuuuuuacaaauuuugucagagguauccuugggaaaguauuucauuugcuuuuacccuccaaauuauuuuaaucuauauuuuuaagaguuuccauucucaguugaguuuuucuuguucuucuccuucugucaguuuugaaagucuugcacaaaaacaauccagguguuguuacagcagugugauuaaaaccaggucaggccuacacugaaaucccaguuccaccacucauuagcuguacgaccuugagcaaguuacuuauccucucugauacccaauuuuuggauuuuuuuuuuuuuuaaagagaugaucauaacgcuuaggacuugacucuuugggagaauuaagugaguuaagacauaaaaugugcagcauguauuugucauguuauuagcgcuucagaaauauaaauguaaacauuuugguacuucguuuauggagauucuuauacuaguuaauuuuauuaaaagcaugauggggaacagaagauccuuuucggauaaccugugugaguaaauuaauaaaacacuaacacuuuuuaagauucaaaacuggauuaauuauguuauuuuacaccauuuaaaaugugcauuuaaaaaauauucacugaagugagagagaaguuccuuuuaaguuaauaaauaaugguaaguugcaugauccuuuuaacucaguuuaagcauuugauaacaccccuaaccuuguuugaauaaacucaauaacagaauauagagaaauaaaauauauauuucauaugaguauguauguaaauuuauuucuuuuaaaggaaaauuucaggaaacaaaaugaauaagcucauagucauaaaaccucuagccaaagugugucaauggucugauuuguaggagagcagacucaggaaucgggaauuuuuuuuuuuuuuuuaagagucgggguuucacucugucacugaggcuggagugcggggaagcaaacguagcucacugcggccucaaacuccugggcucaagcugcccucccaccucagcuucccaaguaguugggauuacaggugcaagcugcugcuccuagcugaaaaguuuuaauuauauaaaauguuuaaauaaauuguuauuccuuucuuuuaugaagaaauauaauugauauucuugucacuuauuaaauaagcaacauuuuaaaauguuuagcaccuacugugaagauagcacugugcuagcugcuaugaauaaacuagaauagcauaucacuguuuuccuauggacaaaaacccagaaauguaaaauaaauagccaugaauggguugagauucccccugcccccuuuggauacugaugacagaaaucuuauaugcacuauguaagcagugcccuaggaucagaacagaaaguaacuugcaauuuuuaaaggugggagaaaugacugaaguuuggaguggucaggaguuucccuggaagucucuugccuuugugacuuuguauagcucccucaaacuaccugagccugagcuccucauuuauaaaauggaagaauugaaccuagcuuccaagguccuuucuagcuucaccaugcucuggucuguuguuuaaugacaugaauccaagauggacaacaaauggucgauuuugcuccuucuacaguaaauagaucuaucuucuuagcagaaguaaaauaguaaagaaagaagacauguuugaggccuguugaggccuguuugcuguaugcauuguaucuaaucaaggaauugagaauguagcccuaaauauuaggaaggaguugaaaguuucugagcaggaacagaacaugcugaaaggaaauugugucagcagcaugguguacaggagagcuuggcagagagaaaggaggcaagaagaccugugggaggcagccaguaaggaggugaagagggccuggaccaaaggaagccaaggaugaccgaaagauuuaaagaugaagcccagauuuaaaaguauccucaaguauuuguuuauucuuuucuuagcaaauucuuuuuaguacaaagauaaaauauggcacucugagucauaaaauuuucugaauuucagaaguugaauguuuuucugaauguaucaaccuguuaaagucaguuccuguuuguuauuuuaggcguauauucuugggcuuuuuuuuuuuuuuccuagagaaacuaugaaguacuagcugugcaagucagggugggcuaagcugcuaaaacagauaccucccuccccuucaauacccugaagaacaagaaguuaauuuuuugcucguguaacauuuuagagaggguauuccagguugaauaccuggaauaaugaaugaaauaauaagucgacucuuauuucuccuaaaauaauuggaucuugacauugaaauuggugugcugauuguauuuaauaagugaccuccaaugcaguuauuucauuuugccauacuuuauguaauuuuuauuuuuucugccuucccuuucgaugucuaaagggaagcauaauuaguuauuggaaagguuauugagacuuaaaaaaagauuugaacauggcuuugguugaugcuaccacacagaaacugcaaacauccaacucaccgcucuuaguugcuguucaugauagucuaugcacagugacugaugaauuuagccugucuugaggcuucagaacuuagucuuaugucaucacgagcagagcuuuauccuaaauuacagguuuucaaugggggggggggggaggggcaguuuugccccucaggggacauuuggcaaucucuggagacauuuuugauugucauaccuggggggaugccccuggcaucuccuggguugagguuaaggaugcugcuaaucuacaaugcacaguacagccaccccacacacacacacuacaaagcauucucccacccaaauugccaggagugaggacuuugagaaacccugcccuagacuguuaaauucaaaaggaaauaaugguuuauugcucacagugugccaggcacuguguuaaacuccuuauauucauaguuuuguuuuuauccucacaacaaccugugaagaaagaacucucauccgucaccacuuuacuguugagggcacuaagccuucuaaagguuaaaugacuugcccagggccgcaacuauuagauguugcagucaggauuuaauuccaggcacuuuguguucaaaguguuucucauccacugugcuauaugccaguagugcccaaaccuaacuuuagccagcaauugucugcaucucuucaguuuaugaacauuuauuuauuaggacaugcaggauaaucauaccaacacaguccguguauccagaauucuaauugaucuagggagugggagagccugccucucuauuuuuuuuaaauuggugugaaauauacauaacauaaaauuggccauuuuaaccauuuuaaguauauaauugagugacauuagguagauuuauuauauuauguaaauggacuuaacacaauuuauuuccagaacuuuuuuaucaucccaaacagaaacucuguacucauuaaacaguaacucccuguuuccccacucccccuugccccagacgcuaguaaccuccauucuacuuccccuuucugugagucucccuguuguagcuaccugauguaagugaaaucagaccauguuugaucuuuugugucuggcuuauucacuuagcauaguauuuucaagguuuauccaugcgugcaaauucccuucuuuuuuaugacgaaauacuauuuaauuguguguguacaugugcacacacaaugaaauacuauuucaucauaaaaaggaaguuuguacacauauauacacacacaccaaauuuuguuuauccauucaucaguucaugggcauuugcgguuuuuuuccaccuuucgacuguugugacuuuccguuuauuuuuaaucugaacuuuacuccaucacuuccucccuuuccuuuuuuauucgcaccauaauuuugaacaagcagacuuuguauuuucauuacucuggggauuuuuuugagggaggcuugcuacccuuugggguugugguaagguugugccaguaacagaauucaugcaguaaaaaacauucaugggacuuucuuuugugauagguacuagggaugcagagaugaauaauacaaggucucgaccuucaaggagcucaggguuuaguagggaaaacagagguauaaguaagucauugcaaugccaggucccagauaugggaggauuccagcaaagagaggauaaggccaggcacagccgcucaugccuauagucccaacacuuugggaagcugagaugggaggaucacuuaagcccagcaguucaaggcuacccugggcaacauagugaguggcaaaaaauacaaaaauuagccaggcaggguggcacaugccuguggucccaguuauuugggaguuugaggugggagaaucaccugagccugggagauugaggcugcagugagcugugaucacgccacugcacuccagccugggugacacagugagaggugagagccuguaucuaaaaaaaaaaaaaagagaggaucagauuuaccuggagaggucagagaagguuuccagagggaguaaaacuugagcuucauuuugaagaaugagaggggaauacaaggagggaaaaauaauaggaacaagaccuguuccuguuacagcaaaccuguaacucccaccauggaaugggcacguuuuccuguagacauuuggagccagugugggcuucaagccuagggggcugauaugaucauuugucaaucugaagaugacucuuggaacaacguagaggauagggugagguggguaggcugguggcugacagacuaggucaggagagggcugaccaagaggaggaggggugacgagggcuggaacuaaggcauaugagcugggauggaaagaagcuagauagaaaggaaacaaaaaccaucagaacuguggaaccaacuccaugggagggauaagaagagggccuauucuagggugaaacccaaauuucuggcaugguaccauuaacccaaacagaaagaggagauuuccagagaaagaaaagcaaauuuugcgggaggugagugugagcugucuagagaauaugcagguagaacuacauguuaacuguaacauauacuugucugcaccucaggagauggcugauuaagaauucaggauucaggccaggcacgguggcacacgccuuuaaucccagcugcuuaagagacuggggcgggaggauugcuugagccugggaauccgagaucagccugggcaacauagcaagacacugucucuaaaaaaaaaaaaaaauucaagauucuggagucaauauuacuuaagguagcaacugucuauucuauagaaaauggacaaauauagauaaaaagccacuucccuuucuaaaagugucccugcaauucaagugaauacuaggaaggauuguguucauucuucuaaacaagacucacauguaucuuagcacaaaaagaggauucuuuuaugauacaaaugcacugagaauuuggucaggcuaucacaaugaacugauaguucagauggauuugagucuuuauaccacucuggaaucuggaccaacugggccuccuaaggccauuuugcagaucugggcuuguuucugaagcuacagacaggccucuuccaagcacucuaagugcuccacaaauaauauuucuguuucccagaacaaccccacaaaaagguacucuuacuccauuuuuagaugaggaaguggaggcucaugaugucagguaagcuuucucagcucccaagugguuaagcccucaguuuaaugucauuugacuccagagcccuauguugcaccaugccuugauaauaggccauauggguuucauguauuucagauggggaagguuagugugaggugaaagauacacaauuaaccuuuuaaccauggaacugaaauauuuacagaugaagugauacaauagcuggaauuaauuccaaaauaauuggggugguacugguccauggccuguuaggaacugggccgcagagcaggaggugagcagcaggcuagugagcauugcuacccccuaucauaucagcaguggcaucagaugggugaggauguaaaugaacuaggauuggcauugaguugauauuguuggaucuaggugauagauuuaucauuauaauauucucucuuugugauauuucugauauuuucuaaaauaaaaaguuguaguuauuuauuuauuuagacggaguuucacucuuuugcccagguuggagugcaguggugugaucucggcucacuguagccuccgccucccggguucaagcgauucuccugccucagccucccgaguagcugggacuacagccucccgaguagcucaccaccacacccagcuaacuuuuguauuuuuaguagagaggagguuucaccauguuagauaggcuggucucaaacuccugaccucaggugauccacccaccucggccucccagagugcugggauuacaggcgugagccagugugcccagccaauaaaaaguuuuugaaaggauuuagauaaaauaguuggggaaauggcauuuuuguucaaagccaauuauuuauguuuggaauaucuuuugugcuuggaguucuccauuacagaguuccccaguguuccuauuaauaaguaacauugagcagaggaaugcacuguuuagaucagcaguccccaaccuuuuuggcaccagggaccggcuucauggaagacaauuuuuccacagaccugggguaggaaguguuuggggaugaaacuguuccaccucagaucaucaggcauuagugagauucucauaaggagcaggcaaucuagauucuucacaugcgcaguucacaauaggguucucacuccugugagaaucuaaugccaccccugaucugacaggaggcggagcucgggcgguaaugcucacuugccugcggcucaccuccugcuguggggcccgguuccuaacaggccauggaccaguacccgucugcagccuggggacuggggacccugcuuuagaugauguacucuggcuuugcauucuggcauuagcuaagcacccucuuaaaggaaauugggucuauacucucaguccguguucucccuaacaccuggaaacauugaauaccuucaaugcugggaaguuaacucccaccacaacuagaacagcuaugggaaagacaacaguugauuuugaagagugucaccaauuugcacaugauuccauccuuaaccauucuuauccuaucagcucugccaaacauggagaauaguuggcugcaggacagcuauuuuuccuacuuguagaugcaacuauuucucacccaccaggauguaaaaggucccuguacccuaagauugguccuacauacacacccaaugggaaaaugagaugaaaaauuuaaagcaguaaauauuugaggaaguagauagaguaauuuagaaaaagaaaauacacagggccaagcacaguggcucacaucuguaaucccagcacuuugagaggccaaggugagaggauugcuugagcucaggaguuugaggccagccuaggcaauguagugagaccccaccucuacaaaaaauuaaaaacuuaguugggcuugguaguauguaccuguaguuuaagaaacuugggaggcugagcugaggcaggaggauuguuugagcccggguggucaaggcugcagugggccaugauugugccagaguacuccagccugggugauagagugagacucugucucaaacaaaaaaaaaaacagagacagaaaaaaagaaagaaaauauauggauguauaucauauaaaaauauaaauaagggaggccaagugcaguggcaugccuguaaucccagcacuuugggaggcugaagcaggaggaucacuugaggccgagaauucgagaccagccugggcaacguauugagaccucaucucugcaaaaaaucaaaaaaugaggcggaaggauggcuugagcccaggagaucaagccuucagugagcugugaucguaccacuacacuccaggcuggguaacagagagagacccugccucaagauaaauaaauucauacauacauacauacauacguacauacauacauacauaagaagacuuguuucuuuccauuugcaauguuucauucaaaggcuagaauuaaauugccguaggccaucacaaguuuagcuugaauauuauuauuuuuucaagauggagucucacucugucacccaggcuggagugcaguggugugauuuuggcucacugcaaccucugucucccggguucaaccgauucuucugccucagccucccauguagcugggauuacaggcgcccgccaccacaccuggcuaaguuuuguauuuuuaguagagacaggguuucaccauguuggccagacuggucuugaacuccugaccucaagugaucuacccgccucacccucccaaagugcugggauuauaggcuugagccacugcacccagccuagcuugaagaaaauuugauaggaguuuguuuuuuucuauuuauaggccaagcaauaccacguauaaauauuaagaaucauggcuguuccuuagugccuaguuguuuauaaaccaugggaaagaaugaaaucauugaccaaaugagacaggguaacagucuucccugggaguaaagagacuagcagucucuauugacauauauuuuaggccuggccuccaaaauaaauuuacccaaagaagugauguauuuguguccagggcuaccgagccuaaucuuuggcugccucuguguuauucuaaguuguaauuuuccaugucaucuaaauuuguaauaauucuuuaauaugauaguguuucagugaacaaacauucugcuugcugcauuucuucugagugaguaauucccugacaacuaccagaucuuggcagaagcaaaguuggucauaaguuaugcuccacucucagugcuggugaaacguaugaugcguaacacaguguuuuugaauucagugcugauuuuccuaaaggacauuuggaaggaaaaaagaaaaggaaaggaaauacccaaauucaggaauagaacuuacauauuauuauaagacuuaaaaaauacaugaacacuaaugaugaacucauuucuucgaaguaaaaggccuuaugcuauuuuuucccauuucccuauguggcuugauuguggcgaaaguggcugugugaguuuccauuauugaaggaguuaaggucuguggaaucaaagcaugagacaacaugcaaggaccagguugguuuccauuuaacagccaaccuaaucuaacugaaaggauugagagguuugucuuuuuuggaaaguguuaagguucuuccaaguaaccagcaaugugacuuuaccacacuguucauuaacggggcuuuggauggccaccaugucugcugcuggcugaguccaaaacugcggucacucucuccagcaagcucauggaggguuacgucaucuucacucagccagcccaacgcuuuuuccaucugcuaaaauguagaacaugguuguugauucuacucuuucuacaaagaaagagagggaacauggaugaguugcugcuuuuaaagauuauauguuaauugcuguuuuaaaaaucugcucagcuaagcacgcuuaguguaaucagucaccauggaguuuuuuaauaggacagcuucugcucuuacagagcagaguuuuuaugccaguagguuagaagcauaacauguuucuauauugaagugauucuccaacaaggacuucuuuucaucaggggugaccuaaaaguuauuacuugaaauauaauuacaucauguucuuaacuggguuuaguaguaggauaauuacaagguuguauccaccucaaauaggaagaacugauaaguuuugcacaauuauuuaacuccucuguuaggccuuccuuauuuccuguucucuuuuuaaaauuugacuaagauauugcuaaugggcuugggagccuauaaaaugaucagaauuguugccuuauguuuugcauguuugggguaacauuggagccagauguacucuuaaauaaaagguaggccuacaaaaccaguuucucaguugcauucaaaaugugauuaaaaaaaaaaaaaggagaaucucccuuauaggugaacuuuuuaauuugugcuuuauuuucccuuuugccauucaugagauuucuuaaauaaaaugauaucuuuucuuuucuucauuauuauuuuaaaggucucuggggaacaagacucauggaggaaagcagcacuaaccgagagaaauaccuuaaaaguguuuuacgggaacuggucacauaccuccuuuuucucauagucuugugcaucuguaaguagaauauuuccuugcacuaaugggaaaguuuugaaaagauuugaccuauccaaaucauaauuaaaaggaaguguguaugcaccagaggggcaacugggaaguuaccuucuuaccuuuguuuuuaauucuaauauuuuuauuugggcauuuguuuauugacuaucuuccuaugguagaaugcaagcuuuauaagagaagggacgugauuuguucucugcuguacccccauuucccaaaacugcagauggcaacagaaggcucugaaaaauauauaagaaagaauuuuucuaauugugacuaaauugugaccaaaugcuaagugacuguggacuugcguuuaacacaggacgggagaggcaaagaguucaauuccaauuuagaauuuggucaaguucucuucugcacucugguaaacauuaauuaaaaaucagcauuaucugaccagccaguucaucgucagugguggugauuuucacuaugagauacgcguggcaacuugccagacaccaagaaaccaaguuagaggauuuuuguauuagauuccuuaacaaugaauacaguaucaccauuauuacaguaucaucauuauugucauacuauuauuauaucaguuaacauaaagucugcauaagaauuguuuccagaaaaaugacuuuccaaauuuaacuuucaggaaauacaaauaaugcuacuaauauugcuuuuauuggcguauacauguaauauccccuucuuuuggauuuggauauguugugucauugccucauuuuaauucauuauuucuucucaaucuuuaauaauugcuggacuuuuacuccacaagaaacuugcuauaggcccaucucuuucgucuucuuuccuucuuucaguucgucuucccauccucugguagggggaggggagggaugccugagcgagagacuagcuguaggaaccauuugucucaaaguccagaaagccacaggugauggauuuguccucugaaucaaagggcguucgaugauggauuucugucaugucucaucuaaagucuucacgagaacagaugaggaagcaguuuuaugaccccagagccuccuaccaaacuccucugagaaaagguuuccuuuuuuuuuuuuuuuuuuaaauuagagacagagucuugaucuguuucacaggccggagugcaguggcacaaucauagcucacugcagccucgagcuccuaggcuucagugauccucccaccucagucacccacguagcugggacuacagcugcacaccaccaugcccagcuaacuuuuaaaacauuuuuguagagguggggucucacuuugcugccuauacuggucuccagcuccuagcuucaagugauccuccugccuuggaaguucugggauuauaggcaugagccacugcacccagccuggaugugauauuuuuauguuuuaaauuguuagaguuuagaaacuugagauugaguuugcugccugcauuaaaaugaugcuuaaacauuaaacugcaguggccuuaaauauuaacaaguugauuagaauuacuaaguucuuuucaagcuuuacauauacagacaaauuucuuaugcaaaauagaagguaaccccuguacguaagucuagaauuucagcaguccccaaaacugacugagcauuagaaucacucugauuuuaaaauacauaugugguuuuccgagaucuacuaacagagccuccauaauguagccuagagaaacgaguuuucagauguagugauaaauuuggaagguaagucagagaaguaagcugaagacagaguuuuaggaaauaugccuaaagucacauaaugaauugguuuucuuguuuauuugagaauauugucgcuuuuuguucuuuuucaugcaaaucacauuuuauuucuuaugugaguagcuauauauuuaaaaauuuuguuuuuggaauauuguagaaucucuacuuaagaaaguaucuuagcagucauauggucugaccucacugaaugcuaaauucucuuuaaaacauccgucucagaugguuacucauacugccucugauugaacaagagucccagguuaagggacuuacuucuuugaaaucguucauuucauuuuucuacagcuauguuagaaaguucguccuuagcagugaagccagagucuaucucuuauaacuucuacccaguugcacccuccaagccuaccuauaccaaguaucuuuuuuccacguugcuuuuccaauucagcucuucgcaaguuuggagacaaauaccuaaucuccucuaagccuucuccagguuaagccuuuccaguucauccagcuguugauuaugugauuggagacacaaguuugaguaacucccaugauggaaagucccucuggugaauguucuguucaucagagucccuaagaaagcacaugagccucaccauggugaguggggccaugagauuccuaaaccagacacuacacuguggcuugugcaaccuaccauggccagacucaugaggcuguuucaucauauaaauaauuccuuagucucuucaccaaaaacugugaagcacugugucccccagcuguaugugagcuagccugggaccauaguggaggacuccucuuucaacccuguuaaauuucaucuuguuaggaucugcccauuuuuccauucuguugaaauuaucuuggaacuggauucauucaucucacaucagcuacuccccgaagccucacaguaucagcagaguuauuaucucuauccauauccuuguaaauuauuaaacuaaaaaagauuggucuaagaacaucaguccauuaaucaaggcucuuugguuggaguucacuucauuauauuaucauccagcucagaguguucauaaacaagaugauaggaaagacuuuuccaaaugccugucugaguaauucccccauuccugugaucugugagcuguugaccagauuaaaaaggaagugagaauaaccaggcaagauuuacuccuagcaaaaccuuacuggcuucuagugacugaguccuuucccuauugcuuaccagcuaucuuuuuaauuacuaguuuuaaaaucuugccagcaaugucaauaucaaaugaccaagaauaucaaacucauuacucuguauguaaaugagauaguguacuuaccccuauggcuuaaguauuaggcuguucuugcauugcccuaaauaccugagacuggguaauuuauaaaaaaagagguuuggccaggcacuguggaucaggccuguaaucucagcacuuugucaggcugaagcagguguaauggugagccaagaguucaaacuuagccuggacaacaaggugaaacccccucucugcaaaaaauacaaaaauuaucugggcaugguggcaugcaccuguagucccagccacccaggaggcugaggugggaaaauuguuugaagcugggagucagugauugcagugagccaugauugcaacacugcacuccauccagccugggcgacagagcaagacccugucucaaaaaauaaauaaaugaauaaauaaauaaaauaaauaaauaaauagaaaagaaaaagaaagaaaagagauuuauuugccucaugguucugcaggcuguaagggaagcauagcuccagcaucugcuucuggggaggccucaggaagcuguuacucauggcagaaggugaagcaggagcuugcacaucauguggcaaaagcaggagcaagagagagagaauggggcagggaagaagccccacacuuuuaaaugaccagaucgcaugagaaaucacucguuaccucaaggacaguaccaagaggaugguacuaaauuccugagaaauccacccccaugaucugaucaccucguaccaggccccgccuucagcauuggggauuauguuucaacaugagauuuggauggggacaacauccaaacuauaucaccuugcauaguagguaggguuuuaaaaagcaguuuggcacaguaagaaaaguacagauuuuuuuugcaucagacagaccugaguuaaaaucccagcuucacugcuaacaugcuagguaaaugugggcaaguuaauuaacauuucuaagccuuuguuuccucacugguaaaacaaguauuuggaaauaucauugugaagauuagaaauaauacaugaaaagauccuaggaugcugucugucauacaguaguaguaguaagaaguuauucuugccaaagauuguugagaauggcagaauuaucucaguucuaagagcuauaguuucuaauuauuugagccuagacucagauucauuuggagcagcuaacugcucaccaagagcuuauuuuccaucuuaccaaugagguuaugugcccuguguuuuuaaaaucagucuacuuaaccaagagaacagaaaugacaugagaauuaaguaaucucacuuucucuguuauuuaggauuuauuccuacucaaaaccugagaguugcuaugaauucaccauuaaagcacuuauuaauauacauggguuacuguuauaaauagcaauaguauugcuauugugugaguuagguguugaaguucaagaaaggaauaaagaauauuuagaagaucuuugaaaacagugucuggguacgguggcucaugccuguaaucucagcacuuugggaggccgaggcaggcagaucacuugaggucacgaguucaagaccagccugggcaacuuggcgagaccucgucucuacaagauauacaaaaauuagccggguauguuggcaugcaccuguaaucccagcuacuuaggaggcugaagcacaagaaucacuugaaccugggaagcagagguugcagugagccaagauuguaccacugcacuccagccugggcaauagagcaacacucugucucgaaaaaaaaaaaaaaaaaaaaaaaaagaaagaaagaaggaaggaaggaaagaaaaaaaaaggaaaaaaugcaaggaagguauuuggugaaucuauaauaauaaaaauguauuugucauuuccuuuuucugugcucucauucuauaaaauugaguaaaaaaucuauauauaguuuaaacacauuaauagaaaucacaaaaguuagcugagucaacauuguagaaacauaauauuucuguaugucaaagaaauagacaacauuaaaaagcagaaagcaauuacaaagaaugauuauaagaaacaucacaaaggguuaauauuuuaacacauuugaaacucaaaaaucacugagaaaagcaguagacuuccauaaauauuuuauagaguagaaaaaauaggccaagcacaguggcucaugccuguaauuccagcacuuugggaggccgaggaggguggaucacgaggucaggaguucaagaccagcccggccaagauggugaaaccccaucucuacuaaaaauacaaaaacuagccaggcgugguggcaggugccuguaaucccagcuacuugggaggcugaggcagggaauugcuuaaacccuuaaacccgggagguggagguugcagugagccaaguucgcaccacugcauuccagccugggcgacagaacgagacucugucucagaaaaagaaaagaaaagaauagaaaaagaauccaugggcaggcacaguggcucaugcuuauaaucccaguacucuaggaagccaaggugagaggaucaauugaggccaggaguucaaggccagccugggcaacauagcaagacuuugucucuauuaaaaauuuuaaaauuagccaggcauggugacgcacaccuguagucccaauuacuugggagccugaggcaggagaacugcuugaggcugcagugagcuaugauuagaccacugcacuccagccugagcuacacagugagaccuugugucaaaaaaguaaaaaaauaaaaauuagccaggcaugguggcacaugccuguagucccagcuacucaggaggcugaggcaagaggaugacuugagucuggaagauggagacugcagugagcuguggucaugccacugcacuccagccugggugacagagcaagacccugucucaaaaaaaaaaaaaagaaaagaaaagaaaaauaaauaaaauuuauucaaauacaaaagugaugugguuugacucuguguugccacccagaucucaucuccaauuguaauccccguguauugacggagguuccugguaggagaugauuggaucauggggaugguuuccccucugcuguucucaugauagugagugaguucucaugaaaucugguuguuugguaggugucugucacuuaccccuucuuuuucucucuccugcugccuugugaagaagguacuuccuucuccuuugccuuccaccaugauuauaaguuuccugaggccuucccagccauuuggaacuguaagucaauuaaaccucuuuccuuuauaaauuaccgagucucaggcaguuuuuuauagaagugugaaaauggucuaauacagagacuugguaccaggagugggguacugcuauaaaaaauaaccugaagauauggaagcgacucuggaacuggguaacaggcagcaauuggaacaguuuggagggcucagaagaagacaggaagaugugggaaaguuuggaauuuccuagagacuuguugaauggcuuugaccaauacacugauagugauauggacaaugaaguccaggcugagauggucucagguggagaugaggaacuuauugggaacuggaguaaacgucacucuuacauguuuuagcgaagagacuggcagcauuuuuccccugcccuagagaucuguggaacuuugaacuugagagacaugauuuagaguaucuggcagaagauauuucuaagcaccaaagcauucgagaggugaccuggcuuuuccugaaagcauacaguuauaugugcucacaaagagaugguuugaaauuggaacuuauguuuaaaggggaagcagagugcaacaaaaguuuagggaguuugcagccugaccaugugguagaaaagaaaaacccauuuucuggggagaaauucaagcuggcuggagaaauuugcauaaguaacgaggagcugaaugugaguugccaagacaaugggguaaaugucuccagggcguuucagaaaaucuucagggcagacccucacaacacaagccuggaggccuagaagggaaaaauggugugagccaggcccaggcccaggccccagcuguucugugcagccuugggacauggcacccuguguuccagccacuccagcuccagcugugguuaaaaggagccaagguacagcuggaccauugcuucagaggguacaaaucccaagcauuagcagcuuccaugugguguugggucuuugggugcacagaagacaaaaguugagcuuuggaagccgcugccuagauuucagaggauguauggaaacaccucgauguccaggcagaagucugcugcaggggcagagccuuauggagaaccucugcuagggcaaugcaggggggaaaugugggguuggagcucccacacagaguccccacuggggcacugccucauggagcugugagaaaaggaccaccauccuccagacuccagaaugguagauccaccaacagauugcacucugcgcuuagaaaagcugcaggcacucaaugccagccugugaaagcagcugcaggggcuguacccugcagagccacagagguggagcuguccaaggccaugggagcccaccccuugcauuagcauggagacaggggaucaaaggagauuuuggagaucuaagauuuaaugaaugcccugucgaguuucagacuugaauggggccugugaccccuuuguuuuggccaauuucuccuauuuggaaugggaacauauacccaaugccuguacccccauuguaucuuggaaguaacuaacuugcuuuugauuuuacagacucaggcagaagggacuugccuugucucagaugagacuuuggacuugaacuuuugaguuaauguuggaacgaauuaagacauugggguucuguugggaaggcguauuugguuuugaaaugugagaaggacaugagauuuuggaggggccagggguagaaugauaugguuugacucugugucuccacccaaaucucaucuccaauuguaauccccaugugucaagggagggaccugaugggaggugacugaaucauaggggcaguuucccccaugcuguuugcaugauagugagggaguucucaugagaucugguuuuuugguaagugucugggcuucccccuuuucccucucucuccuacugccuugugaagaagguacuugcuucuccuuugccuucugccaugauuguaaguuuccugaggucuccccagccauucagaacugugagucaauuaaaccucuuccugccuauucucaggcaguucuuuauagcaguaugaaaauggacuacuacagaaaguguguaacuuuaaacucaguaguauccaaagaaguaaugaaaauggagaaacgaacaacaaaaucauaguacaauaugguguauguacuaggacaggaagagcccuuuuaagaagagaucuauguauuuccauuuguuuaucucugaaagaaagcaacuuugccuuguauucugaaaaagaaaggaauauuuuauuuuacuuguaaaaaucuuacaaggaugcuagucuaaauauaguuuuccuaauuugccagagaauccaugaagaucgaguugauaacaagaucagugaaguaaaggucagugaguuaaucucacagcagcugcaggcuaauuccauuuccagugaaaaacgucuugauugcucaccacauaucuuuucaccacaaacaguuucagucuuaagaucacauguugcaauccaugagaaguaacuauuaagccuucaacuaugacuggagggcuccucgcccuuucugauaaauugacuggacaaaaacucaauuuuaaaaugacaagaaauagaagauguauaaauguacuuuaaaugugaccaaaauggguugugaaaacacaagacacaauauccaaaaaugcuggcaacacaguacacuguagaguauugguuguuuauuuacccuugcuauuguguggcugagcuuacugccacugcccagcauugcaagggcaucaaacugccuaucacuagccuaggaaaagaucaaaauucaaaauucuaaguacaguuucuacugaaugcuuaucacuuuugcaccauuuuaaaguaaaaaaaucaguaaguugaaccaucauauauccaagauugucuguauauaaauauuauacaucuuucucucacuuuuaaaacaaaauaauacuagccaauacuaccauucucaaaagcacuugugucaacagccuuuaccccuuaaagauuuuccucacaauuuuaaaauuguuacuuacuauuuucuuugaaauguugaccaaaccuggauuaaaagauuuggggguuuuagugacuguauuucacaaacucucuuauugauucugcagccucacuucugccuccuaaaaagcccucaccaaggucacgggggauggcucuuuucagccucuuccuggcauuugguccaguggcauuuggcauucuaggacuucccucuuugucuuugauaacucccucucuuccuguguuccuccuugcuguguucacuugcuucgcuuucuucuuucugaagcauguuuacacaguguuuucucugauugggccugugacguucuuuaggucaucuuuuccacaaauaaugcuucaacuaguacuugcgugccagugacuccacgucccacucaugagcucugaaccuaguaccagcuucugcuggacaucuacaaugggaucucucacaggccucucucauugguaacaugccccagccugaacucaucucccacccaucuauccagccaugcucucuaguucaccugaacacuugggugucauccuagaugcuuucccuucccagucuucugugaucauucugccucaucagaggcucucuaaucugucuucuuuccuauaucgcucuugucccuauuuuaauccuaaucaucuauuuccugacuuauucauuccuuaaguuggucaguaauuuaauuaaaaacagauuuaggcccugaccuuaaaugugauaagugauaugaaaggagaugacuggggaaaaggauuucccucaaggaaggccucugugaagccugaagcaagaaugaaaacgagucagacgaagagagaauuguaugaaugaaggcucugaggcaggaaaacacucagaucauuccagaaucacuuagaagccaagugaagccaguuccuggagagcagaucaucaaaugaagauggaaaggugaccaggggccagaccuguaguuuuggugggccuuggugagggauuuacaguaggacaccccaugguuuaaguaugaaagugacaagauuccuuuaaguuuuaagaggccucgaaauaugaaccacagauuagauggaagcuacucucccugugucuggacuuuuuagaauuuccaagagcugcuguuucuggaaccagauuaauacaagucagucuuccauuuauuuauuuauguauuuauuugagacagggucucacucugucacccaggcuggggugcaguggcaugaacacagcucacugcagcuugggggcucaagagauccuccugccucagccucccauguaguugggaccacaggcaccuaccacccagcuaauuuuauuuguuguagaaaugaggucucauuuugcugcccaggcuguucuugaacucuugggcucaagcgauccuccugcaacaucuucccaaagugcugggaucacucuuccauuuaacaugcuaucucaacgucaagauaaacuuuaaaaucuuuagauaauaggcuggcauuuuacuuaaacgaucuuuacuucuucagaacugccauucccuauaaauaucugguucuucaaccacaucaaaccacuugugaucucaaaaagccucagcguacacuguccuuucugucauucuaauuccuccucauccuucaaaaucaacucaaggaccagauccagggagaagcuuaguggugcccacccgaaccggcccccuccuucgaguugugcugccauucgggcccaccucuucacacaggguugucagaccagaccagcucaugcguucaccgcccuugcagggaugggaugcagcugugcaccucucagugccgacaccuggagagucucacgaaauguugacaacauggccuguuuccauuucuuguucacuaggacuucucauuuacuaacacacagaauuuccuguaguauguccacuuaaucaguucaagccuaauaauuccuugauuuggguauagugcuuugcauuuauauacugaugguccccaacuuacgaugguucgauuuaugauuuuucaacuucauggugaugugaaagugauacacauucuauagaaaccacacuuucaauuuugaauuuuggucuuuuuccaggcuaccauacucuaaagauagagccacagaucccagucagccaugugauuaugaggguaagcgaccaauacucuacaguguauuguauugccagaugguuuugcccaacuagccuaauguaaguauucuaaacauguuuaagguaggccaggcuaagcuguguugcucauucaguagguuagguauauuaaaugcauuuucaacuuaugauauuuucaauuuacaaugaguuuaucaggauguaacucuacuauaagucaaggaucaucuuguauagcacuuuuaauuuauagagucccuucaaauguuuguuuguauuuuauuuccacugcaucccugugaggauaccauaaguuauacagcuaacaaaacaguuaguuuuccugugcaaagugauggcuucaucuuguggcagauuaccuggaauacuguggccaaggcaucuuaguucuacugucuuuauauaucuaguacaguuauauuuuuauggcagcucugauuucuucuuuggcccaaggguuauuaagagagggaaaaaauuuaauuucuuaacagauauauauaucuaugucaagucauauauuuaauucaaacccuuaauauuccuagguaauuuuugucuacuuucucugucaaagauugaaagauacaggguuuuaaguuuccaacuguaauuguaguuuugguaauuguuuuauuacuaacagguauugcucuguauauuuugauguucuguuauucaauacauaagaauucauuacaguugaaucaucauguauaguauaauuuaccaauguaaaauaaccuuuuuaucaaacugaguauucaccuuauaauguccucugucagaggauuauaauaccacuuaaaaccuuuuaaaaaauauuuuguuccugauaauuuuagcuuugagugguuuucuuauaacaauucuagagaugcguuuuuauuuuuuaaccaagauuuaaagcuuugugauuuaguaagagucuaaaccauucacaguucaugcuuuuuugucaaauuucuauuauuuaguauuuuccucucuuuuauauuuuccuguuauuuuccauuucuauucuuuuguuagacuggaaauuuuuucuuugcuuucuuuuauccuagugauuugaaauuuauguaauauauacuauucuacaauacccuuuauuuguuuucaauauuugaaccuauauuuuucaacauuauuaagaauaaaauaguauuuguugcuauuuugaaaugauagaccauguuuuuaaggcagguuggugguuguuaaggcaccaguaucggccaggcacgauggcucacaccuguaaucucagcacuuucggaggccgaggugggcagaucguuugagcccagcacuuuggccgauacugugguuuacuguauuuuguucuaguuuauuuuauggaaaaugggaauucagugguuaagacaaggauuaaauagcagaagaaagauguguacauauguacagauguauguguccuuuauauguuuuuuaguacucuugucuccuuucugguccucauuuaagguuaucuauuucaugcaguaaauuuuucuucacaauucauuucauuuagagagugaaugcuaccuuccaagugggcuuucuccaguuuuccuuucagggacuuaaaggagaagugauguuaacaguuuuauauuuccauugcauuuuacagugugcagaugucuucacauauauuuccccauuugagcuuuacaaaagcccuuaguauuauucucauugucuagauuccaaaaucaggcuuagaggaguuaaauaguuguccaggaucucaagaugcaagacccacaaucaugaacagaggcagauguucaggauggaggcaagcugaaacucaaaaccaaaucauuaugacuccaaauucaggagucuuuuagcugccaccugcaugggcucuugguguagcugaccaccagaguuuguagagcugucauucaggugugccauggacuuuccugggaccuggcacaggagaaggacugaguuaauguuugcugauuaaauaucuguuacaggcugggcgcgguggcucacgaccguaaucccagcacuuugggaggccgagcagggaggaucacuugagcucacaaguuugagaccagccugggcagcauggcgaaaccccgucucuacaaaaaauuugaaaauuagcuggccauggugaugcaugccuguagucccagguacucaggaagcugaggugggaggaucacaugagcccaugagauugaagcugcagugagcugagauggugccacugcacuccagccuuggccauagagccagaccuuaucucaaaaaaaaaaaaaaaaaguuacaauaaucuucccuucaaagcuggaaggcauuauuuaccugucuguccagcagauggugcuacauaaccaagggaaucuguugcuugcccuuggugaagcuauuaaagccaauacagaucuugagaauuucaaaagcaaaaaucaauacuggauuaugagugcucuaggaaaauaaagagauaaauuuucaauuuacauacuuauauauaguuauaccauauuuguaaauaaaaauauauaaauaauuuaucaaaauuccuuuuuaacagcaacaaccacaguaaacccacagguuaaaaacuccacaacagucuauauuaaucagucaaugcaaaguacauuccaauuccaaguuaacugaaaauaaucaacuuaaucauuugguuggcucugagcagccuucacugcuugcucuugugucauguuucuuucuguccucgauuggcuauagacuuacagacggcuuuugcagaggacaguguacucauguccauccuuugcauccuuugugggaguuggcuaggcagcacucucccuggggacacuaugaacuccucuucuugagugcagagaucacgucuuguucaucuucaugcccaauaccuuguuccauaaauaugaauggauuagaauucuaaacucuuaacucugccccaagacaguucugagagguaguaagucauauaacaccugaagaggacuguucuuguccuaauuacauuagguuauaagaugacaggugagggagccaaaccagggggccuggaaauuauucauacaucucuagauacaguauacaaguuguguguauuauguguauuuacucuguaauugauugcuugagaugaacccccaaacacacucguguuuggaucauuauuaucuacccuucuccuuaaauaaucuuaauuuccuaugaugcuugaaagggaaagaggggccagguguggugguucacaccuguaaucccagcacuuugggaggcugaggugggagcaucaccugaggucuggaguucaagaccaaccugaccaacauggugaaacccugucucuacuaaaaauaaaaaaucagcugggcaugguagcacaugccuguaaucccagcuacuugggaggcugaagugggagaaucgcuugaaccugggagggggagguugcagugagccgagaucacuccauugcacuccagacugggcaacaacagugaaacuccgucucaaaaaaaaaaaaaaaaaaaaggcagaguggggaagagagcugcaugaaggagagauuuacuaaauaguacuuaaucccaaaauaauuucuauagguuugaauaugaucccugaaauuuauuauagguucagguaaguauuaaucacggguauucagaacugugguuuaaaaaauguauagaacauguuuccuuccccuugaaacuuuuuaucagcuaauuauaggaauuauauuauaccugcaaucauuaaaguccagaaugagacaguacuugguaaagugcugaaauuuauaauaaaugcauuauagcaauccaguuaaggaggaagagccaccauuauugaacauuuguuaagugucagccauuguacuagauaaauuuuaguuauuauuuuuauuuaggcaccaaaaaauccaugggauaguugguuauccccaucuuacugaagaggaaacugaagcucagaaaguuuaagcaacuugcacaggucacauagcaaguaaggagcauggccaggaaucagacccugaucuccuuuggucuacuaagcuugcaaaggaucuucccgccuccuuccaagaccauucaauauuaucaguaaauguccauggcaaggauguaguucgaguuauaggguuccauucaagauaugauugguaggugggaagcagauaugucugugucaaucaguauccuggaagaaggagaugaugaacucaaguggugauuaagggaaguuuaaugaagggacuauuuacagagauguggugggguuaagagaaccaacaaggggaagugaugcacucaaaaaguuacuaccuccaggcuuuaggggauugggggagggaguggcacagugugaacccagugugguugugagaaaagggauucccucagcagccauggccaagguuagagucuccacugccaaacugcauccagguggugagggaauggagaauaggggugggguaacaaacucugaccucgguauccccaaagggcaaaggauuccaggugguacaguucguaaagauuagccucagggcacagaacagggcagagaagaauggagaauugaucuggaggaaacaaacaauggcuugcccauguuauugcagggagaguaggcuggugugcacagcaggaggguggggagcccagcauauagcuguguuggggccugugcagaucagccucacuggcagggaggaucugagccgagaggugguggaagaugaaaucgaguaggcauguugguaguccuaaauaucaaguaaacguuccugaucuuacauugauacucaauaguaagccaauuuuguuucccauaagccaauauuaauauuacguauuucuuuuauaagccagagauauagagagauacccuagaagaaugauaggggaaaggaaggcaagggugagagaagaccuugugugaauuuguccaaaauguuuauccacaggaacaaucccuuugugaaggcugcugguaugugaaugugugccgguucccuuggggcguucauuuggaucuuucuguguuccagugaccuacggcaugaugagcuccaauguguacuacuacacccggaugaugucacagcucuuccuagacacccccguguccaaaacggagaaaacuaacuuuaaaacucugucuuccauggaagacuucuggaagguauuugcaaauaacuuugaaaguaccucucuaucacagaaaauuguucauuuggcuucaucauuucaaugcaugaguaucgacaggaccugcuuugcauuuaacacugugugagacguaaguuauggugaguuguuagaaguuacuguuccuacucucaaaggggguaaacuaacauugagaacuuugccugugccuugcacugugcugaguguuucauaucuuaccuuauuuaauuucuauagucuaacucuauaagguaaguacuaagacuaugcccuaguuuguuaaugaggaaaaugagauucaggauguuuaaaugcguauggucacauggcuagggaacaagaaaaauugauuuuuuucuagccugacagcuacuucauccuaguuuguaauucauuccaugagucaagauucaauaaauauuuauugagaaucuccuagaauguaaggccaaugaagggcagugugguucuucugucuugcuucgccuuuuguguuuugucucuuuguugaugauggcauguauccccagcucuuagaacagugcuugauucaaaguaagcacauucuuucaaaggucugcuguugguggggcuugguggcucacgccuguaaucccagcacuuugggaggccaaggcaggaggauugcuuuagcccaggauuuugaaaccagcugggcacaacauaguaugacuuugucucuccaaaaaaguuaaagaauuagcaggguguggugguacacaccugcagucccagcuacucaggaggcugaggugggagaaucacuugagcgauugcuugaggucaaggcugcagugagccauggccaugcuacugcauuccagcuggggcaacagagugagacccuuucucaaaaaaaaucccccccaaaaaaaaacccaaaaacaaacaaaaaaggucugcuguugugaaguucaacccaauccagccccuucccaaguugucacaaauuccaacguaguuaacaguauaccaaugagugauaccacaggaaaaauauuaaacugaucugagggauauggggcuuggaaucuaagaaaauuggaagggaaauugaaaaggaaauuauuauuucuccuuggggagauaguuucuaaaauucuuacuacacccuggggucagagcuguugauuuuaaggauagagacaacugagucacaggaaacuauucauauauaaaaguaccuggcauccaaaaccacacuuguauaauaugaaucuuucaccaucugaguagggcaaaucagucuaucucuguugaucaucugacaaggauagcacacugagaaauagaucugucuucccuacaggcauagcuaguuguacaaacuaacaagagacuuuuguauacacauuccaugaugauaaaugccaaucacuaaagggacgaggagggauuggagaguucaccauacagcaaaauaguccagacaggugaaaggucuaucaaaugccaggcugguaaucaaaacuguagccuuuucucuaaacaaaguuuagaaccaugauugugugggacauuauuuuaauaagggaaagugcaguuaaucaugaccccaccuuuaguccaagaacaaaaaucagagcugccacguauuaaguacccacucugugccaggugcaguaacuaugcaaaagauggguuuuccagaugcaagaaccuugguucagaggacccugcucaaggccucauagcuaacaaaugauggggcaagaugcuaucccaaaucucucugacaacaaaacucauucuuaucacucuacuauuuucauagaguugccaaaugcuugguuaugcaaacgaugcaggcaggggcaagacagcggcugagcuuggaacuuuuucagagauguuuccuuugcuuuuaguucacagaaggcuccuuauuggaugggcuguacuggaagaugcagcccagcaaccagacugaagcugacaaccgaaguuucaucuucuaugagaaccugcuguuagggguuccacgaauacggcaacuccgagucagaaauggauccugcucuaucccccaggacuugagagaugaaauuaaagagugcuaugaugucuacucugucaguagugaagauagggcucccuuugggccccgaaauggaaccgcguaagugucugugacucauugccacucggugauauucauucauuuauucucugaacucccaccauucauucauucauucccugacaccuucaccaaggcaaaaauaaguucagugacucuucagugcuuauauuuaaaccuuggccaacuugaccuuugacuucuuaaguuuucacuacuucuuagccuucuuuuaguuucuacaugcauauuuuucagaagacuaaaucguugaccauauaaccccucaaaaauuaauuaucugagcguuugaaaauuucauuuaagaugcccugggcccuguuuuuacaggugcaguaacaucauccacuaaguuauuuaacacaaguuuucugguucaggaacucuuuuuauaggucuugcaaacagguuuuuguucagaauggaguuauuuaauguguaagcuugugaggcaauuuuuuguuagguuuaaagcccauuuuguucaaauguuugagauuuuagguauauauuuguacacgugcauauuuacaggggcuuuuuguacacuuugguacuccuacuucaaacaucuuguguauuaagggaggucacuuacuauuuuagaaguauuguaguuauuauaaagaaacaagaagaccuccaaggccguuucagggugggccuuugcgguugcugucccuggguacgucacuggucggagucaucuucuaagcuuugcucagcuaauucugucgguucaucuagguucuuuucuuggaaacugaguugcccagaauccacauuuguuacuauacaaugggcaaucaccuuuucaauuaguauauucuucuuguaccuuccaguauacacucuauuuaauaccagaacccauaagaaacaaauuuaguaaaaauccagguugggcacaguuucucaugccuguaaucccagcacuuuggaaagccaaggcggacagaucacuugaggucaggaguucaagaccagccuagccaacauggugaaacccugacucuacuaaaaauacaaaaauuagcuggguguggugacaugugccuauagucacagcuauucgggaggcugaggcaggagaauugcuugagcccgagugguggggguugcagugagcugaggucucaucauugcacuccagccugggcaacagagcaagacucccccucaaaaaaaaaaaaaaacaaauuuagugaaaauccagagcuuuagaacaaaggaacuaaauagucucaaaggacauuaucauccaaguuaugauagugauuucgcuuucuuuaaaaaaaaaauuauuacagauagaguuucuugauguugcccaggcuggccucaaacuccugggcucaagcaguccuccagccucagccucccaaguagcugggacuaugagaauaugccaccaugcccagcuuuauuuugcuuucuaaugugccuuuuuguaguuccugcaaagcauaagcaugccuucaucugugguacccuuuccaauauuuuauuuaucucacaucacuaauaagauaaauuuauacagccacugcucugugccagacauuauuuaagaaguuauuucacgcauuaucucaucugccuucacaaaacaacucuaaaauagguaucaccuccauuuuauagaugaaaaaacugaggcucacuugcccaaagugucacagcuaacaaauuggacugaaccaagauuuaagcagccugacuccaaaacccauguuucgccuacuaaaccucuuccauauuaauuccuccuccauauuaauugcgucguuaggguggcuugucgacgcucucagcuccccaucaguacucaagcuuccugagggcagggauucuauuuuguuaacugcuguauucucaaagccuugaacaaugccucauauguaaagauacuaauaaauaugugcuggaugcauucgagugauuucuacuccaggguggauugccaaaggggaccuucccugucauaucuaaacuauccuuuuauucuucuacauucucaagucacucccauuucuucuucccuucaacuccaaacuucuuggaagaauagucuucauuugccacuuccauuuccuuaccaucaauucacgucuuaaagcuuagguucuugcuuuugacaucucaccaggaagcuacuagggaccucuaguuagcaaauccacugaacaaaucucaguuuuuauccccuucauacugucugcagaaaguggcaguguugaccgcucauucuuuugacuuccaugaagaacucuacacuuuggguucuuuuaacucugaaaccccuuucucucacuucucuuauucccagguucuauauucauaucuccgucuuuucuuucuuuucucucuuucccaugacauucagauggcuuccacugacaucuuuauuuggugacucaucauuucuucaacaaugugccaggcauguucccauugcuagaaguccccccucuucuaguagugcccuugaugcuggagaaacaaagcagcaggaaacagaagaaacguccuuucuucacagagcuugcauucuagugauacaagacacaucucuauuccaccuggaugucccacaccucuugugauuuaauaugccccaaacuaaacucaucguuuucuuaugagaucugcucuuuguucuguuaauggcacugccgucuuccuauugcccugaaagagacuccagagucauuuuugagccauguuuccuccuugccccaacuuccaaaucaguuaccaaguucugcuggcagucacugugguuacgacacucucucacuccuuccuuucccuucccaucuucacugagugacuucaggccucauuaccucuugguuauugcagacuuugcuaagggagcugugucaggggucccuaagaccacccccagguucagugauucacuagaaggacucagcauagaggcauccuuacagcuaagguuuauuauggugaaaggauacaaaagaaaaggcacauggcaauaucuggggaaaaccugguguaggcuuccaggagcccucucccagugaggucacauaggaugugcugaauuucuccaggaacgaguuguagcaacaugugugaaaugucuaucagagagauuaauuagagacucagugccugggguguucacuggguacugguacugguuuaugacuagcaugugccaaaauucccgacucucagaaggaaagcagguguugaguguaagccacauugcuuauacaaauagcacaggcacagcaagccucucuuaccggucagggaaaguugaauacuggugcagggagcuguuuaucagucaaguucccagaugccagccaaaguccaaccuugcaaacaggccuuccuaaagaaaggccaucucaggccugcuguguuaacucuuuucugcacaugagcccucuguuccuccccacuccagucuucccugcugccaccagaccagcccuguugugugccucuuagaacuuucccuucacagacuccuucauguuugcccuucacaagcugaccacagaccaccuuucaaucugccauucuuuaucuuaugggagccaaacugaacuacuucuucucuugaccaauggcucacgguugaaaaugcccuucccauuuguauuagucuggucucaugcugcugauaaagacauaccugagacugggcaauuuaccaaagaaagagguuuaauggacuuacaguuccacauggcuggggaggccucacaaucaugguggaaggcgaggagcaagucacgucuuacguggauggcagcaggcaaagagagagagcuugugcagggaaaaucccacuuauaaaaccaucagaucucgugagacuuacucacuaucaugagaccagcaugggaaagaccugcccccaugauucaauuaccuccuaccggguuucuccaacaaaacaugggaauugugggaguuacaauucaagaugaguuugguuggggacacagccaacccauaugaccauucaccugugcaaguccagauccuacucaccuuucaugguucagguccaacacagcuucuuccuaaagccuuuucuaauccaucccuccacugccagauccccaaauaaggacagcuuuccucugaucugccagccuuauuucuuuucucuuuugcuucuuauuauuauccaccuuguauuuuacuuguuuaauuauaacucuuauuucccuacuuguuauaaauuugggagggaaaggaccuuuauauccccauuagugcugaagaagcaucuguuuucuaagagauccucugaauauuuguggaugaaauucccaaaugcugacaaugccacuugaugaacuugucccucuuuuggcuguaauuuucucuggggaccucaagucgucuagucccugagcacaguuacccagagaaggcagccguauaaacugagcagaggcucuagagcagagcagaggcucuagggacaaacagcccuggcauugguucccgagucugcccucaaaagcuuugggacuacauugaccucacuaagccucagggcccucauuccuaaagaggcuaauaacaguaugagaauuaaccaagaaaacaugaacugccaggucaggcacaguacccagcuugauaggccuuaauacauacuuuauuuuacaaggaaccagcuguccuuguaauugccucaaguguuccacugauuguaacuguuuguuuuuugguuuuguuuuuaaucaguuggaucuacacaagugaaaaagacuugaaugguaguagccacuggggaaucauugcaacuuauaguggagcuggcuauuaucuggauuugucaagaacaagagaggaaacagcugcacaaguugcuagccucaagaaaaaugucuggcuggaccgaggaaccagggcaacuuuuauugacuucucaguguacaacgccaacauuaaccuguucuguguggucagguguguacugaggacaugcaucccuccuauuucugugugguuguacauacauccuauucugggguuagccagaaaaaccuuugccugcaguuagcuacaugaggaugccaaggacccagacggauagcaagggagggguaaaaacugaaggcuuaccgaaauaaaggauauuugaggaagggaguugggauccuagaauauuacgaguuggaaagaaccauaacucugguccaaguucaucucaaugcuggaaccuuuccagaaaaaguauuguguuuuucuaacaucugucuuuacccauuauaaggaugguuagugccacauguuccaucaccaagucccccggccaucaaaucuugacucauuuccuggaguuucucacucucagaugagccucugcuauuagcacacaagcacaguaaccggagugcuuguaggaugcucaguaggauacccagguuaccugcucgugcucagggcuaccaaaggcacguaaaguuccuuccacagauccugggauguugccaugaugaccccucugugagauaguaacaaaaaugacaaagauuccacuggcuugucugggacucuucuucauucauuuauucagcaaacauucauuggacacuuaauaugggcuaggcauuguucucggcucuugggacaugucagcaaacaaaauaaagauccgcaccuuggcagagcuugcauccaaccaggaggagacuagagaauaaacauuaaacaauacaaauaaauaguauaguauauuagaagguaauagguacuauuaaaaagaaagaaaaagcagagcaagaggaagucagaguucacccacuuuaaucuuccuggugagcaugucagcaacacccaaacaucacuaacauggauuauugcauguauauuuacacauaagauaagaaguguuuauucucauaauagucuuugucaucauucuugagguuaaguucaauucugcuuuauguggcuuguuggauugucccaguccuuguauuuaacaacauuugcagaaaauaguaccacauuaaaucaauuauagauuaucccuuauccaaaaugcuuaagaccagaauguuugagauuuaagaaauuuuucagguuuuggaaugucugcauauauauaaugagauaucuuggggaugggacccaagucuaaacacaaaauucauuuauguuucauaaaugaaacuuaaugcacauagccugaaggaaauuuuauuuuucccuuagggauguugaaucaacuguugugugccagcauguugacaaugaccugucacaugaagucggguguggaauuuuccacuugugcguucauggcggugcucagaaaguuugggauuuugaagcauuuuauauuucagauuuucacauuagaaauacucaagcuguccuugcucacaguggccaaaaaaaaagaaagaaagaaaagaaauacucaaccaguaguccaguaguaguuaucacuagaaaugaaugaaaaucuauugcaguauuauugaguuuuuccuaauuauuccagugcagauaaaaagaaaagaauaaaaaggaagagaauaaaaacagagaggcaacucugauauuuuaguaaauucuauuuauagaaggucuugaguauuucuucugcuuccucccuuacuuuaaggaugaacauuguuaagacaacugcuucauuucucuauacuguuuuucuaaguuucuggaagugguugacuacugcagggccagaaugggccagagaaaugacuugacacuugaaggccacuuccuucccuuuugaguucccaaugaagcugucacauacaaggcucuuggcuucagaguugcucuccugaguuuuugauucucaccccuacucucuaacacaucaaauaggaaagaaagaacaggagaacugacaaugaaaaggaaggaaaauuuucacacuucucugaccaguucuaauuuaccauaguccuguuuuuacuugauuauugcucaugcauguguccuguaugcucagguuccaggugcggcuaccuguccuguaauggcagagauagugauggcuaguagcugacuaaagggcuuuuaaaugucucaaaaugaagcagcuagagauucuauuucuaguuagaaaagaagucuguaucauuaacugaaucacccagcuuucucagugugacaccuacaaaaugggcauuugacaagaaaaaaacccucaguccaguuaugguaaagcaguaaagaucagagccaucaguauggauguaaaauaguguauguuuuagacaaucagacaucuauugaguacccaccuauuaacuauaaggcucugggaagaagagagaaaacuacccuggaggacaaacuauuugaugcuauuuagguguuacauaaugaaugaaugacucaguuccuaucuuuauauauguacaaaauauauccuacuucucaaccagauuacacauguuuugaguggaugguuuauauuucuuuauauucuucauguugccuaguagaaggacuugaauuuaauagaaguccuagggccaggcaugguggcuccuuccuguaauuccagcacucugaaaggcccaggcaggaggaucauuugagcccaggaguuugagaccaaccugggcaaaagggcaagacucagucucugccaaaaaaaaaaaaauuaguugggcauggugcugcacacuuacauucccagcuacucaggaggcuaaggcaggagaaucccuugagcccuggaauuugaggcagcagugagcuaugauugcaacacugcacuccagccugggcaacaaagcgagucccugucucuuaaaaaaauaauaacagaaguccuagaaaaguuuguguguugauuuacuuuuacauuaaaaguauauggcauguugagcagcguaaauauagaaaaguguagggaagacugagcaggaaguacuccuuugggacugaaagaccucaggaagucuuauuccuuugauggcacaaaauucuccaaguauggaauuauuagcuaugauaaaaauguuuugccgcuaguuuggggggacucaugguagcaguuucauuaccuuguaaugcaugaacagaacagauggacauccauuccuggcuguauucauguguuguuguuguuauuguuuuaauuguucuuauuuacaugcagguuauugguugaauucccagcaacagguggugugauuccaucuuggcaauuucagccuuuaaagcugauccgauaugucacaacuuuugauuucuuccuggcagccugugagauuaucuuuuguuucuuuaucuuuuacuaugugguggaagagauauuggaaauucgcauucacaaacuacacuauuucaggaguuucuggaauugucuggauguugugaucguugugguagguuugagaacaacaccaaauuuccuauucuauucuacaagcauguuaacuagagucuuugaucuccucagcauuguggaucuugauauucccaaaaaagaaucuaaaagucccccucaauuauaucaacuucuguuacuaauuauuuucucauuuugcaugaguaacuuugcugaguaugaaguggagagguauuuacaguaugcucucagccacgcuaauaacaagaguaucucaguaauucauauuuggcuuuaguaugccguaugagauguggaggagaaaacaguuuuuuuucuuuguuuuuuuuuccacuaaugauauuuuucuucaacugcugguaaaaaucaauuuauauuuuccugcacaugugugaaguuacagcaauaaaaaaacuugucggccaggugugguagcucaugccuguaaucccagcacuuggggaggccaaggcaggaggaucacuuaagccccagaguucaagcccagccaggguaacauagugagacccugucuuuacaaaaaaaaaaaaauuuaauuagucaggcaugguggcacacaccuguagucucagcuauuccagaggccgaagugggaggaucauuugagcccaggaggcugaggcugcagugagcuauaaaugcaccacugcacugcagccugggugacagagugagaccuugccucaaaaagaaaagaaaaaagaaaaaucauccugaaaauauuuugugcggcagagaaaacuuucugcaguuuaaaauuuucugcaaauagucugcagaguacaaauguaaguuauauucaucaaaguuuucuguaugagguauaagaaaucaaaggcaggccaugcacaguggcucauaccuauaaucccugcacuuuagggaacugaggugggaggaucacuugagaucaggaguuugauaccagccugggcaacauagugagaccccaucucuaaaaaauaaaaauaaaaaauaaaucaaaggcagagucauaaucaagaccaugacaccauguaaauucugugucugcucuugacucuauuauaacuucuaagauuuuuuucaagauguuuucccuucauccuuaucacuuaauuaagcauccgucacuuccuuccugugguuucaguguauaaaagaauuuuuacaagcuuuucucccuucagcaauaacagguaacauuucgcuaaguccaguuguacauuuaagcauauaacaacaugcuuaauuauuagaugcuuacaagcuuugcuuggcauagguguaccauguauuauucuaugucuuuccuucccacuguccuaugauagccauuaccuucugaaaucucaguaaaugaugcacuacccuauuagcauucucucuucuguuagcccuccuuaugagaguuauucuuucccucaucccacuccuaaaaauucauuuggccuuuguggaguauuuagaucaagucauuauuaaacuauuccccacuagaauuauuaauaguugauaaaauauggaaaauauauuauucauaugugagugaaagaacacuuaaagcauaaaaaagaacuacauggccauauauugcauggcaauaacuauauuagcagcaauaauaauuguaauaguaauaauaauaauggcuaacacuuuagaagcuucuguguuaggcauuuccgggugcuuuucaugguacagaagcucauuuguuccucauacuaacccucuucacuacucugccacugccucucaagccauggauaugugcacuuuagaguuuuuacuuaaaguaaaaauuccuguagaauagaugguguugaccccaucagaccgugaugcaguuagaagugcaucccgucuuuuacgauggccauacaacaucacacaaaucaagguaaacccuugauccccaaauucucaauguauuaauaaugaacagaguuacacaagaauuuuagcauuuaaggaaacaggagagacgauaauacuggaaauaauuuuucagaauauuucuguucggauugauggcagagugcaggccauauacauugacaauuauuccagaacacaauuauuguuuggagcuaaaaggaugcaaacccugccucuuggcuuauauggauuuauuuauguuuaggccauugaaauaaugguagaaagguaaguaugauaugcuaauuaagaacagacuuccuuuuuauauuuuaaccaaagaacucaauaucaacaaaagacuagucagugguauucacccuuuuugaucauacacaccuaucagugaaagcuuugacuacuacacacccuaauuuauuaucuuuauuuguaaauugugugccuacuuugguguaacagguacauccguaaaacauacacauacauagaauuuuaaagauuggaauaaaaguuaauacaaauagaauuccaaaacuuucuuaccaccuaccuagaaguuguaacauuuucuucccauagcccagugaauugccuugcaccugcuuuggcgaccaauaggaagaaaggcaaugauaucauggaaauugucucuuuggcucaacagccacagcauuuugcaaguguuucuuugaaaacuugcuucacuguguuuuucaauuuuuuuuuuaaacaacacuuaauacugccagacaacaauucagacagugugcuuuuuguuuauaaagaacaaggaagggcuacuggaaucucacuuguccuuugaaacuuuugcugaccaaguguagaagugagggcaugccuucugcucacccacaaaacacacccugugcuccacuggaccuucaaaccaguggaaagacccaacgcuuuuuguuuuaucuagccaaaauuugcuuaugcuuacccaaaaccugaaaagaaauuauauucuuaauauaaauacaaucacaucuugaaaucacuuugaaauuuucuuuauuuuccuuuuuucuuuccccaacauauguucugaaguacacaggcugcaucagucagccauuuguccugagcaauagucuuucaaaacuagaagaauuacuugaaaaaaagaagacuauuaaggaauuuaaacucaaauaauuuauugaccacuugcuagguuguacaggguaaauuuuuuuuuuuuuuuuuuuuuuugagauggagucuugcucugucacccagacuggaguacaguggcaccaucucggcucacugcaagcucugccucccggguucacgccauucucccuccucagccuccugaguagcugggacuacaggugccugccaccaugcccagcuaauuuuuuguauuuuuaguagagacaggguuucaccgaguuagccaggauggucucgaucuccugaccucgugauccgcccaccucagccucccaaagugcugggauuacaggcgugaaccaccgcgccuggcccgacuaauucauuuauucagcgaguguuuucugagcaccuacuauguacuugccacuguucuaggcacuggggauacaggaaugaacaaaaucacccaaaucucugcccucccaauuuucugguauggagagaaaguucuuuuguagauagggaugagaaucccacagaaaacucaggagugauguaacaaugcaaaugcucacaaaaucucuuuccucaucuuucauucccuauuuggaaggaaagguuucaaagacauugauguuguauaaaugaccaucuucuucauuauuuuauaaacauuuguccugugcagaguaaaaacaacuggacugcauaacaaauuauaccuauugagaguuggguaaagaguuaccauuggauccaguccaccaacccaaauguuuuucuacauguauuagcugagaugagcuccucaucucaggagaagccuauucccacugcaggccuucuugagucugcuguguucaucauucccaccaccaacacaaaaauacaagauuggcucuggaaauccuucacagagaaggaaggaaaggaagauggugagguuggcuuuuuagcugugaucagcaaccaagcuggucuuugcuaugagaaucagugggaccaugaucucuauggucaucucaggaagggagggcuaaugaaguggucucuggccaugauuccuaagaagagagaauggacagcaaagaucgcagcaccugccacagcccaccugcugcagauucagacccccugguggggccagguuguuaugacuaaccccuagcacugucuacauuuaguggugauggaugccaaggagggggcaguguccccuuggaucugauuguaaagcuuagaaccaaagcauauguggaaaguuguagggucaugaguuaagggacagaaaugagcaagagagaagcccuuggcucauauauucccacugcaggccuucuugagcccucuguauucaucauucccacugucuuucaagcccaagcucaugcuuuguucucaugggcacucauuuuuaggauaucuuuugucccucuugacuuuauguugugugauaccaacucuuuaguaguuuuuuguauuauuuaacuucauguguuuaucugcucuugagucucgagggcaggauuuaugcaguuuacuucuguuuauuccucuuagcccuugcacagugcuguauacauagacaucuacuauauuuuuguuaaacagagcaaagaauggcuggcaauuggagaaugcagagaaaccgaaaaauuuuaaauuuaaaaaucacaaauaaaaacagcaggaugaaggcaagaaagcaaaaggguggaaagugauuaaaaugaagguggcagaaaaaacagaaagcauuccucuuugaguuugagucuguuauagugugaucucuucuguguaugcauguauguguguguaauguauaugugcacacacaugcaugcaugccuucguugaguuucuauuccgaacuaaggaaaugcaagcaauauacuguuuuacuuauuuuauggcagggcuuaacacuuuccauuugagugagugacuuuuaagaaugacaucggguaaguauaauggugagcccuuauaauuaauacauuggugaagaaaaauauacuagucauauuaagguaaguuucauauuucuaaaacacuguaauaaaauauaaauauuuugcuuuucagcugucagugguagcuauaggaauuaacauauacagaacaucaaauguggaggugcuacuacaguuucuggaagaucaaaauacuuuccccaacuuugagcaucuggcauauuggcagauacaguucaacaauauagcugcugucacaguauuuuuugucuggauuaagguaauuuauaaauuucauguucuacauuuuaaauaauauuuucuuuaaaaaaaaugaguuccacaaaaucauggaauacuugaauuugaaauucaagugaccagccaaagcugcucaauauuuacuuugagacagggucucacucugucacccaggcuggagugcagugguaugauuacagcucauugcagccucgacuucccaggcccaagcgauccucccaccuuauccuccgaagucacugggacuacaggcaugugccaccauacccggcuaauuuuuaaauuuuuucguagagacaaggucucauuauguugcccaggcugguuuugaacuccuggguucaagcaauccucccaccucagccucccaaagugcugggauuacaggcaugagccaccgugccaggccucauauuuuacauauaaaguaaacuauugagacucaugugaucauuccucucacugucaaugacauacuucugcuaucugaauuagugcaagaucagucccuauagguuuuguuuaacaaaugcaguaagaggccuuucaguguguuagcugggccuggggccccaggcugcuaacagaugagaugaacaggugaaggaaaaggaacuuagagaaagagagggaaggagcagguggagggaaggggagaguugcugcacuuggaaaugcuugcuagaagggaucgccucuuuuccagguagaggcuguaagggaagcuuuaccuagaauuaagguuggaacagacacugcuuccaaauaguuccuugcucacuauuuuccuuauugucccaagauauaaugugcauuuccaugugugugaaagguuaugacauuucauauacaacaagccucaauucuggagaugcaggaaauuucaauaauucucaggcagcagcugccauucggucaccagcacaggcucugauugugcuguccagacaguaaguacuagccacaugugccuauuuaaauucaaauuuaaauuaguuaagcuuaaauacaauuaaaaacgcaguuccuugguccuacuggccacacauuaaguguucaauggcuacugucuaggacaguggaaauguagaacauuuccaucaucacagaacguucucuugaaaagcacuguucuggaagguacuuacccguuauguacuuuucugaguugguauucauaccuagaagaccugagguuuaucacaagacauagacuuggaccaggcgcaguggcucaugccuguaauuccagcauuuugggaggccgagauagguccccugagcccaggagucugauaccagccugggcaacauggcaaaaccucaucucuacuaaaaauacaaaaauuagcugggggugguggcacgugccuguaguccuagcuacuuaggaggcuuaggcgggaggauugcuugaauccagaaggcggagggugcagugagccaagaucgcaccgcugcacuccagccugggcaacagagugagacccugucucaaaaaaaaaaaaaaaaugcauagacuuuauccuguauuucucaugcuauuuauuuauugacaugcuuguucaagagaaaccaucacuaaagcacaaaaccuugaucauaacauaguaauaauaaucaaacagcaaaaauaauaauaguaauaagaauguucuguggugauggaaauguucuauauuuucauuguccuagacaguagccacuaaccauguauaggcauggaacacuuaacauguggcuaguaggaccaagggacugaauuuuuaauuguauuuaaucuuacuuaauuuaaauuugaauuuagauauccacacauguuuggauagcacagucagagccugugcuggugaaaggauggcaggugcugccugagaauuacugaaguuuccuugauuauuauuaguuuaauaauaauaaucaagauaguaauaauaaucaagauaguaauaauaaucaagaucucagcugggcacaguggcucacgcacuuugggaggcugaggcgggcagaucaccugacgucggguuugagaccagccuggccaacauggugaaacccugucccuacuaaaaauacaaaaaaaaaaaauuagcugggugugguggcacgugccuaugaucccagcuacuugggaaucugaggcaggagaauugcuugaacccaggaagcagagguugcggugagcugaaucaugccacugcacuccagccugggcaacagagcagcacuucgucucaaaaaaaaaaaaaaaagaucucaaaugaauugggauuguauuaaguaaugauuaaguaaugugauuacagcaauccucaagaaauauuucacuguggccaguaacaauguguaacagaccuuuaaacuucuagagauuuuccuacaacaugugucucaggcugauguguuuuauuuagugcuucucuuggaaaugucuugccccucgauacuuuaucauuaaggucuuuaaggcagggaucaugacucuacuuuuuuuuuuuuuuuuuuuuuugggacggagucuugcucugucgcccaggcuggagugcaguggcacaaucuuagcucacugcaaccuccgucuccuggguucacgccauucuccugccucagccucccgaguagcugggacuacaggcggcugccaccacgcccggcuaauuuuuuauauuuuuaguagagacgggguuucaccguguuagccaggauggucucgaucuccugaccucgugauccacccaccucggccucccaaagugcugggauuacaggcuugagccaccacgcccggccucaugacucuacuucuaauaucucaucaugugcucuuccacugaggcuucuacuuagagcuacacaaucugggcagccauccucagugccuuaucuaccaacaugcucaauauggcuuugcaggguucacugucuaccagcaggguucacuaucuaccaacaugcucaauauuucuuugcagucaggcagagcaggcuuugcaguucaggcagggcagcuggcugcaggccccagcugacuccuggggauagaaugccaauauuucagacauugcagagauuugaggcaauguacauaaagcccuccacauauaacugaugcacaauaaaugacaguuaauauuaugcaacaagaauuuccugggggguuuuauaauuaauuuuuauuugugugaaguuuuuucccucccuuuuacuuuaauccuuuuuggggggaaagcaucacuagucacaguucacggcagccucgaccucccaggcucaagcaacccucccaccucagccuccugaguagcugaaaccacaggugugugccaccacaccugacuaauuuauuuuuauuuucuaaugaaacagaaucuugccauauugcccaggcugaucuuaaacucaugggcucaagcgauccuccugccucagucuuccaaagugccgggauuauagaugugagccacugcacucagccuuuuuuuuuuuuuuuuuaauuguagauagcauaaaaccuacuguuuuaaccaugcuuaaguguacaauucaguggcauuaaguacauucacaguguugugcagccaucgccauuaugcugcauuauuuucagaacuuuuucauuauucuaaacugaaacuuuguauccauugaacacuaacucccaauucccccagucccugguaaccuccauucuacuuucugucacugugaguuugacuauucuaaguaccuaauuuaaguggaaucauacaguauuuguccuuuugugucaggcuuauuucacuuugcaugauguuuucaagguucauccauguuguaaccugucagaauuuaauuucuuuucaggaugaaauaauguuuuauuauauacagucacaccauuuuguuuauccauucaucuauugaugucuucucucucuuacagcucuucaaauucaucaauuuuaacaggaccaugagccagcucucgacaaccaugucucgaugugccaaagaccuguuuggcuuugcuauuauguucuucauuauuuuccuagcguaugcucaguuggcauaccuugucuuuggcacucaggucgaugacuucaguacuuuccaagaguguauguaaguauauaugaaauuaagaagaaaaauuuaaucagaguugucacugcuucucaagaauaaaucuucauaugagguugcuauaugaccaccaauuauuuaaaaccaguuauuuuaaguaagaauuaauuaccuuuucccaaaacauugaucuacccaugcaaagaagacaaugcauccugaaaugcugaugcuuaagauagcagcccaaaguaguaaaauacaguuaacagacauaggaaaccaacacuguucugaagacugaguuuuucuuugcaccaaaugcagaugguagcuucuagaaggcuguuugccuauauucuuacuccuguugaauauuguugccauauauuuagaacuucaaguuauuuucuaaggaaaaaaacaagauauuucuaauauucuaagguaaacucagaccaguacaagaauuuucaguuuuuuuuuccaaagaucccaaaugugaaauaaaacaacaaaaagcagccagugucagauuucuaugccauuuagaaaggaguuaguuuaaaaaggaauggaaguaauaggguuuugugcauagauaucucgaauuaauauugcuguugauaaaagugauuuugcuaagacccagcacugacaacacuuggccacuuugaucccauuuuaaguacuugucagaauauuggaucuuugaacucaaaccauuuuggguuuuugggguuuuuuuguuuuguuuuuuuuuguuuuguuuuguuuuugaggcacggucuugcucuguugcccaggcuggagugcaguggugcaaucauagcucacugcagccuugaacuccuaggcucaagcaauccugcugccucagccugcugaguagcugggacuacaaguguaugccaccaugccuggccaauuuuuaacuuuuuuuaugagaagggaucucacuguguagcccagggugguauugaacuccagggccucacacuguccucucaccucagcuuccaaaaguacugggauuacaggcaugagccaccacaccaggcccuguuguuuuuuuuuuaaagaaauuuuuaacuuuagaccgagggugacuguugucaagguuuaggguuaagauguuuuaccuagauuauguguugaaauguuauagccaauugcuuuauaaguuauugaauaauaauuguauuuucuuuuuuuuuuuuuuuuugagauggagucucguuccaucgcccaagcuagagugcagcgguguaaucucagcucacugcaaccucugccucccggguucaagcgauucuccugccucagccucccgaauagcugagauuaugggcgcacgccaccaagcccagcuaauuuuuguauuuuuaguagagacgggguuucacuauauuggccaggcuguucucgaacuccugaccucgugauccgcccgccucggccucccaaagugcugggauuacagacgugauccaccgugcccagcuuguguuuucuuuuuaaccaaauggaaauaaccucuguagcaugaaagcauuuuauuauuauugcagaaggcuuuaauugcugauacaaguagcaagacuuuguaaaugggauugacaauuuucuguuauucggcagcuaccuauacugcuaaaagguccaaaaauaaugaaaucaucuuuaagaaauguugcaucaacuaguggacauucuuuguuuuuguauugugguguuuuguuuuauuuuuauagcuucacucaauuccguaucauuuugggcgauaucaacuuugcagagauugaggaagcuaaucgaguuuugggaccaauuuauuucacuacauuuguguucuuuauguucuucauucuuuugguauguacauuuuuauuuauagugagguucaauuuaaacuucguaaauccuugucuucucuuuucucucacacuuuauguccuaucaauuuuaaauaaagacccaggaaguagaaaaaaguguggauguuggaaaacuuauuuuccuuuuauuaauucacaguuuugagacucauaucaaaugucuuuucuguggucuuucauugauccauguauaugugucuauucaaugcaaaaaaaauuagaucucuuccauggucuuucauuucucucucuauauauguaucuauuccaugcaaaaaagaaauuagaucaaguacaaauuuauaaagauaccuaaaauagugcuuugccuaaaaaguagaauaugcuuacaugcuuuuuaaacucauaugucagcacuuucguagucacuugcuagcaugacuuuucucucuuucuucuuuucuuuuuaaaaaauaagaacggaaaagcaagcuagaucuaagaugucgaguaauaguugagugaaucauugcaugucaaaauuaggauauucuguuuuaaauuauuuauaucccauucaucuagagacugccuacagagaauauucaaauaauuaaguuuaaaacuaaauguaacaaugaauggaaauugcauuaaaauuauuuucaaaaauaauuuuuuuauucucuugauuugguacaaaugaacauuuuuaauguuuuugcccuaagucaauuaaguuuuuuuaagguguuuuguucuuuuucuuaacauuuauauauucaauugucuacugagaagguguuaagccagcuuaauuuaggcaauauuuuucaucuaaacacuaacagucaucuuaagaacaauuuucuuaagaaaauaacauuuuuuccauuucaguaaauuguguaaagaucccuugaggaagguuaagugaucacauuuucaguaauucaguguaauaacucuaaagucaguccagguauuacugguuaaguauaugguauuuauugauuggguauuagauguacuguauuaauuuccuguuuaaaaaaaauuuuuuuuccggggagacacagccucugguguaaaacaaagguguguucccuagcuguacuuuaacaggacugaaaaggucaggaauaucauucaaguucauauguaucuugcuguaugcaugguuuauggcucauuuuuaaacuuacaccucuuaagcuucuucuuccuaucauauauuaaaacaauggagagaagaauaagccucuguuacucuaccauugauaguacuucggauucuagaguaccugaaucucuacuaagaaggcaaaaaccaggaauugagaguccugcaccugacccuucaguugaucucaggccaccuaguuuucuccguuuaucaaucugccaaacaaggauggauagagucguggcaacuggaaaggcucaaauguggaauuguuugaaugugguccuuuaguaggcagccaucuuaccagaucuagaguauucagucaucuuaccagaucagucaccagaacaugaaaagaagcucuuaguuucuaucuuuauacuaaaauuguuuuuuuguacgacugcacaaaaaagaauugcucuccuugcaccucccagagauauagguggauagauacauacauacguacauacauacauacauacauacauacauacauacauagacacauacauagauagaagucuacuuucaauacaaaccugucuuuuaaggaaaugacaagcugagcauaggguuggccaccuuucugagccgauugccugguauuaguuuauugccccuguuuagcaagaaggcacaguguuaagaaguggcucagcugaaccaggauaaccccacucuucccccacaucaacaggaaagacauccuggugcagauguccaucugauaauucagggaaccucgggagacaggauggagaggagggugagcuagcuuccucuucccacaccuucaagagccuuucucaagcacuuucuauuuuuugaaaucucuuuagaggucccagacuuugaucuguuucaauuaagguauuggcaggcauuaguuaacagccacuuggaagcaaaaauagaacauuagaucccugaguuggaagagagaagguagaagguguuacuuggacugcaauuaucugcacuuggaauugagcauuuagucaaaaacuuauauguauucuauauucuauucucauuucugcuacagaauuguaaacaauauucuuccuuaauacagaaauucauagcccacuaaaauaagagcguucucauuuguucauuucucaaucauuuaauaaguauuuacuaagccacuauauccauauauauauauauaucauauauacuguauaauacacacuguaguguuuuuuguggauuguguacuaugagguaguauguuagauacugccaguacugggguaaggaaaacagccugauuaggcccuuacgaagauuccucagacuuguggggaaaacagacauuaucaaauagaaauacuugcaaaccacaguuauguguuaaaaaggaaaaacaaaguaaaaaaaaaguuggugggggggaaccugaucuccuggauacagugcuucgagaaaguuuguuguuggaaaugcaaaccauuacuacuguggaagggaaaggucagaaaaaugaacucaccauuacugaauaguaauaguagcuaucaauuagguggcacuuaccugcaucaggaccuguccugagcacuuuacauagauugucucacuaaccagcccaacaaauauguaagggagauacuauuauuuuucccauuuuauuaauguaaaacaauuaaauaauucuuuaaaauuagacuuagaaaaguggagcaacaaucuuagcagugcuaggacugaaauccaaguuugcuugacuccaaagucuaucucucuuccagaaacuuuuucuuuacuaucugccuaguaggccugcuguauuccuauuugcaacagccuuuuaaacucuuuaaaaauguguccuguaaauuucauauaugauuauacaaaaaaacuuggaauaagcauacaauucuacuuaucuguguuaacuguugaaauuugaagagcuuuuuggaauucuauacccuucaguaguguauguaaaaguuucuaaauauagagaacauagauaagcaaaaauaauauuaaauaaaauaaucgcaccauuaguagguaaauauacuaauauuuuguuguauuuuauucuuguauguuuucacaaaguauaucauaaaauuuuuccuguggcaugacuuaacggagaaaauaaucuucccaaaacauguggcagcaaaacuguuaauuuauuacaucaggcugggcacaguggcucacgcuugcaaucccagcacuuugggaagccgaggcgggcagaucacuugaggccaggaguucgagaccagccuggccaacguggugaaacacugucucuacuaaaaauacaacaguuagccagguguaguggcacaugccuguaaucccagcuacucaggaggcugagacucaagaauugcuugaacccaggaggcagagguugcaguaagcugaggucgcgccccugcacuccagccugggcaacacagugagacucugucucaaaaaaaaaaauuuuuuuuuaaauaaauaaauaauaaauuuaugucuucauaaagcacucagauuaggaaaaaaaggauaaacaaaaaggcaugugucauuuuuuugauugauaauuccaaauuauguuucuuccuuuaauuuuugcccuccuuucauuuacaaacagaauauguuuuuggcuaucaucaaugauacuuacucugaagugaaaucugacuuggcacagcagaaagcugaaauggaacucucagaucuuaucagaaagguaggaaaaaccuuaauucucagaauucuucuguuucugacauaaaaugagcauuguuucacccagauuuucaaaucaacauugauccauugaaauuguuugaaauaaagaauacauugcuauauuucaggaauaauuuaaauguucccuaucuuggagucuugauggauauacugcuaucuugaauuuuaauucugggaauccuuuuaugcccuggaauuaaauucucaacaaucuuuugacacuuuaagagcugagcugaagguucaucaccuucauuauuuugacaucuccuguagcuggcucucacuucaggauccugaguugagaauaaacuagaagggaagauuauauaaagggauuuccaccucuucugucucaauuaccauuuuaaaaaaauaaaaaguuuuagaggaaaacacuuaguaguucacccuuuacccuugaccuuccacggcaguuuuaaaauaagcaaaggaaaagauucaugaauucaggccauagccuggggccugagaacuuuuacuuaugcaccuucucaggaaggguuucauuguuaaauagaagggcaggacaggaaaguugggccucuuuguucuucucaauguaacuucuuuauuugguuuaaaguauaaaauguauacaacaacaaauaaccacauuuaaaauacacaguuuguuucccaacaucauuuugcuaagucauaguggcuccuuaacuguaauuuuuuuuuuuauuaguccaagccuuaggauuauguuaucugugauauauguuauaauagaaaacuuaagccucuuaaaacaaaguccuugggaugggaccuaagauucacauuaucuugauuccgcauaacaguugcuuacauuuuagcaaaucuccaguguguaugcaagcacuccucacuuggcacaauucugauacacacaaacuuugguuaccccaguuuuguuauguaacaccaccuucaacaacacaguucaaauuucaguuaucauaguauauuaacucugaguaacagcacaaaguacaaacuccacugcuagcucuucaguguauagaucaguuaccugaguaacagaugugcaggcugagcaggcucacuggucagucaugacacuauuuucagucuguuacuaauuggucacugagcaucugcuauccaauucacaaacaaagaaagcauguaguguugcuuccuuguguuccaguaauaagcccaugugacauuuuacaaaaauggauaauugaaaaagagaaugggugcaguggcucacgcauguugggaggccaaggcggauggaucaccugaggucaggaguucgaaaccagccuggccaacauggugaaaccccaucucuacuaaaaauacaaaauuagcugaguguggcgacagaugccuguaaucccagcuacuggggaggcugaggcaggagaaucgcuugcaccuaggaggcggagguugcagugagccgagaucgugccauugcacuccagccuggguaacaagagcgaaacuccgucucaaaaaaaaaaaagaaaagaaaagaaaagaaaaagagaaugggcuagcaaagaaaugaaaaaugguaacacuggaagugaaaaucaaaacagaguaauggauuuauagaagaaauagcugagugaagaagaaauaggaguguugacacugcgaucauucaagagauccagauauggagccagaagaacuuagggcaggucuaucaacuuaaaugaggaaaauagcugugauaaaacagaugaagaugucuugaggaaaugaugccugcaaaaaacuucacauuaagggaagucuuauuagagauauuucacaauaaugaaaguacaaaagaaaaaauguuggggcuggacaugguggcuuacuccuguaaucccagcacuuugagaggccaagguggguggaucacuugaggccaggaagucgagacaagccugaucaacaugaugaaaccccgucucuauuaaaaauacaaaaauuagccagacaugauggugcacaccuguaauuccagcuacucaaguggcugaggcacgagaauugcuugaaccagggaggcggagguugcaguaagcugagauugcaccacugcaauccagccaggugacaggguaagacugugucucaaaaauaaauaaaagaaaaauauguuggaagcucauccacauuuaagaaggaauaugacaauucacuaaugcauagaaaagaaguucacuccacauuguaaaguguacaguguaauauuauacaaugaaaacaaggcaagugcuguuuaaacuacucuggauacauuuuuuacaaagaaauaaaacacuuuaguuuuuaauguuucuaauguuuuacauuuuaguguauuaaaucaauauuaguuuucuucuuuuuuaagcucccuauacauuuauaacugacacuaagggaguguuuaauguuuugauuaaaaguuguaaagaucacagaacaauuguaauucuucccacugauuauucagaucauuuugcacaauuucagcuugcauggucacuuacagugccgcacuaugugcaaagcaaggucaggucuaaaguucgcuaaugaaaaauccucggccaggggcaguggcucaccccuguaauccuagcacuuuggaaggcgaggcaggcagaucgcuugagcucaggaguucaacaccagccugggcaacauggugagacccugucucuacaaaaaaaaaaaaauagcaaggcguggugacucacaccuguagucccagcuacuuguugggggcugaguugggaaaaucacuugagcucaggaggucgaggcugcagugagccagaaucacgccacugcccuucugccugggugacagaguaagauccugucucaaaaaaagggaaaauccucaucuacauuucacuggguuuuuuguuuguuuguuuguuuguuuauacacacuuaaggaaauuacugucuagaagauagauaauauaaaaaauaaaaaugcaauucaugauucggguuucuugguauuccuaagaacuguugcacaguacuuuaugcucugaggcagacagcuauagcauauauaguaauuuuuguuucuaucacauaaacuugaauacacauaugaguaaaagaccuuuaguucuucaugacuuacugaaagacccugacuuuuuccauguaacuguuccacaaguguuuuauggaaaacuggauacauuaauucuucauucauccagcacguacuuguugaauggccaauguacaccagguuuguaguaguuacuacugugaauggaaaguaaaacagaugcaaaaggagaauacacuaaaccaagucuuuuauuuuuucucucucugauagggcuaccauaaagcuuuggucaaacuaaaacugaaaaaaaauaccguggaugacauuucagagagucugcggcaaggaggaggcaaguuaaacuuugacgaacuucgacaagaucucaaagggugagaaucaugcuuccugagguucugaaaaauuccugcuucuaaagauaaauuccuggugauaagaguauuucuagcccaagggcucauacagauacuuuuuuuuuuuuuuuccagaggcagguaucuuucuggaacauguuauaagaggaaaacuugcccccauuuggugauuucuccuuuccuccugcauuuugaugucucuguguugagggugaacuggguacaaggaaugauuuuuaucuguauccucucucuaauuucaggaagggccauacugaugcagagauugaggcaauauucacaaaguacgaccaagauggagaccaagaacugaccgaacaugaacaucagcagaugagagacgacuuggagaaagagagggugggucugguuuaggagaaccggauuugauuugguaccuacaacaccacagauguaucaaacacuauagaaguaguggguuauugagucucuugcccauuccccaccacacucucucucucucucagucgguuuauguguuaguacccuguuuauuccagaaagaauauauaacacaauuauguauaaaaaugggugguuagcaugauauaaaaacgucaaaaugaaaagcaagcaaaacaaaaguaaaaauaauggauuauuaaugaagcuuaaaaaugcauucauaaaaacacauaugcuuauuaagauugggcuacaaauugggcccuaagcuugcugguaaucagcuugaaaagagaagccugauuagcugcagaguccacaauguccgugagagugaagaaaacaaaaaaugacuuaccaagagaugugaaauuauucugguuaguuaguggcuauuuaaauuguuaacuuuuuuuucuuuuuuuuuuuuuuuugagauggagucuugcucugccucccaggcuggagugcaguggcacaaucgcgacucacugcaaccuccaccucccggguucaagcgauucucuugccucagccucccaaguagcuaggacuacaggcacaugccaucaugcccggcuaauuuuuguauuuguaguagauaugggguuucaccauguuggucucaaacuccugacugcaagcaaucugcccaccuuggccucccaaaguggugggauuacaggcaguagccaccgugccuuuccuaaauuauuaacauuuauaauaaaauuaacagccgccuuccauuugaauacuuuuuacaaaauaguuaaaaauaaacauaagugggcuuuuauagucagaaaaaaaaauucaaagcuuuaccauuaacuuucaaaaauaaaugguuagacagcaacaacaaaaaucugugguaacugagguacagagaacacagaugaauguuauuacaaaagccacuuuccuaugagaagucuaggacagugguuucuaaaugccacuccacagacagugcuaguaggugacagacuucuccagucacagugaaauuuaagcauaaagaaaaugaggaaaauuuuuacaaggcucuauuuagacaaaguucuuauucugacauuacaucuuuccuacuuuggagcuguugaauguauuaucuuuuaugaaaagaaggcgauccagguugagcaucccuaacccaaauaugugagucugaaaugcuccaaaaccuaaaacuucuugagcacaaacaugauagucaaaggucaugcuuaaaggaaaugcugucauuggagcaguuuggauuuuggguuuucagauuagggaugcugaaccaguaaguauaaugcaaacauuccaaaauauuuuugaaaaucccaaauccaaaacacuucugaucccaaguauuucaaauaagggauacucaaccuguaauauauuucuucauuucuuuauuuauuuuauuauuauuuuaagauggcucauggcccacugcagccucaaacuccuaggcucaagugaucuuccgaccucaaccucccagguagcucagguagcugggacugcaggcaugcaucaccaugccuggcuaauuuuuuaaaaaauuuuuuguggaggcagagucucaccuugcugcccaggccagucucaaacuccuggcuucaagcaguacuccugccucagccucccaaaguauuaggauuacaggugugaccacuaugccuggcccauauuucuucauuuaguuuuuucuuugccugcuguguuuuuaauguucuuucuuguucaaacaaaaaguuggcuauuccuugcuguuaguuaaauuugccaaucuaugaaacugaaaaaugcaggagucccagccugguguuaaauacaaagaaaucccagguaaauggcaugcacccaguuccugcuugcccaaguccuuggugaggcuucuguggggucucaguguucugcuccucacucagugaccccuuguucuucaggaggaccuggauuuggaucacaguucuuuaccacgucccaugagcagccgaaguuucccucgaagccuggaugacucugaggaggaugacgaugaagauagcggacauagcuccagaaggaggggaagcauuucuaguggcguuucuuacgaagaguuucaaguguaaguauaaaggaauuggcagaauuugcguugacaagaguccacaugagaccaggcaguucccucaucucucugaauucacuccuuuccauuacuaaucauccagcuuuuaaaaauaacuuauacuggccagacgcaguggcucaugccuguaaucccaccacuuugggaggccaaagcaggcaggucaugaggucagaaguucgagacgagccuggccaacauagugaaaccccaucucuauuaaaaauacaaaaaauuagcugggcaugguggugggcaccuguaauccuagcuacuugggaggcugaggcaagagaauugcuugaacccgggaggcggagguuacagagagccgagauggcuccacugcacaccagccugggcgacagugcaagacucugucucaaaaaaaaaaaaacuugucaauugguguuuuguuucuuacauaauauguuuacuauaaaaauuagcaaauaagagcaaaagaaaacauuaacauuucacauauuucuaccaaugaaaaauguuuauuaauauaucaguguuugugucucuauuugcauguguuuaucaauguuucuauauauuuuuauggccuaacauaugguucguccugaagaauguuccuugugcauuugagaagaaugaauauucugcuguucaaguguucuguagauguuuguuaggucuaguuuguuuacaguuuuauucaggucucccauuuccugguugaucuuagaugugccuagaugugguauucacguuugaaagugggguauuaaagucuccaaguauuauuaguuggaguucaucccuucaauucuguaagguuuugcuuuguguauuuuggaacucuguuguugggugcauacauauuuauaacuaguauauuuuccuaauauauugacccuauuuucucucucaacuuaaugaggcuaaagaaaaaaaagaauugacccuguuuucauuacaagauguuauccacuuuaucucuaguaaaauucuuuguuuuaaguauuuuuuguuugauauuacuguaaccacuccagcuuucuuuugguugcuguuugcaugauaaaucuuuuuccauccuuuuacuuuaaacuuauuuauaucuuucagucugaaguaugucucuccuguagacagcauauaauuggaucuuaucuuuuuauccaguuugacaauuucuguuuuugauuagauugcuuaauccauucauuuaauguuaucauugauguaguugauuucugucugcuauuuuauuuuuuguuuucuagcuuacuuuuuuuuguuccucuuucacugcuuucuuguacauuaagugaauauuuucaaguauaacauuuaaauuuuuuuaaugauuuuucauuuuuuuuagucaggaguugcucuaagacuuaguuuauacaauuaaguuaugaaaaauuacuucagauauauauuaacugaauccagugagauauagaaaucauuucuauuuagcuuuuuuccucuucccucuuuuugugcuauauauucaucuaucuauauguauauauagucaucuacauauguugcaaaucacauuguuagaacaauguuacauuuuuauaacacacuguguaauauauaguauauaauuuuauaucucuuaaugaagcugagagaagaggaaguauauauuuauaaauguguauauuaaccuacuuuuuuaccauuucuaauucucuucuuuugcuccucuggauucaaguuaucaucugucgucauucucuuucuccgauacagcuuugcuacugccuaccuccuauuauugucaaauauauuacauuucuauuauagaccuucagauccaauuauguacauauuuuuacacaacugcuuuuuaaaucaguuaaggaacaaaaggagaaauguacauauauacuauauuuuauaccuacacaguuaucuuuaccaguguucuuugccuuuucauguggauucugauuacuaucuggagucacuugcuuucagcauaaagaauuuccuuuaguauuuuuuguaaagcagguuugcuagcaaugaauucuuucauuuuuuguuuaucugagaauguuuuucuuucuccuucauuuccucuggcuuguauuguuucugaugagaagacaggugcuaauuuuacugugguccccuuguacaugaugacucaauuuucucucaccacuuucaagauuuuuuugcuuuugucuuucauuauuuuuacugugauaugucuggguauaaaucucugaguucauccuacuuagaaaguguuuuuucugcuucuuucacuuucucuucuccuuugggacccgcauuaugcauaugcuuagggguaucacauauuucucuuaggcucuguucgucgucauuuuuuuucccucucuguuccucagagugcauagucuguauugauguaucuucaaguucacugacuuguucuucugucagcuugcuuaaaucucuguugagcuccucuaguuauuuauuuauuuauuuauuuauuuuauauauauauauauauauauauauauagagagagagagagagagagagagagaaagagagagagagagagacagggagacagggucucacuccaucacccaggcuggaguacagugguguaaucauggcucucuacagccugaacaccugggcucaaaugauccuccugccucaaccucccaaguagcuaggacuaugggcacaugcugccaugccuggcuaauuuuuaaaaaaaaauuuguagagauggcaucuuguuauguugcccagguuggucucaaacucccggccucaagugauccuuccgccucggccucccaaagugcuggggucacagguaugagccaccgcacuuagccugaauuuuuuauuuauuauacuuuucaacuccagaauuucuauuugguucuuuuuagcaaucucugucucuuuauucuguauuugaugauauccuguauuugaugagacaaugucaucauaacuuccuuuuuuuuuuaagagauagggucucucucugucacccaggcuagagugcaguggcaugauccuagcucacugcagccucgaacuccugaacucaagcaauccucccaccucagccuccuaaguaccugacacuacaggcaugagccacuguacccagcuaauuuuuauuuuuuguagagauggggucuaaguugcccaggcuggucucaaacuccugggcucaagugauccucccugcucaggcucccaaagugcugggauuacaggcaugaaccacuggacccagccuccuuuauuucuuuaaccauggugggguuuuuuauuauuuguuuguuuguuuuaaccuguuugaauauauuuauaauagguaccuucaggucuuugucugcuaagucugacaucugggcccucucaaagacaguuucaguugucuuuuuuuuuuucuucuuguguaugggaacauuuuccuguuuuuuuguuuuguuuuuuguuguuuuguuuuguuguuguuguuguuguuaaagauuggacauguuagauaauauauuguaggaacucuggcuagugauucccuuuccuccccaggacuuguuuuuauuucucuuugcuuguuuacuuuuucauacagucuguuuccccacagugucugccucugacuuuauuccuuagagggcgcagcuguggccauguacguagucacucugggaagacagugguuuuagcagcgugcucauuaacuuucucugaccucuuuguuauaccuccugccucuguggauauuagacccaguuauuacauuucauuguuuacugauuggucuauuguuuuccagaaugccuugggauguaauuugcuccacagucugauccacuuaaauucaggccucuuugcagggcuaguuuuagaggccagucuuuuuuuuuuuuuuuuuuuuuuuuugagacagagucucacucuguugcccaggccggaauguaguggugcagucucagcucacugcagccucaaucucucaggcucaagcaaucuucccaccucagcuucucaaguagcuaggacuacaggugcacgccaccaugccugguuaauuuuugcauuuuuuauagagaugggguuuuaccauguugccccggcuggucucaaacuccugaguucaagcaauccacccaccucagccucacaaaaggccgggauuacagauaugcaccaccacgccuggccccugaggccagucuuuaacugucuucuuagcugucucuuucccugguucucucuggugaacuagcugguaauuuguuuaucucauaaggcuaccagauuccuuguaaaugcuuauccccacaaucuccauuguuuucaagagcaucguuagucuuuaauuuccucacgcuucauuccaaauaaaguccauucacuugagaagaguucuauauuccuaugaccugugucuccccaugagcaaaacugcuacugcuuuacagagccagggacaguggcccaccucucuguggcauccugcuuuaugaacaagucacugggcucagauggcagucucugauuuucucaccuugcuucuucuggcauggaaacuccacccuacaagugggaacugaguggaagaagagagccccauuccccuuagccacucuuaacaggauuagaaccucugcaacaugcauuuaagaaugggaacaggcugggcacaguggcucacgccuguaauccuagcacuuugggaggucaaggcaggaggauugcuugagccaggaguucaggaccagccugugcaacauggugagacccucaucucuacaagaaauagaaaaauuaacugguggguuguguauaccuguaaucccagcuacucgggagccugaagugggaggauugcuugaaccuggaggcagagguugcagugagucaagauuacaccauugcacgccagccugggcaacagagugagacucugucucaaaaaaaaaaaaaaaaaaagaguaggaacauugaggcugggcaugguggcucaugccuguaauccuagcacuaugggaggccaaggcaggaguaucacuugacgcuaggaguucaagaccaaccuggguaacauagcgagacuuugucucuauuaaaaaaaaaaaaaaaaaagguguaaaaaacuuuuguaacaagagugggaaagccgggcacaguggcucacaccuguaaucccagcacuuuggaaggccaaggcaggcaggcggaucaccugaggucaggaguuugagaccagccuggccaacguggugaaaccccaucucuacuaaaaaauagaaaaauuaucugggcaugguggugcacaccuguagucccagcuacucgggaggcugaggcaggagaaucacuugaaccuacgaggcagaaguugcaguaagccaagaucacgccacugcacuccagccugggcgacagagcaagacucugucucaaaaaaaaaaaaagaguggaaauguuaggaugagaaaugcuggcagccugccccucccugggagauacuguagcccuagacuggaaguugggggaggagggagcccugugcucuuagcugcacccaugugaaguugugcuucuaucacaugagcuggggacaggagagaaggcucagauuauggcuucagugccacagaaucucuucauacuaaaauuuaguagauuuucuugaauaaaugcuuuuucauuugcuguacacccuuaaaaguuucuagaaauuuuuaauauuugaguuuuaaaaaauaauuuucaacaguuacaguuauuucacuaaagagagagucuacagaacccucuugccaccauugcagagguugucuuuggcuuacgaguuuuuaaaguauuuguauacauuuuuuaaguucaaaauaauagaauuguaagugaacaugcuguuuucauacuguuuuucaagcuuuauuuaauauauuguaaaucuaauucuauuuuauuaaauagucugccacaguauaaugucugaugucuccuuagaauuuuauuguauggaugaacaaugauuauuuaauuuccuaccaauuguuggguguuuuuuguuuguuuguuuguuuuugagacugggucucacucugucacccaggcuggagugcaggagugcgguggaaugaucacggcucacugcagccucaacaucccaaggcucaggugauccuuccaccucagccucgcaaguagcugggaguacaggcacaugccaccaugcccaccuauuuuuuagagaugaaguuuugccauccugcccaggcuggcucgaacuccuggccucaagcgaucugcacacuuccgccucccaaaaugccaggauuacaggcgugagccaucaugcccuacccccccaucaauuguuugauguagccauuuuucaaugauccgcgauuaagaagcagcacucuuuuauagccaaaaauuacacauauauaaaauuuuccuuuagaaaauguucuaaaaauggaaugucuaacuaaaggguuaggcauacauucuuaagacuucugauacgcgcugacuugcaggaaaguuguuucaguuaacacuccuaccagcggcauccgagaguuaaucuguaaagcuugagacaacuuagaaaguguuucaaaugauuguguugcuuaagaaaaaaaucuuagcacuuccuuuugaaaagccaguggggcugaaaagacaaugacaagcacuuugucccucuguacuguguuuuccuugcagccuggugagacgaguggaccggauggagcauuccaucggcagcauaguguccaagauugacgccgugaucgugaagcuagagauuauggagcgagccaaacugaagaggagggaggugcugggaaggcuguuggaugggguggccgaggucaguagucaugagcugaaaacaccgcugcugagcaugguguuauuaaugaaaauauauguugcugacaguuguauuugaaguauugaagaagaguaaaaaaaauuuacguuuauagaaauucacaaugauguuuccauuuacucucauuuucagauuuuuuucucugaaacagaaacacucuuucuauaaaaucucuugcuauaaaacaucaauguagucauauugucuaacccuuaggcugagauguuuaucuuucuccauaacuacagauaaaauuauaaucuggagguguuacuuucuuaauacuccauaugcuaaugguccugccuucacugcaggguagaauuaagugaaaaauuacuccagcaacucugagauuugcuauuauaugcuguaaaucuccagccuuaccaaacuacagauuauuuggucccuggacuuccuaaggcauuuccuucuacugcccccaacaccaguuucuuuuucccuuuuuaggaugaaaggcugggucgugacagugaaauccauagggaacagauggaacggcuaguacgugaagaguuggaacgcugggaauccgaugaugcagcuucccagaucagucaugguuuaggcacgccagugggacuaaauggucaaccucgccccagaagcucccgcccaucuuccucccaaucuacagaaggcauggaaggugcagguggaaaugggaguucuaauguccacguaugauauguguguuucaguauguguguuucuaauaagugaggaaguggcuguccugaauugcuguaacaagcacacuauuuauaugcccugaccaccauaggaugcuagucuuugugaccgauugcuaaucuucugcacuuuaauuuauuuuauauaaacuuuacccaugguucaaagauuuuuuuuucuuuuucucauauaagaaaucuagguguaaauauugaguacagaaaaaaaaucuucaugauguguauugagcgguacgcccaguugccaccaugacugagucuucucaguugacaaugaaguagccuuuuaaagcuagaaaacugucaaagggcuucugaguuucauuuccagucacaaaaaucaguauuguuauuuuuuuccaagagugugaaggaaaauggggcauuccuuuccacucuggcauaguucaugagcuuaauacauagcuuucuuuuaagaaaggagccuuuuuuuucaacuagcuuccugggguaaacuuuucuaaaagauaaaauggaaaggaacuccaaacuaugauagaaucugugugaaugguuaagaugaauguuaaauacuaugcuuuuuuguaaguugaucguaucugaugucugugggacuaacuguaucacuuaauuuuuaccuuauuuuggcucuaauuugaauaagcugaguaaaaccaccaaagaucaguuauaggauaaaauggcaucucuaaccauaacacaggagaauuggaaggagcccuaaguugucacucaguuuaauuucuuuuaaugguuaguuuagccuaaagauuuaucugcauauucuuuuucccauguggcucuacucauuugcaacugaauuuaauguuauaacucaucuagugagaccaacuuacuaaauuuuuaguaugcacugaaaguuuuuauccaacaauuauguucauuuuaagcaaaauuuuaagaaaguuuugaaauucauaaagcauuugguuuuaaacuauuuuaagaauauaguacucggucagguaugacggcucacgccuguaaucccagcacuuugggaggccgaaacaggcgaaucacuugagcccaggaguucaagaccaacaugggcaauguggcgaaacuccaucucuacaaaaaaugcaaaaauaaaaaauauaguacucaaguauucuugauccuguguuucaaaacuagaauuuguaaugcaaauggagcucagucuaauaaaaaagagguuuugguauuaaaaguucauacauuagacaguaucagccaaaauuugaguuagcaacacuguuuucuuuacgagagggucucacccaaauuuauggggagaaaucuauuucucaaaaaaaaaaaucuucuuuuacagaaauguugaguaaggugacauuuugagcgcuaauaagcaaaagagcaugcagugcuguugaauaacccucacuuggagaaccaagagaauccugucguuuaaugcuauauuuuaauuucacaaguuguucauuuaacugguagaaugucaguccaaucuccaaugagaacaugagcaaauagaccuuuccagguugaaagugaaacauacuggguuucuguaaguuuuuccucauggcuucaucucuaucuuuacuuucucuugaauaugcuacacaaaguucuuuauuacuacauacuaaaguuugcauuccagggauauugacuguacauauuuauguauauguaccauguuguuacauguaaacaaacuucaauuugaagugcagcuauuaugugguauccauguguaucgaccaugugccauauaucaauuauggucacuagaaagucucuuuaugauacuuuuuauuguacuguuuuucauuucacuugcaaaauuuugcagaauuccuccuuucuacccauaaauuacauauauuuuucuucuuuagucauggagaacucccccccucaucucuucccuauuaucuuucccuguguacugguauuauuaaaaagacauuacauacgcaagucuuucucgacaaucaagaauguuauuaauguguaauacugagcacuuuacuucuuaauaaaaacuugauauaguagcaga

SEQ ID NO: 5547 - RNA, 18 nt, Artificial Sequence
  Description of Artificial Sequence: Synthetic oligonucleotide
uuuuucacuuguguagau

SEQ ID NO: 5548 - RNA, 18 nt, Artificial Sequence
  Description of Artificial Sequence: Synthetic oligonucleotide
aagucuuuuucacuugug

SEQ ID NO: 5549 - RNA, 18 nt, Artificial Sequence
  Description of Artificial Sequence: Synthetic oligonucleotide
cauucaagucuuuuucac

SEQ ID NO: 5550 - RNA, 18 nt, Artificial Sequence
  Description of Artificial Sequence: Synthetic oligonucleotide
acuaccauucaagucuuu

SEQ ID NO: 5551 - RNA, 18 nt, Artificial Sequence
  Description of Artificial Sequence: Synthetic oligonucleotide
uggcuacuaccauucaag

SEQ ID NO: 5552 - RNA, 18 nt, Artificial Sequence
  Description of Artificial Sequence: Synthetic oligonucleotide
cccaguggcuacuaccau

SEQ ID NO: 5553 - RNA, 18 nt, Artificial Sequence
  Description of Artificial Sequence: Synthetic oligonucleotide
gauuccccaguggcuacu

SEQ ID NO: 5554 - RNA, 18 nt, Artificial Sequence
  Description of Artificial Sequence: Synthetic oligonucleotide
gcaaugauuccccagugg

SEQ ID NO: 5555 - RNA, 18 nt, Artificial Sequence
  Description of Artificial Sequence: Synthetic oligonucleotide
aaguugcaaugauucccc

SEQ ID NO: 5556 - RNA, 18 nt, Artificial Sequence
  Description of Artificial Sequence: Synthetic oligonucleotide
acuauaaguugcaaugau

SEQ ID NO: 5557 - RNA, 18 nt, Artificial Sequence
  Description of Artificial Sequence: Synthetic oligonucleotide
gcuccacuauaaguugca

SEQ ID NO: 5558 - RNA, 18 nt, Artificial Sequence
  Description of Artificial Sequence: Synthetic oligonucleotide
agccagcuccacuauaag

SEQ ID NO: 5559 - RNA, 18 nt, Artificial Sequence
  Description of Artificial Sequence: Synthetic oligonucleotide
auaauagccagcuccacu

SEQ ID NO: 5560 - RNA, 18 nt, Artificial Sequence
  Description of Artificial Sequence: Synthetic oligonucleotide
uccagauaauagccagcu

SEQ ID NO: 5561 - RNA, 18 nt, Artificial Sequence
  Description of Artificial Sequence: Synthetic oligonucleotide
acaaauccagauaauagc

SEQ ID NO: 5562 - RNA, 18 nt, Artificial Sequence
  Description of Artificial Sequence: Synthetic oligonucleotide
ucuugacaaauccagaua

SEQ ID NO: 5563 - RNA, 18 nt, Artificial Sequence
  Description of Artificial Sequence: Synthetic oligonucleotide
cuuguucuugacaaaucc

SEQ ID NO: 5564 - RNA, 18 nt, Artificial Sequence
  Description of Artificial Sequence: Synthetic oligonucleotide
ccucucuuguucuugaca

SEQ ID NO: 5565 - RNA, 18 nt, Artificial Sequence
  Description of Artificial Sequence: Synthetic oligonucleotide
uguuuccucucuuguucu

SEQ ID NO: 5566 - RNA, 18 nt, Artificial Sequence
  Description of Artificial Sequence: Synthetic oligonucleotide
gcagcuguuuccucucuu

SEQ ID NO: 5567 - RNA, 18 nt, Artificial Sequence
  Description of Artificial Sequence: Synthetic oligonucleotide
cuugugcagcuguuuccu

SEQ ID NO: 5568 - RNA, 18 nt, Artificial Sequence
  Description of Artificial Sequence: Synthetic oligonucleotide
agcaacuugugcagcugu

SEQ ID NO: 5569 - RNA, 18 nt, Artificial Sequence
  Description of Artificial Sequence: Synthetic oligonucleotide
aggcuagcaacuugugca

SEQ ID NO: 5570 - RNA, 18 nt, Artificial Sequence
  Description of Artificial Sequence: Synthetic oligonucleotide
ucuugaggcuagcaacuu

SEQ ID NO: 5571 - RNA, 18 nt, Artificial Sequence
  Description of Artificial Sequence: Synthetic oligonucleotide
auuuuucuugaggcuagc

SEQ ID NO: 5572 - RNA, 18 nt, Artificial Sequence
  Description of Artificial Sequence: Synthetic oligonucleotide
cagacauuuuucuugagg

SEQ ID NO: 5573 - RNA, 18 nt, Artificial Sequence
  Description of Artificial Sequence: Synthetic oligonucleotide
ccagccagacauuuuucu

SEQ ID NO: 5574 - RNA, 18 nt, Artificial Sequence
  Description of Artificial Sequence: Synthetic oligonucleotide
ucgguccagccagacauu

SEQ ID NO: 5575 - RNA, 18 nt, Artificial Sequence
  Description of Artificial Sequence: Synthetic oligonucleotide
guuccucgguccagccag

SEQ ID NO: 5576 - RNA, 18 nt, Artificial Sequence
  Description of Artificial Sequence: Synthetic oligonucleotide
cccugguuccucggucca

SEQ ID NO: 5577 - RNA, 18 nt, Artificial Sequence
  Description of Artificial Sequence: Synthetic oligonucleotide
aguugcccugguuccucg

SEQ ID NO: 5578 - RNA, 18 nt, Artificial Sequence
  Description of Artificial Sequence: Synthetic oligonucleotide
auaaaaguugcccugguu

SEQ ID NO: 5579 - RNA, 18 nt, Artificial Sequence
  Description of Artificial Sequence: Synthetic oligonucleotide
agucaauaaaaguugccc

SEQ ID NO: 5580 - RNA, 18 nt, Artificial Sequence
  Description of Artificial Sequence: Synthetic oligonucleotide
ugagaagucaauaaaagu

SEQ ID NO: 5581 - RNA, 18 nt, Artificial Sequence
  Description of Artificial Sequence: Synthetic oligonucleotide
uacacugagaagucaaua

SEQ ID NO: 5582 - RNA, 18 nt, Artificial Sequence
  Description of Artificial Sequence: Synthetic oligonucleotide
cguuguacacugagaagu

SEQ ID NO: 5583 - RNA, 18 nt, Artificial Sequence
  Description of Artificial Sequence: Synthetic oligonucleotide
guuggcguuguacacuga

SEQ ID NO: 5584 - RNA, 18 nt, Artificial Sequence
  Description of Artificial Sequence: Synthetic oligonucleotide
uuaauguuggcguuguac

SEQ ID NO: 5585 - RNA, 18 nt, Artificial Sequence
  Description of Artificial Sequence: Synthetic oligonucleotide
acagguuaauguuggcgu

SEQ ID NO: 5586 - RNA, 18 nt, Artificial Sequence
  Description of Artificial Sequence: Synthetic oligonucleotide
acagaacagguuaauguu

SEQ ID NO: 5587 - RNA, 18 nt, Artificial Sequence
  Description of Artificial Sequence: Synthetic oligonucleotide
accacacagaacagguua

SEQ ID NO: 5588 - RNA, 18 nt, Artificial Sequence
  Description of Artificial Sequence: Synthetic oligonucleotide
ggaugcauguccucagua

SEQ ID NO: 5589 - RNA, 18 nt, Artificial Sequence
  Description of Artificial Sequence: Synthetic oligonucleotide
aggagggaugcauguccu

SEQ ID NO: 5590 - RNA, 18 nt, Artificial Sequence
  Description of Artificial Sequence: Synthetic oligonucleotide
gaaauaggagggaugcau

SEQ ID NO: 5591 - RNA, 18 nt, Artificial Sequence
  Description of Artificial Sequence: Synthetic oligonucleotide
acacagaaauaggaggga

SEQ ID NO: 5592 - RNA, 18 nt, Artificial Sequence
  Description of Artificial Sequence: Synthetic oligonucleotide
caaccacacagaaauagg

SEQ ID NO: 5593 - RNA, 18 nt, Artificial Sequence
  Description of Artificial Sequence: Synthetic oligonucleotide
auguacaaccacacagaa

SEQ ID NO: 5594 - RNA, 18 nt, Artificial Sequence
  Description of Artificial Sequence: Synthetic oligonucleotide
gauguauguacaaccaca

SEQ ID NO: 5595 - RNA, 18 nt, Artificial Sequence
  Description of Artificial Sequence: Synthetic oligonucleotide
aauaggauguauguacaa

SEQ ID NO: 5596 - RNA, 18 nt, Artificial Sequence
  Description of Artificial Sequence: Synthetic oligonucleotide
cccagaauaggauguaug

SEQ ID NO: 5597 - RNA, 18 nt, Artificial Sequence
  Description of Artificial Sequence: Synthetic oligonucleotide
cuaaccccagaauaggau

SEQ ID NO: 5598 - RNA, 18 nt, Artificial Sequence
  Description of Artificial Sequence: Synthetic oligonucleotide
ucuggcuaaccccagaau

SEQ ID NO: 5599 - RNA, 18 nt, Artificial Sequence
  Description of Artificial Sequence: Synthetic oligonucleotide
guuuuucuggcuaacccc

SEQ ID NO: 5600 - RNA, 18 nt, Artificial Sequence
  Description of Artificial Sequence: Synthetic oligonucleotide
caaagguuuuucuggcua

SEQ ID NO: 5601 - RNA, 18 nt, Artificial Sequence
  Description of Artificial Sequence: Synthetic oligonucleotide
gcaggcaaagguuuuucu

SEQ ID NO: 5602 - RNA, 18 nt, Artificial Sequence
  Description of Artificial Sequence: Synthetic oligonucleotide
uaacugcaggcaaagguu

SEQ ID NO: 5603 - RNA, 18 nt, Artificial Sequence
  Description of Artificial Sequence: Synthetic oligonucleotide
guagcuaacugcaggcaa

SEQ ID NO: 5604 - RNA, 18 nt, Artificial Sequence
  Description of Artificial Sequence: Synthetic oligonucleotide
cucauguagcuaacugca

SEQ ID NO: 5605 - RNA, 18 nt, Artificial Sequence
  Description of Artificial Sequence: Synthetic oligonucleotide
gcauccucauguagcuaa

SEQ ID NO: 5606 - RNA, 18 nt, Artificial Sequence
  Description of Artificial Sequence: Synthetic oligonucleotide
ccuuggcauccucaugua

SEQ ID NO: 5607 - RNA, 18 nt, Artificial Sequence
  Description of Artificial Sequence: Synthetic oligonucleotide
uggguccuuggcauccuc

SEQ ID NO: 5608 - RNA, 18 nt, Artificial Sequence
  Description of Artificial Sequence: Synthetic oligonucleotide
ccgucuggguccuuggca

SEQ ID NO: 5609 - RNA, 18 nt, Artificial Sequence
  Description of Artificial Sequence: Synthetic oligonucleotide
gcuauccgucuggguccu

SEQ ID NO: 5610 - RNA, 18 nt, Artificial Sequence
  Description of Artificial Sequence: Synthetic oligonucleotide
cccuugcuauccgucugg

SEQ ID NO: 5611 - RNA, 18 nt, Artificial Sequence
  Description of Artificial Sequence: Synthetic oligonucleotide
ccccucccuugcuauccg

SEQ ID NO: 5612 - RNA, 18 nt, Artificial Sequence
  Description of Artificial Sequence: Synthetic oligonucleotide
uuuuaccccucccuugcu

SEQ ID NO: 5613 - RNA, 18 nt, Artificial Sequence
  Description of Artificial Sequence: Synthetic oligonucleotide
ucaguuuuuaccccuccc

SEQ ID NO: 5614 - RNA, 18 nt, Artificial Sequence
  Description of Artificial Sequence: Synthetic oligonucleotide
agccuucaguuuuuaccc

SEQ ID NO: 5615 - RNA, 18 nt, Artificial Sequence
  Description of Artificial Sequence: Synthetic oligonucleotide
cgguaagccuucaguuuu

SEQ ID NO: 5616 - RNA, 18 nt, Artificial Sequence
  Description of Artificial Sequence: Synthetic oligonucleotide
uauuucgguaagccuuca

SEQ ID NO: 5617 - RNA, 18 nt, Artificial Sequence
  Description of Artificial Sequence: Synthetic oligonucleotide
uccuuuauuucgguaagc

SEQ ID NO: 5618 - RNA, 18 nt, Artificial Sequence
  Description of Artificial Sequence: Synthetic oligonucleotide
aaauauccuuuauuucgg

SEQ ID NO: 5619 - RNA, 18 nt, Artificial Sequence
  Description of Artificial Sequence: Synthetic oligonucleotide
uccucaaauauccuuuau

SEQ ID NO: 5620 - RNA, 18 nt, Artificial Sequence
  Description of Artificial Sequence: Synthetic oligonucleotide
ucccuuccucaaauaucc

SEQ ID NO: 5621 - RNA, 18 nt, Artificial Sequence
  Description of Artificial Sequence: Synthetic oligonucleotide
ccaacucccuuccucaaa

SEQ ID NO: 5622 - RNA, 18 nt, Artificial Sequence
  Description of Artificial Sequence: Synthetic oligonucleotide
ggaucccaacucccuucc

SEQ ID NO: 5623 - RNA, 18 nt, Artificial Sequence
  Description of Artificial Sequence: Synthetic oligonucleotide
uucuaggaucccaacucc

SEQ ID NO: 5624 - RNA, 18 nt, Artificial Sequence
  Description of Artificial Sequence: Synthetic oligonucleotide
uaauauucuaggauccca

SEQ ID NO: 5625 - RNA, 18 nt, Artificial Sequence
  Description of Artificial Sequence: Synthetic oligonucleotide
acucguaauauucuagga

SEQ ID NO: 5626 - RNA, 18 nt, Artificial Sequence
  Description of Artificial Sequence: Synthetic oligonucleotide
uuccaacucguaauauuc

SEQ ID NO: 5627 - RNA, 18 nt, Artificial Sequence
  Description of Artificial Sequence: Synthetic oligonucleotide
guucuuuccaacucguaa

SEQ ID NO: 5628 - RNA, 18 nt, Artificial Sequence
  Description of Artificial Sequence: Synthetic oligonucleotide
uuaugguucuuuccaacu

SEQ ID NO: 5629 - RNA, 18 nt, Artificial Sequence
  Description of Artificial Sequence: Synthetic oligonucleotide
cagaguuaugguucuuuc

SEQ ID NO: 5630 - RNA, 18 nt, Artificial Sequence
  Description of Artificial Sequence: Synthetic oligonucleotide
uggaccagaguuaugguu

SEQ ID NO: 5631 - RNA, 18 nt, Artificial Sequence
  Description of Artificial Sequence: Synthetic oligonucleotide
gaacuuggaccagaguua

SEQ ID NO: 5632 - RNA, 18 nt, Artificial Sequence
  Description of Artificial Sequence: Synthetic oligonucleotide
gagaugaacuuggaccag

SEQ ID NO: 5633 - RNA, 18 nt, Artificial Sequence
  Description of Artificial Sequence: Synthetic oligonucleotide
gcauugagaugaacuugg

SEQ ID NO: 5634 - RNA, 18 nt, Artificial Sequence
  Description of Artificial Sequence: Synthetic oligonucleotide
uuccagcauugagaugaa

SEQ ID NO: 5635 - RNA, 18 nt, Artificial Sequence
  Description of Artificial Sequence: Synthetic oligonucleotide
aaagguuccagcauugag

SEQ ID NO: 5636 - RNA, 18 nt, Artificial Sequence
  Description of Artificial Sequence: Synthetic oligonucleotide
ucuggaaagguuccagca

SEQ ID NO: 5637 - RNA, 18 nt, Artificial Sequence
  Description of Artificial Sequence: Synthetic oligonucleotide
cuuuuucuggaaagguuc

SEQ ID NO: 5638 - RNA, 18 nt, Artificial Sequence
  Description of Artificial Sequence: Synthetic oligonucleotide
caauacuuuuucuggaaa

SEQ ID NO: 5639 - RNA, 18 nt, Artificial Sequence
  Description of Artificial Sequence: Synthetic oligonucleotide
aaacacaauacuuuuucu

SEQ ID NO: 5640 - RNA, 18 nt, Artificial Sequence
  Description of Artificial Sequence: Synthetic oligonucleotide
uagaaaaacacaauacuu

SEQ ID NO: 5641 - RNA, 18 nt, Artificial Sequence
  Description of Artificial Sequence: Synthetic oligonucleotide
gauguuagaaaaacacaa

SEQ ID NO: 5642 - RNA, 18 nt, Artificial Sequence
  Description of Artificial Sequence: Synthetic oligonucleotide
agacagauguuagaaaaa

SEQ ID NO: 5643 - RNA, 18 nt, Artificial Sequence
  Description of Artificial Sequence: Synthetic oligonucleotide
gguaaagacagauguuag

SEQ ID NO: 5644 - RNA, 18 nt, Artificial Sequence
  Description of Artificial Sequence: Synthetic oligonucleotide
uaauggguaaagacagau

SEQ ID NO: 5645 - RNA, 18 nt, Artificial Sequence
  Description of Artificial Sequence: Synthetic oligonucleotide
ccuuauaauggguaaaga

SEQ ID NO: 5646 - RNA, 18 nt, Artificial Sequence
  Description of Artificial Sequence: Synthetic oligonucleotide
accauccuuauaaugggu

SEQ ID NO: 5647 - RNA, 18 nt, Artificial Sequence
  Description of Artificial Sequence: Synthetic oligonucleotide
cacuaaccauccuuauaa

SEQ ID NO: 5648 - RNA, 18 nt, Artificial Sequence
  Description of Artificial Sequence: Synthetic oligonucleotide
uguggcacuaaccauccu

SEQ ID NO: 5649 - RNA, 18 nt, Artificial Sequence
  Description of Artificial Sequence: Synthetic oligonucleotide
gaacauguggcacuaacc

SEQ ID NO: 5650 - RNA, 18 nt, Artificial Sequence
  Description of Artificial Sequence: Synthetic oligonucleotide
ugauggaacauguggcac

SEQ ID NO: 5651 - RNA, 18 nt, Artificial Sequence
  Description of Artificial Sequence: Synthetic oligonucleotide
cuuggugauggaacaugu

SEQ ID NO: 5652 - RNA, 18 nt, Artificial Sequence
  Description of Artificial Sequence: Synthetic oligonucleotide
gggacuuggugauggaac

SEQ ID NO: 5653 - RNA, 18 nt, Artificial Sequence
  Description of Artificial Sequence: Synthetic oligonucleotide
caagauuugauggccggg

SEQ ID NO: 5654 - RNA, 18 nt, Artificial Sequence
  Description of Artificial Sequence: Synthetic oligonucleotide
ugagucaagauuugaugg

SEQ ID NO: 5655 - RNA, 18 nt, Artificial Sequence
  Description of Artificial Sequence: Synthetic oligonucleotide
ggaaaugagucaagauuu

SEQ ID NO: 5656 - RNA, 18 nt, Artificial Sequence
  Description of Artificial Sequence: Synthetic oligonucleotide
cuccaggaaaugagucaa

SEQ ID NO: 5657 - RNA, 18 nt, Artificial Sequence
  Description of Artificial Sequence: Synthetic oligonucleotide
agaaacuccaggaaauga

SEQ ID NO: 5658 - RNA, 18 nt, Artificial Sequence
  Description of Artificial Sequence: Synthetic oligonucleotide
gagugagaaacuccagga

SEQ ID NO: 5659 - RNA, 18 nt, Artificial Sequence
  Description of Artificial Sequence: Synthetic oligonucleotide
ucugagagugagaaacuc

SEQ ID NO: 5660 - RNA, 18 nt, Artificial Sequence
  Description of Artificial Sequence: Synthetic oligonucleotide
gcucaucugagagugaga

SEQ ID NO: 5661 - RNA, 18 nt, Artificial Sequence
  Description of Artificial Sequence: Synthetic oligonucleotide
cagaggcucaucugagag

SEQ ID NO: 5662 - RNA, 18 nt, Artificial Sequence
  Description of Artificial Sequence: Synthetic oligonucleotide
aauagcagaggcucaucu

SEQ ID NO: 5663 - RNA, 18 nt, Artificial Sequence
  Description of Artificial Sequence: Synthetic oligonucleotide
gugcuaauagcagaggcu

SEQ ID NO: 5664 - RNA, 18 nt, Artificial Sequence
  Description of Artificial Sequence: Synthetic oligonucleotide
cuugugugcuaauagcag

SEQ ID NO: 5665 - RNA, 18 nt, Artificial Sequence
  Description of Artificial Sequence: Synthetic oligonucleotide
cugugcuugugugcuaau

SEQ ID NO: 5666 - RNA, 18 nt, Artificial Sequence
  Description of Artificial Sequence: Synthetic oligonucleotide
gguuacugugcuugugug

SEQ ID NO: 5667 - RNA, 18 nt, Artificial Sequence
  Description of Artificial Sequence: Synthetic oligonucleotide
acuccgguuacugugcuu

SEQ ID NO: 5668 - RNA, 18 nt, Artificial Sequence
  Description of Artificial Sequence: Synthetic oligonucleotide
caagcacuccgguuacug

SEQ ID NO: 5669 - RNA, 18 nt, Artificial Sequence
  Description of Artificial Sequence: Synthetic oligonucleotide
uccuacaagcacuccggu

SEQ ID NO: 5670 - RNA, 18 nt, Artificial Sequence
  Description of Artificial Sequence: Synthetic oligonucleotide
gagcauccuacaagcacu

SEQ ID NO: 5671 - RNA, 18 nt, Artificial Sequence
  Description of Artificial Sequence: Synthetic oligonucleotide
cuacugagcauccuacaa

SEQ ID NO: 5672 - RNA, 18 nt, Artificial Sequence
  Description of Artificial Sequence: Synthetic oligonucleotide
guauccuacugagcaucc

SEQ ID NO: 5673 - RNA, 18 nt, Artificial Sequence
  Description of Artificial Sequence: Synthetic oligonucleotide
ccuggguauccuacugag

SEQ ID NO: 5674 - RNA, 18 nt, Artificial Sequence
  Description of Artificial Sequence: Synthetic oligonucleotide
gguaaccuggguauccua

SEQ ID NO: 5675 - RNA, 18 nt, Artificial Sequence
  Description of Artificial Sequence: Synthetic oligonucleotide
gagcagguaaccugggua

SEQ ID NO: 5676 - RNA, 18 nt, Artificial Sequence
  Description of Artificial Sequence: Synthetic oligonucleotide
agcacgagcagguaaccu

SEQ ID NO: 5677 - RNA, 18 nt, Artificial Sequence
  Description of Artificial Sequence: Synthetic oligonucleotide
cccugagcacgagcaggu

SEQ ID NO: 5678 - RNA, 18 nt, Artificial Sequence
  Description of Artificial Sequence: Synthetic oligonucleotide
gguagcccugagcacgag

SEQ ID NO: 5679 - RNA, 18 nt, Artificial Sequence
  Description of Artificial Sequence: Synthetic oligonucleotide
ccuuugguagcccugagc

SEQ ID NO: 5680 - RNA, 18 nt, Artificial Sequence
  Description of Artificial Sequence: Synthetic oligonucleotide
acgugccuuugguagccc

SEQ ID NO: 5681 - RNA, 18 nt, Artificial Sequence
  Description of Artificial Sequence: Synthetic oligonucleotide
acuuuacgugccuuuggu

SEQ ID NO: 5682 - RNA, 18 nt, Artificial Sequence
  Description of Artificial Sequence: Synthetic oligonucleotide
aaggaacuuuacgugccu

SEQ ID NO: 5683 - RNA, 18 nt, Artificial Sequence
  Description of Artificial Sequence: Synthetic oligonucleotide
uguggaaggaacuuuacg

SEQ ID NO: 5684 - RNA, 18 nt, Artificial Sequence
  Description of Artificial Sequence: Synthetic oligonucleotide
ggaucuguggaaggaacu

SEQ ID NO: 5685 - RNA, 18 nt, Artificial Sequence
  Description of Artificial Sequence: Synthetic oligonucleotide
aacuaauuuuuuuuuuuu

SEQ ID NO: 5686 - RNA, 18 nt, Artificial Sequence
  Description of Artificial Sequence: Synthetic oligonucleotide
ugcccaacuaauuuuuuu

SEQ ID NO: 5687 - RNA, 18 nt, Artificial Sequence
  Description of Artificial Sequence: Synthetic oligonucleotide
caccaugcccaacuaauu

SEQ ID NO: 5688 - RNA, 18 nt, Artificial Sequence
  Description of Artificial Sequence: Synthetic oligonucleotide
ugcagcaccaugcccaac

SEQ ID NO: 5689 - RNA, 18 nt, Artificial Sequence
  Description of Artificial Sequence: Synthetic oligonucleotide
aagugugcagcaccaugc

SEQ ID NO: 5690 - RNA, 18 nt, Artificial Sequence
  Description of Artificial Sequence: Synthetic oligonucleotide
aauguaagugugcagcac

SEQ ID NO: 5691 - RNA, 18 nt, Artificial Sequence
  Description of Artificial Sequence: Synthetic oligonucleotide
cugggaauguaagugugc

SEQ ID NO: 5692 - RNA, 18 nt, Artificial Sequence
  Description of Artificial Sequence: Synthetic oligonucleotide
aguagcugggaauguaag

SEQ ID NO: 5693 - RNA, 18 nt, Artificial Sequence
  Description of Artificial Sequence: Synthetic oligonucleotide
uccugaguagcugggaau

SEQ ID NO: 5694 - RNA, 18 nt, Artificial Sequence
  Description of Artificial Sequence: Synthetic oligonucleotide
uagccuccugaguagcug

SEQ ID NO: 5695 - RNA, 18 nt, Artificial Sequence
  Description of Artificial Sequence: Synthetic oligonucleotide
ugccuuagccuccugagu

SEQ ID NO: 5696 - RNA, 18 nt, Artificial Sequence
  Description of Artificial Sequence: Synthetic oligonucleotide
ucuccugccuuagccucc

SEQ ID NO: 5697 - RNA, 18 nt, Artificial Sequence
  Description of Artificial Sequence: Synthetic oligonucleotide
gggauucuccugccuuag

SEQ ID NO: 5698 - RNA, 18 nt, Artificial Sequence
  Description of Artificial Sequence: Synthetic oligonucleotide
cucaagggauucuccugc

SEQ ID NO: 5699 - RNA, 18 nt, Artificial Sequence
  Description of Artificial Sequence: Synthetic oligonucleotide
cagggcucaagggauucu

SEQ ID NO: 5700 - RNA, 18 nt, Artificial Sequence
  Description of Artificial Sequence: Synthetic oligonucleotide
aauuccagggcucaaggg

SEQ ID NO: 5701 - RNA, 18 nt, Artificial Sequence
  Description of Artificial Sequence: Synthetic oligonucleotide
ccucaaauuccagggcuc

SEQ ID NO: 5702 - RNA, 18 nt, Artificial Sequence
  Description of Artificial Sequence: Synthetic oligonucleotide
ugcugccucaaauuccag

SEQ ID NO: 5703 - RNA, 18 nt, Artificial Sequence
  Description of Artificial Sequence: Synthetic oligonucleotide
cucacugcugccucaaau

SEQ ID NO: 5704 - RNA, 18 nt, Artificial Sequence
  Description of Artificial Sequence: Synthetic oligonucleotide
cauagcucacugcugccu

SEQ ID NO: 5705 - RNA, 18 nt, Artificial Sequence
  Description of Artificial Sequence: Synthetic oligonucleotide
gcaaucauagcucacugc

SEQ ID NO: 5706 - RNA, 18 nt, Artificial Sequence
  Description of Artificial Sequence: Synthetic oligonucleotide
guguugcaaucauagcuc

SEQ ID NO: 5707 - RNA, 18 nt, Artificial Sequence
  Description of Artificial Sequence: Synthetic oligonucleotide
gugcaguguugcaaucau

SEQ ID NO: 5708 - RNA, 18 nt, Artificial Sequence
  Description of Artificial Sequence: Synthetic oligonucleotide
cuggagugcaguguugca

SEQ ID NO: 5709 - RNA, 18 nt, Artificial Sequence
  Description of Artificial Sequence: Synthetic oligonucleotide
ccaggcuggagugcagug

SEQ ID NO: 5710 - RNA, 18 nt, Artificial Sequence
  Description of Artificial Sequence: Synthetic oligonucleotide
guugcccaggcuggagug

SEQ ID NO: 5711 - RNA, 18 nt, Artificial Sequence
  Description of Artificial Sequence: Synthetic oligonucleotide
gcuuuguugcccaggcug

SEQ ID NO: 5712 - RNA, 18 nt, Artificial Sequence
  Description of Artificial Sequence: Synthetic oligonucleotide
gacucgcuuuguugccca

SEQ ID NO: 5713 - RNA, 18 nt, Artificial Sequence
  Description of Artificial Sequence: Synthetic oligonucleotide
acagggacucgcuuuguu

SEQ ID NO: 5714 - RNA, 18 nt, Artificial Sequence
  Description of Artificial Sequence: Synthetic oligonucleotide
aagagacagggacucgcu

SEQ ID NO: 5715 - RNA, 18 nt, Artificial Sequence
  Description of Artificial Sequence: Synthetic oligonucleotide
uuuuuaagagacagggac

SEQ ID NO: 5716 - RNA, 18 nt, Artificial Sequence
  Description of Artificial Sequence: Synthetic oligonucleotide
uuauuuuuuuaagagaca

SEQ ID NO: 5717 - RNA, 18 nt, Artificial Sequence
  Description of Artificial Sequence: Synthetic oligonucleotide
uguuauuauuuuuuuaag

SEQ ID NO: 5718 - RNA, 18 nt, Artificial Sequence
  Description of Artificial Sequence: Synthetic oligonucleotide
acuucuguuauuauuuuu

SEQ ID NO: 5719 - RNA, 18 nt, Artificial Sequence
  Description of Artificial Sequence: Synthetic oligonucleotide
cuaggacuucuguuauua

SEQ ID NO: 5720 - RNA, 18 nt, Artificial Sequence
  Description of Artificial Sequence: Synthetic oligonucleotide
cuuuucuaggacuucugu

SEQ ID NO: 5721 - RNA, 18 nt, Artificial Sequence
  Description of Artificial Sequence: Synthetic oligonucleotide
acaaacuuuucuaggacu

SEQ ID NO: 5722 - RNA, 18 nt, Artificial Sequence
  Description of Artificial Sequence: Synthetic oligonucleotide
aacacacaaacuuuucua

SEQ ID NO: 5723 - RNA, 18 nt, Artificial Sequence
  Description of Artificial Sequence: Synthetic oligonucleotide
aaaucaacacacaaacuu

SEQ ID NO: 5724 - RNA, 18 nt, Artificial Sequence
  Description of Artificial Sequence: Synthetic oligonucleotide
aaaguaaaucaacacaca

SEQ ID NO: 5725 - RNA, 18 nt, Artificial Sequence
  Description of Artificial Sequence: Synthetic oligonucleotide
auguaaaaguaaaucaac

SEQ ID NO: 5726 - RNA, 18 nt, Artificial Sequence
  Description of Artificial Sequence: Synthetic oligonucleotide
uuuuaauguaaaaguaaa

SEQ ID NO: 5727 - RNA, 18 nt, Artificial Sequence
  Description of Artificial Sequence: Synthetic oligonucleotide
uauacuuuuaauguaaaa

SEQ ID NO: 5728 - RNA, 18 nt, Artificial Sequence
  Description of Artificial Sequence: Synthetic oligonucleotide
ugccauauacuuuuaaug

SEQ ID NO: 5729 - RNA, 18 nt, Artificial Sequence
  Description of Artificial Sequence: Synthetic oligonucleotide
caacaugccauauacuuu

SEQ ID NO: 5730 - RNA, 18 nt, Artificial Sequence
  Description of Artificial Sequence: Synthetic oligonucleotide
cugcucaacaugccauau

SEQ ID NO: 5731 - RNA, 18 nt, Artificial Sequence
  Description of Artificial Sequence: Synthetic oligonucleotide
uuacgcugcucaacaugc

SEQ ID NO: 5732 - RNA, 18 nt, Artificial Sequence
  Description of Artificial Sequence: Synthetic oligonucleotide
uauauuuacgcugcucaa

SEQ ID NO: 5733 - RNA, 18 nt, Artificial Sequence
  Description of Artificial Sequence: Synthetic oligonucleotide
uuuucuauauuuacgcug

SEQ ID NO: 5734 - RNA, 18 nt, Artificial Sequence
  Description of Artificial Sequence: Synthetic oligonucleotide
uacacuuuucuauauuua

SEQ ID NO: 5735 - RNA, 18 nt, Artificial Sequence
  Description of Artificial Sequence: Synthetic oligonucleotide
uucccuacacuuuucuau

SEQ ID NO: 5736 - RNA, 18 nt, Artificial Sequence
  Description of Artificial Sequence: Synthetic oligonucleotide
cagucuucccuacacuuu

SEQ ID NO: 5737 - RNA, 18 nt, Artificial Sequence
  Description of Artificial Sequence: Synthetic oligonucleotide
cugcucagucuucccuac

SEQ ID NO: 5738 - RNA, 18 nt, Artificial Sequence
  Description of Artificial Sequence: Synthetic oligonucleotide
acuuccugcucagucuuc

SEQ ID NO: 5739 - RNA, 18 nt, Artificial Sequence
  Description of Artificial Sequence: Synthetic oligonucleotide
ggaguacuuccugcucag

SEQ ID NO: 5740 - RNA, 18 nt, Artificial Sequence
  Description of Artificial Sequence: Synthetic oligonucleotide
ccaaaggaguacuuccug

SEQ ID NO: 5741 - RNA, 18 nt, Artificial Sequence
  Description of Artificial Sequence: Synthetic oligonucleotide
cagucccaaaggaguacu

SEQ ID NO: 5742 - RNA, 18 nt, Artificial Sequence
  Description of Artificial Sequence: Synthetic oligonucleotide
ucuuucagucccaaagga

SEQ ID NO: 5743 - RNA, 18 nt, Artificial Sequence
  Description of Artificial Sequence: Synthetic oligonucleotide
ugaggucuuucaguccca

SEQ ID NO: 5744 - RNA, 18 nt, Artificial Sequence
  Description of Artificial Sequence: Synthetic oligonucleotide
cuuccugaggucuuucag

SEQ ID NO: 5745 - RNA, 18 nt, Artificial Sequence
  Description of Artificial Sequence: Synthetic oligonucleotide
uaagacuuccugaggucu

SEQ ID NO: 5746 - RNA, 18 nt, Artificial Sequence
  Description of Artificial Sequence: Synthetic oligonucleotide
aggaauaagacuuccuga

SEQ ID NO: 5747 - RNA, 18 nt, Artificial Sequence
  Description of Artificial Sequence: Synthetic oligonucleotide
aucaaaggaauaagacuu

SEQ ID NO: 5748 - RNA, 18 nt, Artificial Sequence
  Description of Artificial Sequence: Synthetic oligonucleotide
gugccaucaaaggaauaa

SEQ ID NO: 5749 - RNA, 18 nt, Artificial Sequence
  Description of Artificial Sequence: Synthetic oligonucleotide
auuuugugccaucaaagg

SEQ ID NO: 5750 - RNA, 18 nt, Artificial Sequence
  Description of Artificial Sequence: Synthetic oligonucleotide
ggagaauuuugugccauc

SEQ ID NO: 5751 - RNA, 18 nt, Artificial Sequence
  Description of Artificial Sequence: Synthetic oligonucleotide
uacuuggagaauuuugug

SEQ ID NO: 5752 - RNA, 18 nt, Artificial Sequence
  Description of Artificial Sequence: Synthetic oligonucleotide
uuccauacuuggagaauu

SEQ ID NO: 5753 - RNA, 18 nt, Artificial Sequence
  Description of Artificial Sequence: Synthetic oligonucleotide
aauaauuccauacuugga

SEQ ID NO: 5754 - RNA, 18 nt, Artificial Sequence
  Description of Artificial Sequence: Synthetic oligonucleotide
uagcuaauaauuccauac

SEQ ID NO: 5755 - RNA, 18 nt, Artificial Sequence
  Description of Artificial Sequence: Synthetic oligonucleotide
uaucauagcuaauaauuc

SEQ ID NO: 5756 - RNA, 18 nt, Artificial Sequence
  Description of Artificial Sequence: Synthetic oligonucleotide
auuuuuaucauagcuaau

SEQ ID NO: 5757 - RNA, 18 nt, Artificial Sequence
  Description of Artificial Sequence: Synthetic oligonucleotide
aaaacauuuuuaucauag

SEQ ID NO: 5758 - RNA, 18 nt, Artificial Sequence
  Description of Artificial Sequence: Synthetic oligonucleotide
gcggcaaaacauuuuuau

SEQ ID NO: 5759 - RNA, 18 nt, Artificial Sequence
  Description of Artificial Sequence: Synthetic oligonucleotide
aacuagcggcaaaacauu

SEQ ID NO: 5760 - RNA, 18 nt, Artificial Sequence
  Description of Artificial Sequence: Synthetic oligonucleotide
ccccaaacuagcggcaaa

SEQ ID NO: 5761 - RNA, 18 nt, Artificial Sequence
  Description of Artificial Sequence: Synthetic oligonucleotide
aguccccccaaacuagcg

SEQ ID NO: 5762 - RNA, 18 nt, Artificial Sequence
  Description of Artificial Sequence: Synthetic oligonucleotide
ccaugaguccccccaaac

SEQ ID NO: 5763 - RNA, 18 nt, Artificial Sequence
  Description of Artificial Sequence: Synthetic oligonucleotide
ugcuaccaugaguccccc

SEQ ID NO: 5764 - RNA, 18 nt, Artificial Sequence
  Description of Artificial Sequence: Synthetic oligonucleotide
gaaacugcuaccaugagu

SEQ ID NO: 5765 - RNA, 18 nt, Artificial Sequence
  Description of Artificial Sequence: Synthetic oligonucleotide
guaaugaaacugcuacca

SEQ ID NO: 5766 - RNA, 18 nt, Artificial Sequence
  Description of Artificial Sequence: Synthetic oligonucleotide
acaagguaaugaaacugc

SEQ ID NO: 5767 - RNA, 18 nt, Artificial Sequence
  Description of Artificial Sequence: Synthetic oligonucleotide
gcauuacaagguaaugaa

SEQ ID NO: 5768 - RNA, 18 nt, Artificial Sequence
  Description of Artificial Sequence: Synthetic oligonucleotide
uucaugcauuacaaggua

SEQ ID NO: 5769 - RNA, 18 nt, Artificial Sequence
  Description of Artificial Sequence: Synthetic oligonucleotide
uucuguucaugcauuaca

SEQ ID NO: 5770 - RNA, 18 nt, Artificial Sequence
  Description of Artificial Sequence: Synthetic oligonucleotide
aucuguucuguucaugca

SEQ ID NO: 5771 - RNA, 18 nt, Artificial Sequence
  Description of Artificial Sequence: Synthetic oligonucleotide
uguccaucuguucuguuc

SEQ ID NO: 5772 - RNA, 18 nt, Artificial Sequence
  Description of Artificial Sequence: Synthetic oligonucleotide
auggauguccaucuguuc

SEQ ID NO: 5773 - RNA, 18 nt, Artificial Sequence
  Description of Artificial Sequence: Synthetic oligonucleotide
caggaauggauguccauc

SEQ ID NO: 5774 - RNA, 18 nt, Artificial Sequence
  Description of Artificial Sequence: Synthetic oligonucleotide
acagccaggaauggaugu

SEQ ID NO: 5775 - RNA, 18 nt, Artificial Sequence
  Description of Artificial Sequence: Synthetic oligonucleotide
ugaauacagccaggaaug

SEQ ID NO: 5776 - RNA, 18 nt, Artificial Sequence
  Description of Artificial Sequence: Synthetic oligonucleotide
acacaugaauacagccag

SEQ ID NO: 5777 - RNA, 18 nt, Artificial Sequence
  Description of Artificial Sequence: Synthetic oligonucleotide
caacaacacaugaauaca

SEQ ID NO: 5778 - RNA, 18 nt, Artificial Sequence
  Description of Artificial Sequence: Synthetic oligonucleotide
aacaacaacaacacauga

SEQ ID NO: 5779 - RNA, 18 nt, Artificial Sequence
  Description of Artificial Sequence: Synthetic oligonucleotide
acaauaacaacaacaaca

SEQ ID NO: 5780 - RNA, 18 nt, Artificial Sequence
  Description of Artificial Sequence: Synthetic oligonucleotide
uuaaaacaauaacaacaa

SEQ ID NO: 5781 - RNA, 18 nt, Artificial Sequence
  Description of Artificial Sequence: Synthetic oligonucleotide
aacaauuaaaacaauaac

SEQ ID NO: 5782 - RNA, 18 nt, Artificial Sequence
  Description of Artificial Sequence: Synthetic oligonucleotide
ugggaauucaaccaauaa

SEQ ID NO: 5783 - RNA, 18 nt, Artificial Sequence
  Description of Artificial Sequence: Synthetic oligonucleotide
guugcugggaauucaacc

SEQ ID NO: 5784 - RNA, 18 nt, Artificial Sequence
  Description of Artificial Sequence: Synthetic oligonucleotide
caccuguugcugggaauu

SEQ ID NO: 5785 - RNA, 18 nt, Artificial Sequence
  Description of Artificial Sequence: Synthetic oligonucleotide
cacaccaccuguugcugg

SEQ ID NO: 5786 - RNA, 18 nt, Artificial Sequence
  Description of Artificial Sequence: Synthetic oligonucleotide
ggaaucacaccaccuguu

SEQ ID NO: 5787 - RNA, 18 nt, Artificial Sequence
  Description of Artificial Sequence: Synthetic oligonucleotide
aagauggaaucacaccac

SEQ ID NO: 5788 - RNA, 18 nt, Artificial Sequence
  Description of Artificial Sequence: Synthetic oligonucleotide
uugccaagauggaaucac

SEQ ID NO: 5789 - RNA, 18 nt, Artificial Sequence
  Description of Artificial Sequence: Synthetic oligonucleotide
ugaaauugccaagaugga

SEQ ID NO: 5790 - RNA, 18 nt, Artificial Sequence
  Description of Artificial Sequence: Synthetic oligonucleotide
aaggcugaaauugccaag

SEQ ID NO: 5791 - RNA, 18 nt, Artificial Sequence
  Description of Artificial Sequence: Synthetic oligonucleotide
cuuuaaaggcugaaauug

SEQ ID NO: 5792 - RNA, 18 nt, Artificial Sequence
  Description of Artificial Sequence: Synthetic oligonucleotide
aucagcuuuaaaggcuga

SEQ ID NO: 5793 - RNA, 18 nt, Artificial Sequence
  Description of Artificial Sequence: Synthetic oligonucleotide
aucggaucagcuuuaaag

SEQ ID NO: 5794 - RNA, 18 nt, Artificial Sequence
  Description of Artificial Sequence: Synthetic oligonucleotide
gacauaucggaucagcuu

SEQ ID NO: 5795 - RNA, 18 nt, Artificial Sequence
  Description of Artificial Sequence: Synthetic oligonucleotide
guugugacauaucggauc

SEQ ID NO: 5796 - RNA, 18 nt, Artificial Sequence
  Description of Artificial Sequence: Synthetic oligonucleotide
caaaaguugugacauauc

SEQ ID NO: 5797 - RNA, 18 nt, Artificial Sequence
  Description of Artificial Sequence: Synthetic oligonucleotide
gaaaucaaaaguugugac

SEQ ID NO: 5798 - RNA, 18 nt, Artificial Sequence
  Description of Artificial Sequence: Synthetic oligonucleotide
aggaagaaaucaaaaguu

SEQ ID NO: 5799 - RNA, 18 nt, Artificial Sequence
  Description of Artificial Sequence: Synthetic oligonucleotide
cugccaggaagaaaucaa

SEQ ID NO: 5800 - RNA, 18 nt, Artificial Sequence
  Description of Artificial Sequence: Synthetic oligonucleotide
acaggcugccaggaagaa

SEQ ID NO: 5801 - RNA, 18 nt, Artificial Sequence
  Description of Artificial Sequence: Synthetic oligonucleotide
aucucacaggcugccagg

SEQ ID NO: 5802 - RNA, 18 nt, Artificial Sequence
  Description of Artificial Sequence: Synthetic oligonucleotide
agauaaucucacaggcug

SEQ ID NO: 5803 - RNA, 18 nt, Artificial Sequence
  Description of Artificial Sequence: Synthetic oligonucleotide
acaaaagauaaucucaca

SEQ ID NO: 5804 - RNA, 18 nt, Artificial Sequence
  Description of Artificial Sequence: Synthetic oligonucleotide
aagaaacaaaagauaauc

SEQ ID NO: 5805 - RNA, 18 nt, Artificial Sequence
  Description of Artificial Sequence: Synthetic oligonucleotide
agauaaagaaacaaaaga

SEQ ID NO: 5806 - RNA, 18 nt, Artificial Sequence
  Description of Artificial Sequence: Synthetic oligonucleotide
guaaaagauaaagaaaca

SEQ ID NO: 5807 - RNA, 18 nt, Artificial Sequence
  Description of Artificial Sequence: Synthetic oligonucleotide
acauaguaaaagauaaag

SEQ ID NO: 5808 - RNA, 18 nt, Artificial Sequence
  Description of Artificial Sequence: Synthetic oligonucleotide
ccaccacauaguaaaaga

SEQ ID NO: 5809 - RNA, 18 nt, Artificial Sequence
  Description of Artificial Sequence: Synthetic oligonucleotide
cucuuccaccacauagua

SEQ ID NO: 5810 - RNA, 18 nt, Artificial Sequence
  Description of Artificial Sequence: Synthetic oligonucleotide
aauaucucuuccaccaca

SEQ ID NO: 5811 - RNA, 18 nt, Artificial Sequence
  Description of Artificial Sequence: Synthetic oligonucleotide
uuuccaauaucucuucca

SEQ ID NO: 5812 - RNA, 18 nt, Artificial Sequence
  Description of Artificial Sequence: Synthetic oligonucleotide
gcgaauuuccaauaucuc

SEQ ID NO: 5813 - RNA, 18 nt, Artificial Sequence
  Description of Artificial Sequence: Synthetic oligonucleotide
ugaaugcgaauuuccaau

SEQ ID NO: 5814 - RNA, 18 nt, Artificial Sequence
  Description of Artificial Sequence: Synthetic oligonucleotide
guuugugaaugcgaauuu

SEQ ID NO: 5815 - RNA, 18 nt, Artificial Sequence
  Description of Artificial Sequence: Synthetic oligonucleotide
guguaguuugugaaugcg

SEQ ID NO: 5816 - RNA, 18 nt, Artificial Sequence
  Description of Artificial Sequence: Synthetic oligonucleotide
aaauaguguaguuuguga

SEQ ID NO: 5817 - RNA, 18 nt, Artificial Sequence
  Description of Artificial Sequence: Synthetic oligonucleotide
uccugaaauaguguaguu

SEQ ID NO: 5818 - RNA, 18 nt, Artificial Sequence
  Description of Artificial Sequence: Synthetic oligonucleotide
gaaacuccugaaauagug

SEQ ID NO: 5819 - RNA, 18 nt, Artificial Sequence
  Description of Artificial Sequence: Synthetic oligonucleotide
uuccagaaacuccugaaa

SEQ ID NO: 5820 - RNA, 18 nt, Artificial Sequence
  Description of Artificial Sequence: Synthetic oligonucleotide
gacaauuccagaaacucc

SEQ ID NO: 5821 - RNA, 18 nt, Artificial Sequence
  Description of Artificial Sequence: Synthetic oligonucleotide
auccagacaauuccagaa

SEQ ID NO: 5822 - RNA, 18 nt, Artificial Sequence
  Description of Artificial Sequence: Synthetic oligonucleotide
acaacauccagacaauuc

SEQ ID NO: 5823 - RNA, 18 nt, Artificial Sequence
  Description of Artificial Sequence: Synthetic oligonucleotide
cgaucacaacauccagac

SEQ ID NO: 5824 - RNA, 18 nt, Artificial Sequence
  Description of Artificial Sequence: Synthetic oligonucleotide
cacaacgaucacaacauc

SEQ ID NO: 5825 - DNA, 3638 bp, Homo sapiens
ttggatctacacaagtgaaaaagacttgaatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcaggtgtgtactgaggacatgcatccctcctatttctgtgtggttgtacatacatcctattctggggttagccagaaaaacctttgcctgcagttagctacatgaggatgccaaggacccagacggatagcaagggaggggtaaaaactgaaggcttaccgaaataaaggatatttgaggaagggagttgggatcctagaatattacgagttggaaagaaccataactctggtccaagttcatctcaatgctggaacctttccagaaaaagtattgtgtttttctaacatctgtctttacccattataaggatggttagtgccacatgttccatcaccaagtcccccggccatcaaatcttgactcatttcctggagtttctcactctcagatgagcctctgctattagcacacaagcacagtaaccggagtgcttgtaggatgctcagtaggatacccaggttacctgctcgtgctcagggctaccaaaggcacgtaaagttccttccacagatcctgggatgttgccatgatgacccctctgtgagatagtaacaaaaatgacaaagattccactggcttgtctgggactcttcttcattcatttattcagcaaacattcattggacacttaatatgggctaggcattgttctcggctcttgggacatgtcagcaaacaaaataaagatccgcaccttggcagagcttgcatccaaccaggaggagactagagaataaacattaaacaatacaaataaatagtatagtatattagaaggtaataggtactattaaaaagaaagaaaaagcagagcaagaggaagtcagagttcacccactttaatcttcctggtgagcatgtcagcaacacccaaacatcactaacatggattattgcatgtatatttacacataagataagaagtgtttattctcataatagtctttgtcatcattcttgaggttaagttcaattctgctttatgtggcttgttggattgtcccagtccttgtatttaacaacatttgcagaaaatagtaccacattaaatcaattatagattatcccttatccaaaatgcttaagaccagaatgtttgagatttaagaaatttttcaggttttggaatgtctgcatatatataatgagatatcttggggatgggacccaagtctaaacacaaaattcatttatgtttcataaatgaaacttaatgcacatagcctgaaggaaattttatttttcccttagggatgttgaatcaactgttgtgtgccagcatgttgacaatgacctgtcacatgaagtcgggtgtggaattttccacttgtgcgttcatggcggtgctcagaaagtttgggattttgaagcattttatatttcagattttcacattagaaatactcaagctgtccttgctcacagtggccaaaaaaaaagaaagaaagaaaagaaatactcaaccagtagtccagtagtagttatcactagaaatgaatgaaaatctattgcagtattattgagtttttcctaattattccagtgcagataaaaagaaaagaataaaaaggaagagaataaaaacagagaggcaactctgatattttagtaaattctatttatagaaggtcttgagtatttcttctgcttcctcccttactttaaggatgaacattgttaagacaactgcttcatttctctatactgtttttctaagtttctggaagtggttgactactgcagggccagaatgggccagagaaatgacttgacacttgaaggccacttccttcccttttgagttcccaatgaagctgtcacatacaaggctcttggcttcagagttgctctcctgagtttttgattctcacccctactctctaacacatcaaataggaaagaaagaacaggagaactgacaatgaaaaggaaggaaaattttcacacttctctgaccagttctaatttaccatagtcctgtttttacttgattattgctcatgcatgtgtcctgtatgctcaggttccaggtgcggctacctgtcctgtaatggcagagatagtgatggctagtagctgactaaagggcttttaaatgtctcaaaatgaagcagctagagattctatttctagttagaaaagaagtctgtatcattaactgaatcacccagctttctcagtgtgacacctacaaaatgggcatttgacaagaaaaaaaccctcagtccagttatggtaaagcagtaaagatcagagccatcagtatggatgtaaaatagtgtatgttttagacaatcagacatctattgagtacccacctattaactataaggctctgggaagaagagagaaaactaccctggaggacaaactatttgatgctatttaggtgttacataatgaatgaatgactcagttcctatctttatatatgtacaaaatatatcctacttctcaaccagattacacatgttttgagtggatggtttatatttctttatattcttcatgttgcctagtagaaggacttgaatttaatagaagtcctagggccaggcatggtggctccttcctgtaattccagcactctgaaaggcccaggcaggaggatcatttgagcccaggagtttgagaccaacctgggcaaaagggcaagactcagtctctgccaaaaaaaaaaaaattagttgggcatggtgctgcacacttacattcccagctactcaggaggctaaggcaggagaatcccttgagccctggaatttgaggcagcagtgagctatgattgcaacactgcactccagcctgggcaacaaagcgagtccctgtctcttaaaaaaataataacagaagtcctagaaaagtttgtgtgttgatttacttttacattaaaagtatatggcatgttgagcagcgtaaatatagaaaagtgtagggaagactgagcaggaagtactcctttgggactgaaagacctcaggaagtcttattcctttgatggcacaaaattctccaagtatggaattattagctatgataaaaatgttttgccgctagtttggggggactcatggtagcagtttcattaccttgtaatgcatgaacagaacagatggacatccattcctggctgtattcatgtgttgttgttgttattgttttaattgttcttatttacatgcaggttattggttgaattcccagcaacaggtggtgtgattccatcttggcaatttcagcctttaaagctgatccgatatgtcacaacttttgatttcttcctggcagcctgtgagattatcttttgtttctttatcttttactatgtggtggaagagatattggaaattcgcattcacaaactacactatttcaggagtttctggaattgtctggatgttgtgatcgttgtg

SEQ ID NO: 5826 - DNA, 31777 bp, Homo sapiens
gacagcggcgtggcggcggcggtggcggtagcgacggcacgccgtagggcggtcagaaggtttccggttccggtgtaacgttcgggctccgtctcaggggctgaagtttgtgaggtgagtagtggccccgggcccacagagggtaattccagtccgcgccactgtggccggggactcagtccaaggggaggaccgaagcgggagggttcagcgggaaggagtgtgaaaggagtacctggtttggtgggagaagaggttggaatgagattgttgagaggaaaagggcgggggcgggaaggagaccgggttgggagaccagctctggggtgaggagtttaggtagaacaaggtagagtaagagactggttggagtgacggagagagtaaaaatgaagattagcgggggagtggggggctgcagagggaaactcaggttgtagcaaacaagagcacggagtaaggaattccttctgaagactggatttggattctgctgcctgctcattgagaggagagatcattgtacctcgctttccttccgcacccccactacccccgcacctcgcagttattgttgagcatttgattagtgacaaggctaattaccgtttgaaacttttttatccattggctgtttagtttgcacgtcatcttatggaggtaacagtggcacctcatttattgctttgggctttcaaattgcttatactttctagcctatcattcaattctagtggaatataagacccgttaaggtgaggactcttgttagttttgctcactgttttatgtatccaccgcacctagtacattgcttgacacttagtagttactcaataaatatttattgaatgaattaggatgtaaatatggcagtactcattttgtaagatggtaaactgtggctccaaagaattacttaacttgcccaagggcttgtaaatggtggggctcagtgtcccaactgtttctgtgtgaactcttgttttcactttctatggcatctggatatgccgcttttgtgcaatacatgtgtaatatgtagaaattggtacgctgtatgtctactcattgtggggtaatagaaccaccatagaattactcacgtaacttgtcactgaggcagaaaatctttcagtcttagtttcatcacttcaatctactagcttcctttggatataccaaaagtgagtctatttggcagcaagtcttatagactctagtatagaggctaaacttaccaagaatgtagaagttaatcagactggattttttggagaaaagatgtcttaaaacatcttgaaagatgattcccagatctttgataagtggcactgctgggaatagctgagcttggaaattgaggtcagtcaatttattgactcccatttagacacctttttttttttttccccgggacggagtcttgctctgtcgcccaggctggagtgcagtggtgcgatctcggctcactgcaacctccgccttccatgttcaagggattctcctgtctcagcctccagagtagctgggattacaggtgcaggtcaccacgcccagctaatatttgtatttttaatagggatgcggtttcaccatgttggccaggctggtctcgaactcctgacgtcagataatccacccgccttggcctcccaaagtgttgggattacaggcgtgagccaccgcacctggctttttttttttttttttttttttttttggagacacagtttcactctgtcgctcaggctggagtgcacatgattttggctcaccgcaacctccgcctcctgggttcaagtgattttcctgcctctgcctcataagtagctgggattacaggtgcccaccacctcacctggctaatttttgtatttttagtagagacaggtgcagtgggtcacgcctgtaatcccagaactttcggaggtcaaggtgggcagatcacttgaggtaaggcattacctggccgatatggtgaaaccgtgtctttattaaaactacgaaattggccaggcgtggtggtgcatgcctgtagtcccagctacttgggaggctgaggcaggagaatcaagtgaacccaggagatggaggttgcagtgaaccaagattacgccactgcactccagcctgggcgacggagtgagactgtctcaaaataaaaatgagggtattcttttctgagctgaaggatcatcaagtcagctgatggagaccctgtagattgaacatgataattacctgtatgcagaattcccactgggatgaatatgaccacagagaaatgtgacagaacattctttttttttttttttttgagacggagtcttactctgttgcccaggctggagtgcagtggcgcgatctcggctcactgcaacctctgctgcctgggttcaagtgattctcttgtctcagcctcccgagtagctgggattacaggcgcctgccaccatgcccagctaaatttttttgtagtttttagtagagatggggtttcaccatcttggccaggctggtcttgaactcctgacctcgtgatccacctgcctcagcctcccaaagtgctgggattacaggcgtgagccaccgcgcccggccagaacattcttaaagatcatgagatttaatttaatatctaagatgactgacctggataaaccctcttttacttgcataccttaaaagaagggaatcctacataagtcagggttgggttagggaatgcctgcctggaagtaggaagaatggaaaagctggcctctggatgggcttttttagttctgttttagtgttactaggtttgcaagtccttgttgatatgacaggatcaagaaagaagctagaactaatttctcagacttagcttattcacagagtttgtttattccgcagatttcattgatcaacttaagagttagaattaaaaatcaaatgggatctctttctgctttgagatatggttcttggggaaaatatttgccttcaaatgagttggaaaaacttgtctagggattgagaatagggctggggaatgcattcctgatgtactaaccatttccctggatcactttagtcttttttttttttttgagagagagtcttgctttgtcgcccaggctggagtgcagtggtgcgattttgacttgttgcaagctctacctccctggttattcccctgcctcagcctcccaagtagctgggattacaggcacatgccaccacgcccagctaatttttttgtatttttagtagaggcagggtttcaccatgttggccagactggtctcgaactcttgaccccaggcagtccatccaccttggcctcccaaagtgctgggattacaggcatgagccactgcacccagcccactttagtcttttcttattctctaacttgtctcttttttttttttttttaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccggtatgtacctttctgcatcttttatcttaacatatagggtgaccccaaacactgctttgaacttcctcaaaattctctctgttgggaacatctaaaaaaatggcaggccatattttattttcacctgtattatagtgaaaataggctaaataataatttgctttttctcttaattgcttattttttatgttatttatgatagattttaaatcttcgtttggctaccatactgagtcacctaagttagatttacttaggaagtatgcttaagtcagataggcatattcagattcagactgaacatctcaacatacaaaaatctttatgaaatacatgaaaaagcttgaaggaggtagattttgttaatggtaggcttctacaacttgctatttgggaaaggtgagggtggttattcatctcaaacttgatgttcaaggtaaacaggttgctctaactgcaccacttcccacgccaaaaaattataactattttcacctcacagggcaaggtcatttagtgtaagagagatgggaatcctacaaaaaacttaaaatttgtttcactcctgggaataaaattccagtgttggtacctgttataggcctagtattagactgtgtactcttacctttccaaccctaccaccgcctttcttcctgtcagatcatctgaaaccttttcttgatgattctactctccgatttgtggacaaactgtttgaggctgtggaggaaggccgaagctctaggcattccaagtctagcagtgacaggagcagaaaacgagagctaaaggtaggttacaatttactgtctaatgagctcaggactgttttgaatggtaacagagttgctgagcttaccagttcacacgttgatatcctctatttagagcagcaaatgttcaagagaggtacttagacattagagtaggagagatgaattagtgtcatcaccatctgaactacctctaagttcatgggttgaaatatccaaagaaataattggcagctttgtctttttttagataacaggagttttgattctcatgtttctccatatttcctttttttccttcttactgttacttataaactgattgctctaagattttatctttgatttatttgaggcctaataagttgttttagaatgtgactccactggtacctgagctgtacacctcattgttgcctctttgtagaagtttctctgcaatgcacttgtagatagaataccaaaaaataactattatttattatattcttgagagcttaccatttgctctatggcatattgctggtcctctgctgccatgagtgaaacacttggaggagttgtcagtacccccttaactactacactttttattctgtagttgccgactgatcctggcctctttcagtattagcagtatcaagtagcctatttttctactcatttcccagtatctctctttaggagaaaaaaaaaagttctgtgactcctatcaaaccttccaaagttcttctgataccttggctatcccattacttttcctgagggaaaagagtgaataagtaatgtctgcttggtcccctggccaggctatggaactaaagaaaaaaagcagagagatttgtgccctttgtgtttggagcattgtagggtggtcagagaaggagagatagtccttgccttaaaacaatttgtaatttgtcaggcagtgtggcatgtgcctgtaatcctagctacttgggaagctgaggcaagaggatctcttgagcccaggagttacaatttagaagaggcaggggtatcacaaaatatatattcacgtattataaaatctaagtagcagtttcatgtaaattttagggttggttatagaatttcagacctatgttgaattttgttatatttaaggtggaatgattgatccacagtatacacagatctgtacagtgaagattatgtcacgatagggcatacttctttttttttttccttttttttttttcaagggtgagtctcactctgtcgcccaggctggagtacagtagcgcaatcttgactcactgcaacttccacctcccaggttcaagtgattctcctgcctcagcctcctgagtagctgggattacaggcacatgccaccatgcctggctaatttttgtatttttagtagagacggggtttcatcatgttgatcaggttggtctcgaactcctgacctcaagatctgctcgcctcggcctcccaaagtgctggaattacaggcatgagccactgcgcctggccagtagggcatacttctgtatgagtgctgagggcatgctgtgaatgaagtgactacattgggtgggattaataaaaatggcttcttgaaggaggtgtctagatagccttgggatacgggtcccatttttggtccattcaggtccccaccccacacaatatattatgggagagtcctttttcttgaactgtaggagttccaggaagcgctcgcccctggccgaggatatgtccttgcaaaacacgagccctcctagtgaagaggggatgtcacccaaagcctaccaccggtgtgtacatttgctttttcccattgtcccttccagttggccactctcggtcctgttaaattcaccttgcaaattagtcatcatatttgagtttccattgtttgatgaaaacaaagtgttaatggggattactgaagaagaaagagaaagcccctgtcctggaagagcttagacttagttgggaaaactatactaacattgaaatacttaacacttggcaaacagaatatcaacaatgtaatttaacctaatatgaaccaagctcttacacgctaagagaatgtgaaacaaaagtttaatcagagtgggataggttataatgaggaaaacttcttggaggaggtgagttttaggcaggatttggaacaggggttgtggaaaagttgagagaaatcattataaatgtgagcagtagcatttgcaaagaccttgagatgggaacatttataagaacatgggaatgaaatttgtttgactggattaggagaatgttgaagttgggtgagatggagagtctagtagaccctgcttctggcaggtggctatttgcaaggttgtgtcatattcccctgggaatagccagaaaatgctggtaggggctaggataattcttcctttctccccacggggagggatacagcttttctttcatcttgggttcccttaggaggtgtttggtgatgactctgagatctctaaagaatcatcaggagtaaagaagcgacgaataccccgttttgaggaggtggaagaagagccagaggtgatccctgggcctccatcagagagccctggcatgctgactaagctccaggttagtgattagggactggaagcaaagtggttttgtgagttgaagaagcaaaaggtgcatgggtctgtatttattgtggaattttttttttttttttttttttttttgaggtggagttttgctcttgtcacccaggctggaatacagtggcgcgatctcagctcactgcaacctccgcctcccgggttcaagcaaatctcctgtctcagcctactgagtagctgggattagaggcacccaccaccaagcctggctaatttttgtatttttagtagagatggggtttcaccatgttggccaggctggtcttgaactcctgatgtcaggtgatgcactcaccttggcctctcagagtgctagaattacaggagcgagccactgcgcccggctaattttttgtatttcttttagtagagacagggtttcaccatgttgggcaggctggtcttcaacttctgacctcaggtcatctgcccaccttcgcctcccagagtgctgggattataggcgtgagccagcgtgcctcgccttattgtgatcttgatttgaattagtgtttagcatttggggaaactttttttttttttttttgagatagagtttcactctgttgcccatgctggagtgtagtggcgtgatctcagctcacggcaacctccacctcccaggttcaagcgattctcctgcctaagcctccggagtagctgggactacatgcgaacaccactacgcctggctaatttttgtatttttagtacagatggtattttgtcatgttggccaggctgctctggaactcctggcctcaagtgatctgccacctcagccgcccaaatggctgggattacaggtgtgagccaccatgccaggccagcatttgggaaaattttatttcctgctttatgttttagcgttctttgatttgaccaggagtattctaggtaagggtattgaaattgccatttactgtggcaagcaaagtgtgttatgtacattatttgcctaattacctatgtcgttgagtcattgagaaaattaaatgaaatgatcagaactcatcttaatgacagaggagactctccaaacataatgcaaagaagatataatccactgataaataattttaagttgactttatttttttttaacaggaagtatttgtgttttttcaattggcattgttaaataataccacataagtgtttcttttaccatttaatatttgaggggggtaatagaacatatacagaaatatgggtgggtggatttgcatatatgtgatatttacagaaggaaagaaatggattttttttgtgtgtgtgtgtgagatgttctctctgtcactcaggctggagcgcagtggtgcgatctcggttcactgcagcctctgcctcccaggttcaagtgattctcctgcctcagcctcctaagtagctgggattataggcatgtgccaccacgcacggctaatttttgtatttttagtagagacagggtttcaccatgttgaccaggctggtctggaactcctgacctcaagtgatctgcctaccttggcctcccaaattgctgggattataggcgtgagccaccgtacctagcctgtttttgtttttcaggcaaggtctcacttttttgtccaggctggagttcagtggcgagatcttggcttactgcaacctctgcctcccgggcttgagtgatcctcccaccttggcttcccaagtagctgggactacaggtcaccatgcctggctgatttttgtattttttttaaagattgagttccaccatgttgcccaggctggtcttgaactcctgggctgaaatgatcctcctgcctcagcctcccaaagtgctggacttacaggcgtgagctaccacgcccagccaattattttcttttttggggggtgggggatggagtcttgctctgtcacttaggctggagtacggtggcgcgttctcggctcactgcaacctctgcctcccgggttcacgccattctcctgcctcagcctcctgagtagctgggactacaggtatgtaccaccatgcccgactaattttttgtatttttagtagagatggggtttcaccatgttagccaggatggtcttgatctcctgacctcgtgatccacccgcctcggcctcccaaagtgctgggattacaggcatgagccaccgtgccaggcccaatgatgttttttatggagaatggggatggacgtattcacaacatatccttttgttatgtttctttctttttttttttttgagacggagtctcactctgtcgcccagagtggagtgtaatggcgctatctcggctcactgcaacgtccgcctcccgggttcaagctattcttctgcctcagtcccttgagtagctgggattacaggcacgcgccaccacgcctagctaatttttttgtatgtttagtagagacggggtttcaccatgttggtcaggctggtctcgaactcctgacctcgtgatccgcccggctcggcctcccaaagtgctgggattacagacgtgagctgccaggcccagcctgtaatttttcattttattttattttattttttgagacggagtctcgctcttgcactgttgcctaggctggagtgcaatgccgtgatctcagctcactgcaacgtccgcctcctgggttccagcagttctcctgcctcagcctcctgagtagctgagattacagaacgtgcatcaccatatccagctaatttttgtatttttagtagagatggggtttcaccctgttagccaggatggtctcgatctcctgacctcgtgatccacctgcctcagcctcccaaagtattgggattacaggcgtgagccaccacgcccagccctgtaatttttaatttttttattttctttctttctttacttatttagagatggagtctccccctgttgtccaggctggagtgcagtggcatgatcttggctcactgtaacctccaccttctggattcaagcgcttctcctgcctcagcctcctgagtagctggcattacaggcgcccaccaccacacccggctaatttttgtatttttactagagacggtgtttcaccatgttagccaggctggtcttcagctcctgacctcaagtgattcgcccacctcagcctctcaaagtgctgggattacaggcgtgagccaccatgcctgacccttccgtaatttttgtattttgaatatatcacctattcaagaaaaaatgttaaagacaaatgtttaaaaatatcttgaagcagtttaagaacaggtctgttttgcaaaatgtaagaggagttgtttggccataccctcaaagcttatcattctgaacttctttaggacagaaggggtttatagagactagggagcaggtctttgcaccatcgtctcttgtttcccaaactagtagttcaagtactaatatcatgattttttaaaaaaaattaagtataggctgggtgcggtggctcacacctgtaatcccagcactttgagaggccgaggtgggcggatcacgaggtcaggagatcgagaccatcctggctaacagggtgaaaccccatctctactaaaaatacaaaaaattagccgggcgtggtggtgggcgcctatagtcccagctactcgggatgctgaggcaggagaatggcatgaacccgggaggcagagcttgcagtgagccaagatcgcaccactgcactccagcctgagtgacagagcgagactccatctcaaaaaaaaaaaagaaaaattaagtataatattttgtgtaggttctgttaggtttgcatgcattatttaagtggttaacactagacctataaggtaggtactgttttcttcccccttctagacacttaggaggtttagagactaagttccttatccaagataacaaaggcattaagtggcagagttaagattcaaactcaggtttctctgactccagagtctcaatcatcacactatattactacctaatatgctaatcttgctttaggaacatgggttgaaaaattccagtgctcacttatcttgactaaattttttgcactgtggtgcaggcagaatgtggtatagtcattcaaaacattttaagtgtctagacctgagagccttgtgggtttaaaaacctgaatgggagaagtaagaaggagaaattaacagtttttcaatttttttcctggagagcagatcaaacagatgatggaggcagcaacacgacaaatcgaggagaggaaaaaacagctgagcttcattagcccccctacacctcaggtattgtgtctagattactctgaacagaataatctttggcacagaatttcttgccatccactcaaaatgagagactagaagaggtgactacatgtttcacttcataatcatctgctacagtctaccatgatgtgtgtgtatatctgtgtgtatgtatgtgtgtttgtctgcctgtcttaattcctctgatttctttttctctatctcacagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgtgagtgtctatttcatggaataccttttcatttctgaagtttgagaagcaataaatacctttgaatgttactgatctggctgggcgcagtgcctcaggcctgtaatcgtagcactttgggaggctgaggtaggtggatcacctgaggtcaggagtcaggagttcgagaccagcctggccaatatggtgaaaccccatctctactaaaaatacaaaaattagccaggcgtggtggtgcatgcctgtaatcccagctactcgggaggctgaggcaggagaatcgcttgaacacaggaggcagaggttgcagtgagctgagatcgtgccactgcgtgggtgacagagggagactccggctcaaagaaaacaacaaacaaaatattactgatcctctttttccacagaacctagatcatttctcacagtttcatatttcttaggtgtgattgattaatcagttgaattttttctcgtcttccctgttggagggtttattatcttcttatgatttatataactgagattaaggttattcatctaatgttggagctaggagtatagccaggtttccttcctggtttcaaactcagatttatccattaaaccacattgtgtgagactagatctgaggttcctctgcaactggtcaaagatgttacattttttttagcatctacagttggtctggcatcccatgagtgacataagaattcagggataaggaaagataggattataaattcatataatttataaactcatttcatttggttgtcctgtatactgaaatatccactttgatatttttaatcaagatactattggcagggcgcggtggctcacacctgtaatcccagcactttgggaggccgagactggcagattgcttgagctcaggagttcaagaccagcctaggcaacatggcaaaaccccatctctctaaaatatacaaaaattagccaggcatggtagagcatgcgtgtagttccagctacttaggaggctgaggtgggagaatttctttgggcctgggaggttgaggttgcaatgagctgtgattgtgccactgtactttagcctgggcagcagagtgagaccatgtctcaaaaaaaaagatggtattgctcactgatgagattgttccctagaattattttattgtcctttttgttgttgttgttgttgagagggagtctcactctgtcacccaggctggagtgcagtgatctcggctccctgcaacctctgcctcccaggttcagtagctgggactacaagtgcccgtctaaattttgtattttttgtagagatggggtttcactgtgttgccaaggctggtcttgaactcctgggctcaagccatccacccgcctcagcctcccaaagtgctgggattacagtgtgagccaccacacccgtccatccaaataactcttatagagaaggcactgcagcctcaacttcctgggctcaagtgatcctcctcaacctcctgagtaggtgggaccacaggtatatgccaccgcacccagctaattttaaattttttgttgagatgcagtctccttgtgttggccagactggtctttaactcctggtctcaagtgatccctctgccttggcctcccaaaatgctgtggttccaggcttgagccaccacgcctggctttattttgttttttgcttgccttaatgttccatacaggatttatttctttgcgggctatttttcaggaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggtatctggcttagagtataacacagaatttggaaaaagttaagaagctgacaagaaaacattgttaaatctctgtgttctaggaaattagataaataggtcatttaaagcagcagtcctcaacctttttggcaccagggacttgtttcatggaagataatttttcccctggagtaaggatggtttcgtgatggttcaagcacatagcatttattgtgtactttattattattatttttttcgagatggagtgtcgctcttgttgcccaggctggagtgcaatggggcgatctcggcttgctgcaacctttgcctcccaggttcaagtgattctcctgcctcagcctcccgagtagctgggatcacaggcatgtgccaccacgcctggctaattttgtatttttggtggagacggggtttctccatgttggtcaggctggtctcgaactcctgacctcaggtgatctgcccactttgtcctcccaaagtgctgggattacaggcgtgagccaccgcccccgcctttttttttttttgggcggggagggggatggagtcttgcactgttacctgggctggagtgcagtggtacagtctcagctcactgcaacctctgcctcctgggttcaagcaattctcctgcctcagcctcctgagtagctgggactgcaggcatgcgccgccatgcctgacgaattttttgtatttttagtagagacagggtttcactatgttggcccggctggtcttaaactcctgaccttgtgatctgcctgccttgacctcccaaagtgctgggattataggcgtgagccactgtgctggcctatttctattattattttattgtaatatatgatgaaataattatataactcaccataatataaaatcactgggagccttgagcttgttttcctgctgaaatggtcccatttgggtgtgatgggagacagtgacagatcatcaggcattagattctcataaggaatgtgcaacatagccccctcacatgtacagttcacaatagggttcgcgctcctatgagaatctcatgccaccgatgatctgacaggaggtggagctcaggccataatgcaggtaatagggagcaatcgtaagtacagatgagactgttggcttgcctgctgctcacctcctgttgtgcagcccagttcctaaaagactgttgggttggggacccctgatttaaagcaatgaatactttgaaaaatgtgctggacaagatggctcaagcctgtaatcccagcgctttgggaggccgaggtgggtggatcacgaggtcaggagttcaagaccagcctgcccaacatggtgaaaccccgtctctactaaaagtacaaaaattaaccgagcgtggtggtgggtgcctgtaatcctagctacttgggaggctgagtcaggagaatcacttgaaactggaaggcagaggttgcagtgagctgagatcgcaccactgcactccagcatgggcaaaagagcgaaactccgtctcaaaaaatatatatatatatttattaatataatacataatttttttagcagattttacttcctaattcgtttctacataagtggaaatattatgaaattgagtttgaaaattctccacatacaactaagtggagggaaacaatttgaaacattctgagtgactaaggaaggcttgcctgtagttaaaatttaatgagacagtacacctggagagttgaattgattgtatattgaatgacctttgccgcctttttatcctctcaaagtgaggttttcataaaattcctttttttttttttttttttgagacggagtctcgctctgtcacccaggctgcagtgcagtggcacgatctcagctcactgaaagctccgccttccaggttcatgccattctcctgcctcagcctgccgagtagctgggactataggcgcccgccaccacgcccggctaatttttttgtatttttagtagagacggggtttcaccgtgttagccaggatggtctcgatctcctgacctcatgatcctcccgcctcggcctctcaaagtgctgggattacaggcgtgagccaccacacccggccataaaattctatttctgcgtatttactgcaggcatatactgtggagtgcagggaggggttgaaggtgagatctatgtatatgaactaaataaaggataaaataaagcagaacaactcctttctaagctttcagaaattatgaacttgttgcgttaggtgtaaagagttcaacggggaagtgttttaaaatttgggattcttggccgaggtgggcgaatcactaggtcaggagatcgagaccatcctggctaacatggtgaaaccacttctctactaaaaatacaaaaaaatgagccgggcgtggtgatgggcgcctgtagtcccagctactcgggaggctgagtcaggagaatggcgtgaacccgggaggtggagcttacactgcactgcactgcagcctgggtgacagagtgagactccgtctcaaaaaaaaaaaaaaaaaatttgggattctggccgggcacagtggctcatgcctgtaatcccatcactttgggaggccgaggcgggcagatcacctgaggtcgggagtttgagaccaggctgagcaacgtggagaaaccccatctctactaaaaatacaaaattagctgagggtggtggcacatgcctgtaatcccagctactgaggaggcttaggcaggagaatcgcttaaacctggaaggtagaggttgctgttagccaagaccatgccattgcactccagcctgggcaagaagaacgaaactccgtctcaaaaaaaaaaaaaaaattgagattctacacattctgttttctatgactccaatttatctttctgtcttggattatcttgtttttaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatctgtgagtttgttttagtacctttttaaaaaaacagtttttaatcagctgagtttaagactcaagttaataccttttagtaaagctatggttttagtgggaaggatggtactcattcattaattaaaatttttaaatccaagagagataagtaactgtacacaaggtcctgtatttttttttttttttttttttgagagggagtctcgctctgtcacccaggctggagtgcagtggcacgagctcagctcactgcaacctccacctcccgggttcaagagattctccttgaattctccttgaatctcagcccctcaagtagctgggactacaggtgtgtgccaccatgcccatctgctttttgtatttttgatagagacagggttttgccatgttggccaggctggtctcgaactcctgacctcaggtgatccgcccaccttagcctcccaaagtgctgggattacaggcgtgagccactgcacctggccaagctcctgcatttgtaagtgatgtatcatatatataggctgtttttagcttttggggttaatgtaggataaccagggacacaatctacaaaagcaaagtctagaattctttttgctctgttacacattgttgcctgtttttagcattattttccttaattacattcttttgctacgtattataggtgtttacatttcctaaagatctcattgtgatagagcaaggattattagttggtaggtgagataatagtaaatatagcatataaggctgggctcggtggctgacacctgttattccagcactttgggaggctgagggctgaaggattgcttgagcccaggagttaaagaccagcttgggcaatatggtgagacctcgtttctacaaagattaaaaaaaaaaaaaaagtagctgggcatggtggcttgtgcctgtagtcctggctacccaggaggctgatgtgagagaatcacttgagcccaggagggtctgtgctgcagtcagctatgatcatgaccactgcactctatcctggacaacagggtgaaactctgtctcaaaaaaaaaaaggatataagacacatttgaagagctttaaatatatctgctccatccattttttttttttttttcctgagacggagtttcgctcttgttgcccaggctggagtgcagtggagcaatcttggttcaccacagcctccgcctcctgggttcaagtgattctcctgcctcagcctcccaagtagctgagattataggcatgcaccaccacgcctggctaatttttggtgtttttagtagagacgaggtttctccatgttggtcaggctggtcccaaattcccgacctcaggtgatccacccgcctcagcctcccaaagggctgggattacaggcatgagccaccacgcctggcgttttttttttttttttttttttttaagacagagtctcactctgttgcacaatctcggctcgctgcaacctctgtctcctgggttgaagcagttcttctagctcagcctcataagtatccgggactacaggcaaataccaccacacctggccagtttttatatttttagtagacaagagtttcactatttggccaaactggtctcaaactcctgacctcaggtgatccacctgccttcatctcccaaagtgctgggattataggcataagccacatcacctggccctgctccatcattctgatacatggctttagtagattttgtcttagcctttcgttgccccttctttgtcagccactgttccagggacttattgtcactaatgagagaacatagcgtctgtcagctgtggcatggtagaaaaaaggttgagaatgattgctgtggagagtgtgttcaaccatagagggactcagttttctcatcatgaaaattatgtgtaatttaactatatattttaggtacctaaatgctattttaggtatatcaagcacaagaacccattatagagagtgggttttttcattgtatttctgagactcctctcttagaatcatctctacccgcatatcgtgttttcttttcttcctacaattttagtacagaggaaaatcccaagagagaagattattttggaatcacaaatcttgttgaacatccagcccagctcaatcctccaggtaatgtatagattcctgaatcaagtctctagagcagcattacccattggaaatttatacagtgaggaacatgttctgtatctatgctgttcaatacaatagccactacccatgtgtaattcttttttttaattcagtttttttcctgacaatagtttgttgtttgaccagtgaacatacattttaagtgcatattcctgtgcttagaatttcatgagacagccaagcatggtggctcatgcctctaatccaaacactttcggaggccaaggcaggaggattgcttgaggccaagaattcaagaccagtctgggcaacacagtgagacccatctcaaggaaaaaaaatttggctgggtatggtggcttatgcctgtaatcactgcactttgggaggctgaggtgggcagattgcttgagctcaggagttcgagatctaggcaacatggcaaaaccccatctctacaaaaaataaaaaatcagccgggcatggtggtgtgcatctgtagtcccagcctcttgggaggctgaggtgtggaggatggcttgagcctgggaggtggaagttgcagtgagctgagatggtgctgctgcactccagcctggatgatactgccagaccttgtctcaaaaaaaaaaaaaaaaaaaaaagaagaaagaaagaaagaaaaaaacccaaaatttcatgaagctttacatttacagttccctggttgttcctaggaaagagccctcagcttgctccttttatagaaccacatgttgttgtggcatccacagctaaatgcaaatgcaagagccaaactcttgggttggtgtgttattagatgcgatatgctccactacccactgtgagggatgctaattccaaagggctttttgttagtttcccaaagttgaaactgggaaacaaagttgcttctattttttttttttttttttttttgaggaggagtttcgctcttgtggtccaggctgcagtgcaacggcatgatctcagctcaccacaacctctgcctcctgggttcaagcaattctcctgcctcagcctcctgagtagctgggattacaggcatgtgccaccacgcccagctaattttgtatttttagtagagacagggtttcaccatgtttggtcaggctggtcttgaactcctgacctcaggtgatctgccagccttggcctcccaaagtgctgggattataggtgtgagccaccgcgcccggccttttttttttttttgagttggagtttcgcttttgtcacccaggctggagtgcaatggcactatctccgttcactgcaactttcacccccctgggttgaagctattctccggccttagcctccggagtagcttggattataggtgcctgccaccacacctggctagtttttgaacttttagtagagacagggttttgccatgttggtcatgcttgtcttgaactcctgacctcaagtgatctgcccacctaggcttcccaaagtgctgggtttaccggcgtgagccaccgcacctggccctaattttgttttctacatttgccaggtatcattgaatgagggggtttaacagcttaaaggaaaacaactaagaacactacttaagaaagataagaggccaggcgaggtggctcatgcctgtaatcccagcactttgggaggccgaggcgggcagatcacgaggtcaagaaatcaacaccatcctggctaacaaggtgaaaccccgtctctactaaaaatacaaaaattagccagacgtggtggcgggtgcctgtagtcccagctactcaggaggctgaggcaggagaatggtgtgaacccaggaggcagagcttgcagtgagctgagattgcgccactgcactccagcctgggcagcagagcgagactccgtctcaacaaaaggaaagataagaatgttttttaaaaacatagccatattgccgggcaccaggcctgaactgattttaatcttactgatcccttattaacgagttttcttcattttctatttaaagtttatacacacacacacacacacacatgttttttgaaatggagtctcgctgtgttgccaggctagagtgcagtggcaagtggcacaatctcggctcactgcaacctccacctcccggattcaagtgattctcctgcctcagcctcccgagtagctgggactacaggtgcgtgccaccacgcccagctaatttttgtatttttagtggagtcagggtttcaccatgttggccaggctggtctcgatctcttgacctcgtgatctgcccacccgtgcctcccaaagtgctgggattacaggtgtgatccaccgcacctggcctcaatatattttttacataaaatgtttataatagagttgggtctcacttggttgtccaggctggtctcgaactcttgggctcacgccatcctcccaccttggcctatcaaagtgctagaattacaggcataagccactgtgtccagcctaaagtttcttttaatgatattgatatttacctaggtttctttaatatttttattgctgtccgggcctggtggctcatgcctggccaacatggtgaaaccccatctctactaaaaatacaaacattagccaggcatggtggcgtgtgcctgtaatcctagctactcgggaggctgaggcaggagaattacttgaacccaggaggcagaggctacagtgagctgagatcgtgccattgcactccaacctgggtgacagagtgagagagagaaaaaaaaaaaatatatatatatatatatgtattcttactgctttggtatactaatatctctgcctgacagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaaggtgcatttctcagtggcctcttctgttaaaaagagtggcaagtttatgtctttaatcctggaggaactttaacatctctgtgtttgagtgatttctgtttctaagaattattcttggggtcctttttctccaagttttctaccatcttttcatattaagataggtcaacacattcattatagaggccatttatggcttatttttaagcatactgatcatacaacactctggttttcctggaagaatacaggtcttgaaattcatggagatagtagttgcagtatttgcgtagactttttatgtacataattcttaatgttttaatttttacaatgaaagtacaggataaaaaacttgaccctgtagttacattctcgttcagcagtattttgactgagcactattatttataagctctttcactagatgctgtgatcagtgtgaaaaatatgaaaggaattaagttccacgtccttcataaattttcagataatgtaaatgcataccaatcttcaacttaattgtgtgaacttctgcaaatgctgaagtgattggatgggattttcaagataggagttattggaggaagtgagtttagagcagagatttgaaataggtaaataatatgaattggtatggaagaaataacaagttactccagctggagaagtgacttcaaagactgattgttgtcctctcttcactgcagtgagaatttctaatttgatgcgagtattaggaacagaagctgttcaagaccccacgaaggtagaagcccacgtcagagctcagatggcaaaaagacagaagtaagtgccatgggattgggtggaaacctcgggcaagtacctttcccaaactcttctggggggtccatatttggagggaggggagagttctccgttgctctctctttccctcagccctgcctctgatcttcaatgcctttctcacttgtggatgtccttcctgtcacgacagagcgcatgaagaggccaacgctgcccgaaaactcacagcagaacagagaaaggtcaagaaaattaaaaagcttaaagaagacatttcacagggggtacacatatctgtatataggtaggtgtccatactgggccaaacttccccttagaattactaaaacattttccaagtgcttgaggcagaatcattgtggcctaaaagcatacctaacaccagttcctactctcttttaatgaccctagtgtggatcaagagctagtaaatcttgtaaaatagcgagagttaatgacttatgtttatggttacccagttcttccctctcaagtcttctttttttttttaccagaatattagttctgaacaagtcaatatacttgttcaggccaagatgtgaactaaagattgtatgtcctttgagaactataaaatatcatcctatttcttttttttttcatctttttttttttaaatggtctgagtttgcttccaacatccatggaagcattacaaattttctttcctccgtagtcatatccttaccctgatgtattgctgtgtttcatcctcactccaaaatgcattttatatgttgtaaatatttttctacctttgtgttgatttaatgtttttattcttttatgttgagtacatgtgtatcttctatttttaaaatgtgcttatttctattaactagttctttattataaaagtggtacattatcacaaaaatagtgaatgcttattaagatttaaaaaattgtctgacaacacagaagaatacttactcaaaatgtctcctttctattctctgatcccttagaaccactctctttaggtaattgctattaacagtttttcacatatcctcctagaaaattttcatgcctatatagtgatcctatatatatattttatttatttatttatttattttgagacggagtttcagtcttgttgcccaggcaggagtgcaatggcgcgatctcagcgcactgcaacctctgcctcccaagttcaagcaattctcctgcctcagcctcctgagtagctaggattacaggcacgcacccccacgcccggctaatttttgtatttttagtagagatggggtttcaccatgttggccaggctggtcttaaactcctgacctcgtgatctgcccactttggcctcccaaagtgctgggattacaggcatgagccaccgcacccagccaagtaatcctatattataagagtctaagggtctagaggacaaaaagtctgtaggtctttacattgtcaagaacaatgagattgtaagtatttttggatgatagtaaatacctctccctgactcttagagtaaactttggttagtaatgtaatggttaatgtaaagtgctagactttgaagaaatgtaagagtgtggaaatatttctagactcatcaactctaccttttaagcattcatctatttgtttactccagaggcctttgtttatagagaggaaaccattttggattcatctttttacttgccactccattcaggcagctgctgatgctaaaatggaagacataactaaactttcccttctccagagttcgaaatttgagcaacccagccaagaagttcaagattgaagccaatgctgggcaactgtacctgacaggggtggtggtactgcacaaggatgtcaacgtggtagtagtggaagggggtgagtctgaaaaacttgagggagactgtccccagacaaccctaggcttagagtgattagcattgtggggagaaaggagaaaaagatcgtattttagtgccatacctgatataatatgctaggtctctgcttctgtgttttttggagtagaaggccctaagatgtggttcctgagattgcttcaactaccacattaatgtctgagctcagaggttctttctaccccatcatcttccacagttctggcaaaattattcttctctgtttccaggccccaaggcccagaagaaatttaagcgtcttatgctgcatcggataaagtgggatgaacagacatctaacacaaagggagatggtgaatgggggttagaggggattaagggggagagctatgggaggtggggatggtgcatctgtccgttcatcttatttcctccctgtgacactcttgataacactagatagtgttcaggaattttagaaagacccgtttagactttgagcctcctagacattcatacaatatttactacatgattatatgcatgaatggtaaagctatttttttgcctatcatttaaggcttttctaccagctggtttctgtgtctgtcctggatctgagtaccggttacatgaatttattcagtatttgaaaattcagcaagcagctaggcatggtggctcatgcctgtaatcctagcactttgggaggctgaggcgggcagattgcctgaggccaggagttcgagaccagcctgggcaaacaacgtggtgaaaccccatatctacaaaaagtacaaaaattagctggatgtggtggcacacacctgtattcccagctactcaggaagctgaggtgggaggatcacttgagcttggggaggtcgaggctgcagtaagctgtgatcgtgccactgcaatccagcctgggtgacagaatgagaccctgtctcaaaaaaaagaaaaagcaaatctagtaagctatacattcatgtgtacagtgtctatattatattattatttgatttttttttttttaaggattgaagccaaaaagatcttcaggtcaaaaaagctctgctttgatcaaactatttcttttgtctgatatatatatatacacacatacacatacatacacacacacacacatacatacacacatgtacacacacatacacatacacacaatacacacacatacatgtacatgtacatactcacacatatgctcttcaacttaatgatggggttagttccaataaacctgagataaattgaaaatattgttaagtcaaaaatgcatttaaggccaggcacggtggctcacacttataatctgagcactttgggaggccgaggcgagcagatcatttgaggtcaggagttcgtaacagcctggccaacatggtgaaaccccgtctctactgaaaacacaaaaattcggggcgtggtggtggacctctgtaatcccagctactcgggaggctgaggcaggagaatcgcttgaacctggcaggcggaggttgcagtaagctgtgatcgcaccactgcactgcagcctaagcgacagagcaagactccatctcaaaaaaaaaaaaatgcatttaatacatctgacctacaggacatcataacagcctagccttccttatactttctcagaatacttagattagcctacagttgggcaaaatcatctaacacaaagcctatttttatctcatgtaagagtattttactgcatattgctagcccaggaaaatctcaaaatttaaaatttgaagtacattttctactaaatatttatcactttcacactatactcaaggcaaaaaattgtaagtcaaggactgtctgtctatatttgaaggccagacattcttctggccatcatactcccattagtgttcattcttctcatctttgaacacctggattagcatttaaaatctgcagagaggcctggtgtgatggcttatgcctgtaatcccagcactttgggaggccgaggcgggtggatcacctgaggtcaggagtttgagaccagcctgacatggtgaaaccccgtctctactaaaaaatacaaaaatgagctgggcgtggcagcgtgcgcctgtaatcccagctactcgggaggcctaggcaggagaatcacttgaacccaggaagcggttgcagtgagctgagatcataccacttcactccagcctgagtgacagagcaagactccgtctcaaaaaaataaaaatataaataaaatctgcagagagttcatcttaagatacctgagaataaaaaatattttgttctacacgtgcatttttttttttttttttttgagatggagtctttgctcttttgcccaggctggagtgcagtggcaccatcttggctcactgcagcctccgcctcccaggttcaagtgattctcctgcctcggcctcctgataagctcggattacaggcacctgccaccacacctggctaatttttgtatttttagtagagatgaggtttcgccatgttggctaggctggtctcaaactcttgacctcaggtgatccactcacctcagcctcccaaagcgctaggattacaggcgtgagccaccacgctggccgataattttgatttggtatatctgccctcctcctccattgggtgaaagttttttgagagtaatatatgatgttgacatatgaagcctgcctcccaaagtgcctaggacaagtttttattcttgactgcttgtcttttatttccttattcccagtacctggtggagctcttgattcataacaagtgctatgtaaatgctaattgtatcaattaatattactgcctacttggagcttcaagtctaatttggggaaaataaagagcaacagaaaagagaacacttggtccaacacataaaaagggtgataatattttagagagtttgggtagacttgaatattatttgtttagaacctgaatctcaagtctaagtctgtaacaagatttctcttccagatgatgaggagtctgatgaggaagctgtgaagaaaaccaacaaatgtgtactagtctgggaggtaggtgatcctttgtaaaacattgtaaaactttagccaactcctgaatatttatactatttgagtggagcaatggaatgtaagatgtaatcagtgaataatgttttaaataatttatgtttctttttggaatccatttttaaatggttggcagtaaattcttcctgatcatctgtttaattaaattcgtgagtatttagtatatgctatctggggaagtgcgtggacagtgctgctggtagcaggaatacaaattctctaccgaaaattatttatttcacagtcatgaatatgagacttggaaacgggaatgaattgttgttggatttacctttggatatagtgaaggaagtactagacttaagaatataaagttaggaggctgggcagtgctgcttattagctgtgcaatctgggcaagacacttaatgtcaaattctgttgccttagctattgttctctatattgtcaagtttttgagaatgaaattagataattatgtgatagtgcttcataaaatgtgactgaatcactcttcaagtggaatattttttatggttatctagttctttaacccctgaagccttcttagagaaccagtattaaaaccagtattaatgttttcatgtttgcttttaggtatagtacatgtatatctttttttgggggcgggggggcggggggcggtatggagtttcgctcttgttgctcttgttgcccaggctggagtgcgatggcgtgatctcggctcaccgcaacctctacctcccaggttcaaacgattctcctgcctcagcctcccaagtagctgggattacaggtgcacgccaccatgcccgactaatttttgtatttatagtagagacagggtttctccatgttggtcaggctggtcttgaactcccaacctcaggtgatccgcctgcctcggcctcccaaagtgctgggattacaggcatgagccactgtgcccagcccctccatttctttttttttttttttgagagagttttgcccttgttacccaggctggagtgcaatggtgcaatctcagctcaccgcaaccaccgcctcctgggttcaagtgattctcctgcctcggcctcccgagtagctggaattacaggcatgagccaccacgcctggctaattttgtatttttagtagagacggggtttcgccatattggtcaagctggtctcgaactcctgacctgaggtccgactgccttggcctcccaaagtgctgggattacaggcatgagtcactgcgcccggccatatatcttctatttttaaaatgtgcttatttctagtatatgtgctgctgaagcgagcagtaaaatgtgcttatttctattaatgaattctttattataaaagtggtacattattacaaaagtagtaaatgtttattaagattagaaacaaattctaattatacagaagagtacttactgagacccagcacagtggctcacgcctataatcccagcactttgggaggatgaggtggttggatcacttgagctcaggagttcaagaccagcctgggcaatatggcgaaaccccgtctctacaaaaaatacaaaaattagcctggcctggtggcgtctgcctgtagtcccagctacttgagaggctgaggtgggaagattgcttcagctttggagtttgaagctgcagtgagctgtgactatgccactgcactccagcctgggcaccagagtgaaaccctgtcttaaaaaaaaaaaagaaaaagtctcaggccaggtgcagtggctcatgcctatactcccaacactttgggaggctgaggtgggcggattacgaggtcaggaattcgagactaacctggccaacatggtgaaacccagtctctactaaaaatacaaaaattagtggggcgtggtggccagtgcctataatcccagctacttgggaggctgaggcaggagaatcgcttgaatctgggaagcggaggttgcagtgagccgagatcgcaccattgcactccagcctgggtgacagtgcgagactgtgtctcaaaacaaaagtctcttcctattcgctgatctcttcagaccagtctttataggtaattgctattaatagtttttcttctgaaggagcaatcaaaaaataaaaattaaaaaaaaaggttttcatgtatcctgccttatcccagattcttcaatttatgcatacaaattagatgataataaccatagtatttgttctctgttttataagttcccacctgcatatttgttatctttttttaatcaacttttttttttagagatagggtcttgctctattgctcaggctggtgtgcagtggcgcagtcatagctcgctacagccttgaactcctagggacaagcaatcctccagtctcagcttctcaagtatctgagacctcaggtccacaccactgtgcctggctaattttttttttttttttttttttttttagaaatggatctcactatgttgcctaggcttgtcttgaactcttagccttgagtgatcctcccacctcagcctcccaaagtgctgggattataggcatgagctactgtgcccagccctaccttcacatatctcagcaccctcatctttcaattttcttctatttatctctgaagagtacttactgaaaaagtcccggcttcttagagaaccagtattaatgttgtaggaatttagttttcaggaattgtctctcatgttcagaaataagccaagttctgctccagcctccttattggagtctactccctgaacgcctcttgaggtattgctttatgactgccattgctgctggtaactttggcaagaatgccattctgcccagtactgtctttttctgttgtaattctctgctggtacctgctcttcttctgttccccgcccccagttgttctttgttgctgggccccaaagcctcctgcttatataaatagtttctggggcctttttgaaggctcagatttagtccttaaggcctggtaggagataagtttatctcattccaccttccatagttcttcctgacttgctgttccacccaggcaccagagcaaataattcctcacttcatttcaaaaaactaaaagccttatgcatatgaattcgtaaaatctcatacaaatatccaaggaggccgggcgcggtggctcacgcctataatcccagcactttgggaggctgaggcgggaggatcacgaggtcaggagatcgagaccatcctggctaacacggtgaaaccccgtctctactagaaatacaaaaaatcagctgggcgtggtagcgggcgcctgtagtcccagctactccagaggctgaggcaggagaatggtgtgaacccgggaggcggagcttgcagtgagccgagatcgtgccactgcactccagcctgggcgacagagcgagactctgtctcagaaaaacacaaatatccaaggaaatggaggtcacaatttttttttaaccataaaatcacgttcagctgggcacatgtctcacaaatgttactaggtcttcttataaaagaatattatctgatttaaataagaaattgaagtgtttttattatatatctcttttctagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaacttggtgtgatatttttcacacattcgtaagta

SEQ ID NO: 5827 - DNA, 34254 bp, Homo sapiens
gaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaaggtgaggcgagagtgtggagcggcgcgcgggccggaggcggggcgggtgtgcgcgcgcgcaggcgggtggggaccctccccgtttgggcagctcctgaggtgtcagctcccttgttatttccagttaatttttcatcaagtcattttaagcgcgtattatttgcaagcgctgatccagcgggggtacagtagtgacggagacaaaattcctgtccttacggggtttaaattacagcgggagagacagagaataacaaaaccttgaagctctgtaataaaaatgtcaggccgggcgcggtggctcacggttgtaatcccagcactttgggaggcccaggcgggcggatcacctgaggtcaggagttcgagaccagcctggccaacacagtgaaacctcgtctctacgaaaaatacaaaaatgagtcgtgtgtggtggcgcgtgtctataatcccagctactggggaggctgaggcaggagaatggcttgaacccaggaggcggaggttgcagtgagccgacatcgcaccattgcactccagcctgggagacagagtgaaacaacctctcaaaaaaaaaaaaaaaagtcagatagtgatcaatgtgatgaaaggaaaaacagagtaaaatggtaagggaattggcaaggggtgcttcttcctgctggtgcctgcttctccctcacactcactgacaggagcttaccctagggcaagaggtgaagaggattagggggagggtgtgcaggcctttaaactgaggtgcctttccagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttggggtaaggaacatcctgaaataatttcatttggaatttggcccttttcccttctccctgtcccacagtcttggattgatgctttgacagctcatcttggtggatataagagaaaggagaaaaccagtaggagtctctgataatttctacatcttccacttttgcagtctgtttcccctctcttcccgatctgggactggtgctttaatttgtcctgttgatgatattataagatgtccctggccaggcgcggtggctcatgcctgtaatcccagcactttgggaggccgaggcgggtggatcatgaggtcaggagatcgagaccatcctggctaacacggtgaaaccccgtctctactaaaaatacacaaaattagctgggcgtggtggcaggtgtctgtagtcccagctacttgggaggctgaggcaggagaatggcgtgaacctgggaggcggaacttgtagtgagccgagatcacaccactgcactctggcctgggcgaaagtacgagactccgtctcaaaaaaaaaaaaaaaatgaaaaataagatgtccctatggttgagctggttgaagtccagagtgggatactgtgcatagtggcagcctgtcgctcctcagggacctgaattctgtgtttggggtatttaatttcagaggtttccctactcctgttttttctgtggctctaaactgggctagtacaggtacagatgtcttagcagattcctgttctatttggacacaaaaatgtttgccatgtaatgaactggaagttttgtttatttcaaaaaatacttagagaactgtgctggctgctggggatatagtagcgagcagagggtaacaatctccgcctttctgcagtgtgcggtctagtggcctgacagacatgagacaactggtgatagtgaagtatggtgaatactttattatgatttatgggaagatgcggagggaataggatgtgagagagccgcaaagctgtctccagagggatagccgttgatttagaggagctgataccagcattgtgggattatgacgtttaagaagagtggtgcaaggtgaagttggagagggagaggcagggtttctggttaggaagggcctgtgggctaagtttgggagtttggattgtaaggtaggactgtggaacatgaacatgtggcttctctgcatgggacaggtagcagaacacctcgtcatttctgatagccttctctttttctaatgtgccagtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtgagaaaggctgaaatatggtgggtggtggtggtggtggtggttgggaggcagtgggtagaaatggttgtgtgatgtcttgccttccaggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtgagtgatagatggagatactacacctgggaggagttctggaaatgcagaaggagtcctgggagatcagtaggtggtatgggtttgtctagctgcttacttgaggtgggcctttcattttttacctaggtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacagtgagttggagagattagggattttagacattttgagttgaatgaaacgtaatcttgatccttaaagtcctgatataacttccaaattagtctgtttacaccaggtgcagtggctcacgctgtaatctcagcactttgggaagctgaggcaggaggattgcttgagcccagaagtttgagaccaatctgggcaaaatggcaaaaccctatctttaccaaaaaatgtagctgggcgtggtgacactcacagcttcgtgtagtctcagttacttgggaagctgagctgtgggaggattgtttgagcccaggaggtcacggctgcagtgaacgatgatcatgccattgcattccagcttgggtgataagagtgagaccctgtctcaaaaaaaaaaaagtctgcttattcttgatgttgtaccctagggatgaagactggaatgaattcaatgatattaacaagattatcatccggcagcctatccgcactgagtacaagattgcttttccttacttgtacaacaatcttccacaccatgtccacctcacctggtaagagacctggaacacaacatttggaaaggagaaggctgctgtttaggttgggccagggcgggaaaactttggctgactcttcctttcattttaggtaccatactcccaatgttgtattcatcaaaactgaggatcctgacttgccagctttctactttgaccctttgatcaacccaatctcccataggcactcagtcaaggtgaggaagggaagggatgctttccctcagctcttctaggagaaatgcgtgaggttggctgatgttactaaacgctcaggtggagggagatgtgttttccgtcttgctaagtgttccccttgagctataagcgaatatgagaattcagcatttgctttaaaacatgtcattggtataatcctgttttctgtgattatccttttggactttacggttcttttcttgggtgctctagataatctgtcccggtctgtctctattgtgtttgtttgttttagcctttatattgagatgtagttaacataccatacaagttatccatttaaagtgtgtaatttgatggtttttagcttattctcagagttgtcccaactgtcacgacatgcaatttgagaatatttttattacttgagaaagaaacccttagcagttactcgccatttctccccaacttccttacgcaaccactaatctactttctgtctatagatttggctattctacacatttcatatgatagaatgaaatagaatcgtacactatgtagtcttcagtgactggcttcttaagcttaccataatgtttttgatgctcatctgtgttccgttgtgtccaagcccagtgtttggagcttgggtgggagatgattgcaatgttgacctcctgtgatgttggggctccattgggaggctttctggtggtcagccagttgaggtgtgagaagtgacgcttgctttcctggtggccctgtcttgttctttgctgtcttggtttcctttgtgctggcacttcagggctgcttttgtcagacagcccagtttccatagcagatacaggctttgtgcttggccccagagaatttccctcatcttaagtctgtgcctagttcagcaggagctaaacccttagagggattcctttttcagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtaaggtttttccctgtggcagggggaatgatagtggatgtgtaggagaaaagactccaactaggtgggcatgtagccttttttttaaattctttttttttttttcccataaaaatggtagacaacccaaggcttgcagcctttagcagagtgtctggaagaagagatggccaaactctggtgggcttatttttccaggtatcgggagcattgtcctgccgggcagcctgtgaaagtgagggtctcctaccagaagctgcttaagtactatgtgctgaatgccctgaagcatcggccccctaaggctcaaaagaagaggtaaggtgccccaggggccctgcgcagacttctgttccagagatatcagtaggctgactcttactctccatgttcccacctcaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggtgcctgcattggaccctaggggcctcctgggcttcaaggacggacagttgttttcctctggttactgatgaaggcatacatcagttgggtccattgctcattcacgttctgtctgttttttgcatcttctccaggaaagaaagaaatctcgttttgggaatgctttccacctgtgtcgggaagttctgcgtttgactaagctggtggtggatagtcacgtgcagtatcggctgggcaatgtggatgccttccaggtaaggttaggtattcccaacccctgcctgggtgaggacgctggaggaagcctgtgctgaccgtggagctggtttaagctccaggtctgatggggcaattgtattgcagctggcagatggattgcagtatatatttgcccatgttgggcagttgacgggcatgtatcgatacaaatacaagctgatgcgacagattcgcatgtgcaaggacctgaagcatctcatctattatcgtttcaacacggtgagaccttgactttactgactttcttttttttgagacagagtcttactcttgtctcttgggctggtgtgcaatggcacgatcttggctcactgcaacctccgcctcctgagttcaagcaattctcctgcctcagcctcccgagtagctgggattacaggtgcccgccaccacgcctggcaattttttttttgttttgttttgaaactgagtctttctctgttgccccagctggagtacaatggcacgatcttggctcaccacagcctccgcctcccgggttgaagtgattctcctgcttcagcctcccaagtagctgggactacaggcgcgcaccaccatgcctggctagtttttgaaattttagtagagatggggtttcactgtattggccaggctggtcttgaactcctgacctcaggtgatccacactcctcggcctcccaaagtactgggattaccagcgtgagtcaccgtgcccagcctcactggacttaactttctcagatcttttttcatgtatacatttagacagggctctttccagggacctatttggagagcagctatgactgtgtccttactgctcctttaaattcacatgggcgatcttagttcctggtttttgccttaaggtttctcatttacccttttgttttagatgttgaggtcccagagtttttttttctttttacccctctactgccatacctacattcctctgtatgtatattatacatatatgccccacctctgcccaggtttctattgttgtttaaatgcattgctaacttgtattcttaacttctgcttgggatcgtagggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtgggtgtctctttatttccttggaggcgtaaacatccgtctttagggtaggattaccacttcgggaatcattagggggctatctggctccaatctcttttcttttcccttttagacagggaaaagaagcaccatgttgcttaggctggcctcaagctcctgagctcaagcgatcctccttagcctcctgagtagccgggactacagatgtgtgccacagtgcctggctggatcctggcttgattgtgctttttggacttttaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggttgggcagagtaggctgggctgggtgtgagtggtgggggagtgggcaagagggaggactgtagagttgtgactgaaccttgttctggcaggatcgggctgtagcgggaggctaatttcatgtccaccttacaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttataggtgagtagtagggtagataggttcctgctgggaaggtgacagcagggaatggcgtcatcctcagagtccaaagaaagaaggtgtagccccagtctttcctggttttacttcctcctagttttcccattcacccttcccattgcttttgtcagtgtgaagtctcggttgaaccagtctcagagggaggagctaggtctgatcgagcaggcctacgataacccccacgaggcgctgtcccgcatcaagcgtcacctcctcacacagagagccttcaaagaggtgagtgaggcctcccaagttttctttttggttctaccaaaggtagcagttgcctttggttctaccaaaggtagcagttggtggattggtgtgaaccagcctccttgtcccacaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggtagaactttcatgagatcgccctgtgaggaacggggcaggaatttagttctacgtcaaaaatctcatctgggtagcatgattggtttactctcttgatgcgtggtagtaaagggaagtagtgttcgtgttaaactgaggaaaagcccatagtcaaagcaatccaaatgaatacgtggaatcatagtgggattggttatggaaggtaatgatagttcctgtggggctagtcttgcaagaggatttctaacctgctggagacctgccttgctactcctcaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggtgcgtctcaggcgcagtagcatggaattgtgtgtggagtgcttgtctggcccactgactcagaatttgctgaggaggaggctgggtgcggtggctcatgcctgtaatcccagcactttgggaggctgaggcgggcagatcacgaggtcaggagttcgagaccagtctggccaacatggtgaaaccccgtctctacttaaaaaaatacaaaaattagttgggtgtggtggtgggcgcctgtaatcccagctacttgggaggctgaggcaggagaatcacttgaacccgggaagtggaggttgcagtgagctgagattgcgccagtgcactctcagcctgggtgactgagcacaactccgcctcgggagtggaaaaaagtagaatttgctgaggggagaacaaaagaggttaactctggagaatcctggggcatggctcacattcttaagaattgtagttctttctttctaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggtgagggctttcctggattcctagccttgcagggtactgaggcatgtgctttgcctctgaaatcagctattgtacctgagttgacttaactgctgttggggctttaaaatggaatgaagcggccgggtgcggtagctcacgcctgtaatcccagcactttgggaggccgaggcaggcggatcacgaggtcaggagatcgagaccatcctggctaacacagtgaaaccccgtctctactaaaaatacaaaaaattagctgggcgtggtggcgggtgcctgtagtcccagctactccggaggctgaggctggagaagggcgtgaacctgggaggcggagcttgcagtgagccgggattgcgccgctgcgctccagcctggggaaagagcgagactgtctcaaaaaataaataaataaaaataaaatggaatgaagcccggggagggtgggggtaggatggggtggggtctccgtctattgagctggaggacttgtgggtgtcccaaatctcagtgtactggggcctcagcagtgtacctggtctggtgtaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttgtgagtctaggttggggctgtgtgagctggaaggacataagctaagggcccagagagggcatacctgaggctgcgtcctgggtgggagaggcgtggctgtgtcaggatgtcatcagttggcctttgaagggaagttccttccaagaaactgctgtgaccatgtgttctctgtgggcagaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggtacagcctgggcggggctgggagtgacatgaacgcgcctgcacttcctgggtcagtcaccggagtcttgttgggtggaaagacttgagtggtgggcacagttggctcttgcttctgtgggagttcctcggacatgttaaccttgactttgtggtttaggttactaaggagcgcacagctcagtgtttcctgcgtgtggacgatgagtcaatgcagcgcttccacaaccgcgtgcgtcagattctcatggcctctgggtccaccaccttcaccaaggtacagggccgtcatgcccagcttccctcttgtcctctgctgtcctctgctcatttcacacccctttcacttcgtcccctgctggctgcttccttctcttctttgcttagtgtgccagtttccatgctctgtgccatagtggcttatagtatgtcaggtcacttcatcgttattttctgagcgttccttgtagaaattgtgtagcctccttcttgtggacttgtgatgattctaaattaaggcaagagtaaaagttggatttattattttgaacagaaaagcattatttttgcattttctcaggtgcttatctaagtcatgttaaccagtggcatagagaacctgtgaaaaagcagccctcataggcatctcggggttcgtttctccttcacttaccttcagaggcccagccgaaggcaaccggaattgagaaagaaaaatctgaggaattttgaactacgtatatttaaggttttgcaaaatttaaaaagttacctcggccgggcacggtggctcacgcctgtaatcccagcactttgggaggccgaggctggtggatcacctgaggtcaggagtttgagaccagcctgtccagtgtggttctgaaacctcgtctctgctaaaaatacaaaaattaaccgggcctggtggccggcgcctgtaatcgcagctacttgggaggctcaggcaggagaattgcttgaacccaggaggcggacgttgctgtgagtcgagatcgtaccattgcactctagcctgggcgacagagcaaaaactctatctcaaaatacaaacaaacaaaaaaaagttaccttactctggtttccattagagtaactcttagctataacatttttcttgcattccgaccttcatatctctaaatgtgcggcatttgcatgcgcagaatgttttctgttttttagttaagtctgttaaggatacgttctgttatgttttagaactattgcattacggttgagtttcctttatccaaaatgcttgggaccagaaatgttttggatttcagattttcttttttaatattttcattatttttattagagacagggtctcactgtcacttaggctgaagggcagtggcgctatcatagctcactgcagctcaagtgatcctcacacctcagcctcccaagtatctgggaccacaggtgcatacgccaccatgcctggctaatttttaatttttttttttttttttttttttttgagatggagtcttgctctgtcacccaggctgcagtgcagtggcgcagtcttggctcaccgcaagctccgcctcccaggttcacgccattctcctgcctcagcctcctgagtagctgggactacaggcgcctgccaccacgcccggctaagtttttgtatttttggtagagaaggggtttcaccgtgttagccaggatggtctcgaactcctgaccttgtgatccgcctgcctcagcctcccaaagtactgggattacaggcgtgagccaccacacccggcctgatttttaaattttttgtagagctgggatctcactctcttgtccaggctggtctcagactctggattcaagcagtcctcctgccttagcctctctaatgctggattataggtgtgagtcaccgtgcccagccttgaaatattttcattatacttacaggttcagcatccctaatccaaaatttgaaatgccccaatgagcatttcctttgagcgtcatgttggtgctcagaatgttgggactcagaaagtttcagctttttgtgagcattttgggttttagattaacctgtatgtgggaatctgtgagagcactagagttagtgattgctctagcccagtctggaagtggaagaggaaaggattcctgaaagaagtagcatgtgatgagacaggtgagggagagcattcctttagccagaagtgtggcgatgtaactagcttgtgtacatgggaccatggaaagttcaaggtttgctggagtaaattgtggaattgggaatgttaagagatgaggctggataaatagtggagagccatatcatggagggcatcgcacaccttaggaagaatcatataagggtcttaagcacagagtgactttgtcagatgtgtttttcttcttttttttttttggcttcccacactacagatgcagactttgtcaaatttctgtgttagatgattcactcttgcagctgtgagaaagatggacctgaaaggataggatgggagaccaggtttggggaccactgaagaagtccagataaaaatgatgagagcaggccaggcgcgggggctcacgcctgtaatcccagcactttgggaggcccaggcaggtggatcacctgaggtcaggagtttgagaccagcctgaccaacatggggaaaccccatctctacttaaaatatgaaaattagccgggcgtggtggtgcacacctgtaatcccagctacacaggaggctgaggcaggagaatcgctggaacccgggaggcggaggttgcagtgagccgagatcccaccagtgcactccagcctggcaacagggtgagactctgtctccaaaaaaatacataaatcaataaaaatgatgagagcactgaaagtagaggtaggaagaggggaacagatttgataagaagttagcagataaaatcagcagaactttgtggtcctgggatgctcaaagaaaagtcaaaaatgatgtgcagattttggcatgggtgactaggtgggtgttagtgccaccaactggaagaccacatgaacaagaacaggtttaggatcgaagataaagaaatctagtttaggatatataaagtttgaagttcctgagaacattcagatggagatttccccaggtatttatttataccttatttcttcagttccaagatacatatttaagtacatatatacacatgtgtagattcctgattccttctgctcccttagtggtgcctctttaattgatgatctgttagatttgatttaaaaagtatgagtgagacattccagggagagaaatgaaactagaaaggtaagagcagtcagggatagcttagaggttcctaggtgagaagcaatctgaagaaacatggagaacaggtctggattaaagatgtagatttcggagcctatccacaaaaggtcaaaagctcaagaatgagtgacatcacccagggacaatgtggagtgagaagaggagagggaggaatttggaaatgtggggaatactaagatgaagtgtggtcagaacctgtgggagggtgccgggtcttggaaccaaggccttcaggaacacgtgtccagaattggggtgatgctgagcagtgtcagttgcctaagagcatttcagttagatgaggactgaaaagtatccattggatttgacagttaggacgtcattggtgaccttagcaggagctgttacagaaatagtagggatggaagccagatggcagtgggtgaggcttcatgggaagtgagtgagtggagacagcaaggacaatctgtttgtcagttgaagagaaggaaggacatcagatgccacctagagggagctgtaagtcagtgcaggtgtttttgaatgacagtgacttgagcgtgttttaattaaggagcccagtagcagttgagtgtacaagagaaaagtgtggaattggctggacacagtggctcacgcccgtaatcccagcactttgggaggccaaggtgggtgaatcaccaagtcaggagttcgagaccagcctggccaacatggtgaaaccccgtctctactaaaaatacaaaaattagccaggcgcggtggcgggtgcctgtaatctcagctactcgggaggctgaggcaggagaattgcttgaacccgggaggtagaggttgcagtgagccaagatcgtgccactgcaccccagcctcggcgacagagcaagactccgtctcgaagaaaagaaaagtaggtaattgatgagcagaggtgcagagggtctccctagggatagaataaagagcaagcagaggaaaaatcctctgaacctgacaggaaagaggtctggaaagatgtggatatagatgaggttagtgggaagctataacaggattttgagtttttcagcttttcttgggctgcagttaggggaaagagttgtgcatagtgaatttcatggtattagggtatgatgattgctgaagaaactgagagggattggaaggtgtgttgggagctcagctgggttttgggaagacaactctgagcatttgtttttcccagaatcacccagctactcagtgacagggatgcagaaggtggatagattacactggtgattaaggaatagagctctgttagaagacagttgtagagtggtaaggcattgaatgcaagggaatcaagagtgcgggacccagccggccgcggtggctcatacctgtaatcccagcactttgggaggccgaggcgggtggatcacgagttcaggagattgagaccatcctggctaacgcggtgaaaccccgtctctactaaaaatacaaaaaattagctggatgtcgtggcgggcgcctgtggtcccagctactcaggggggctgatgcaggagaatggcaggaacctgggaggcagagcttgcagtgaaccgagatcgcgacactgcactccagcctgggtgacagagcaagactctgtctcaaaaaaaaaaaaaaaaaaaaaaaaagaatgctagaccccattgagatactggaagaggggagaggagagagagcagaagaggccattggcctgggaaagaattgtaggcatcagggaactggatatcagaagttagaggctgaggagtggaggagtgtctgagagggtaaggatgcagttgactctagtggttagaagcacaggctctggagtcagatggggttcacatcatatctttgtcatattactagttgggatcttgggaatattgcccatgctgggcctcaattccctcatctgtaaaatagggatactgataggacctaggtcagacggcttttgtgagaattaaatgaaacggggtatttagtaagccatattacttggtaaattgcatgataaagctgggcatggtggcttatgcctgcaatcccagcacttttggaagccgaggtgggaggactgcttgagcccaggaatttgagaccagcttaggcaacatagcaagatcctgtttatatttaaaaataaataaataggccgggtgcggtggctcacgcctgtaatcccagcactttgggaggccgaggtaggtggatcacgaggtcaggagttcaggaccagcctggccaatatggtgaaaccccatctctactaaaaatacaaaaattagccaggcgtggtggcacatgtctgtagtcccagctactctggagactgaagcaggagaaccacttgagccccggaggtggaggttgcggtgagctgagattgcgccactgcactccagcctgggtgacaaagtgagactccatctcaaaaaaaaaaaaaaaaaaaaaaagctatgtcatgggcaagttctataacttgttttttatgaagacataagaggtataacatatataaatttcttaccatggtacctagtacacgtagacctgagtaaatattattttccttcttgcctccccttatcccccaggaatttctgctatttagtaaaggaacactgggctcctcaggaatttatgcctcctccccttcagggatagagcactgttaactacaacagaaatactgtgttccattacacacatcagcaattccaagtgcagtccaagaatttactaaacctaatgggaatcatccacttgcctttaccccagtatctagcctatcctggcccctggccctcctttttttttttgagagggagtcttgctctattgcccaggctggagtgcagtggcacaatttcagctcactgcgacccccgcctcccgggtttaagtaattctcctgcctcagcctcctgagtagctgggattacaggtgcctgccaccatgcccggctaatttttgtatttttagtagagacagggtttcaccatgttggtcaggctggtctcaaactcctgacctcatgatccaaccgcctcggcctcccaaagtgctgggattacaggcatgagccaccgcacccggcccccctcctttctgtagatctgcctggttgtctcatcctgtggacatgcgagatgctcagtctagctttcatagtagggtttgagctgttatctcacctgcagtcttttctccttgcttgtctgaataccatttgctcaaggcagattactatagtaactccagccaacgcactctttcacctcaataattgttcagaagacattttttgccttaaagtcttgactatatcatttggtattttgtggtttgctatcttgttttattcagcttttcaaagaaacagctttggtttcattaatttttatcgtttttctcttttttgttgcattgattttttttttttttgagatggggtctctatgacccaggttggtgtgcagtgtcgcagtctcagctcactgtaacctctgcctcccaggctcaggagaccctcccaccttagcctcccaagtagctgggaccacaggcacatgccaccatgcctggctgatttttctttgtattttggatacagacagtttcgccatgttgcccaggctggtcttgaattcctgagctcaggtaatccacccccctgggctcccaaagtgctgggattgtaggtgtgagccaccacgcctggccttgttgcattgatttcttctcttatcattgccatccctttgctagtttgttaaggtaaaaggttagattatcaattttggacctttctctttttttttttttgagacagagtctcgccctgtcactcaggttggagtgcagtggcgcgatctctgctcactgcaagctccgtctcccgggttcacgccattctcctgcttcagctcccaagtagctgggactacaggtgcccaccaccacacccggctaatatttttttttgtatttttactacgacgcggtttcaccgtgtttgcgaggatggtctcgatctcctgaccaccacctgatcagcttgcctcggcctcccaaagtgttgggattataggtgtgagccaccgcacctggcctggacctttctctttttctttttttttttttttgagatggagtctcactctctcacccaggctggagtgcagtggcgcgatctcagctcactgcaacctccgccctctgagttcaagcgattctcctgcctcagtctcccgagtagctaggattacagatgcctgccaccgcacccggctaatttttttgtgtgtttttagtagagacagggtttcaccatcttggccaggctggtcttgaactcttgacctcgtgatccacctgcctcgtcctcccaaagtgctgggattacaggcgtgagccaccgtgcccagctgacctttctcgtttttttttgtttgagacggagtcttgctctgtcgcccaggctggagtgcagtggcgcaatcttggctcactgcaacttccgcctcctgggtttgtgtcattctcctgcctcagcctcctgagtagctgggactatagtcgcctgccaccatgctcagctaattttttgtatttgtagtagagacgggtttcaccgtgttagctgggatggtcttgatctcctgacctcgtgatccacccacctcagcctcccaaagtgctgggattacaggggtgagccaccgtgcctggccaacctttctctttttctaatagtattattcacttctgtaaattttcctctcagcattgctttagctgcattcctccctttttttttttttttttttttgaggcagagtctcacattttcgcccgggctagagtgcagtggcacgatctcggctcactgcaacctccgcctaccctgttcaagcgattctcctgcctcagcctcccaagtagctgggattacaggtgcccgccaccacacccagctaatttttttttgtatttttagtagagacaggtttttaccatgttggccaggctggtcttgaactcgtgacctcgtgattcacccgccttggcttcccaaagtgctgggcttacagatatgagccatcgtgcccggccccattcctcacattttaatatgttgtgttttcatttttatttagttaaaagtatattctaatttcccttatgagttcatatttcaccttaggttgtttcaaattatgctgtttacatatttgggggtttcccttattagtttctgctttgattccattatgattaggaaacatgttgtatatgatcttagttttaaaaaatgtatcaagattttttttttaataattaattcatttagaggtgggatctcactcttgcctaggttggacccaaactcctgggcgcaagcgatcctcctgcctcagccttccaaagagttgggattacgggcatgagctactgcacctggctgaggctgactttttgatgtcctagcgtacagtctctcttggtgcctgtcctatgtgtgctggaaaatatctgttaatctgtattctgctattgttaggttgagtgttttacaaacattaggtccagtcagttggttacattgcttaagtcttctatatccttagtgatattttttgtatacttctatcgattactgaggagtattagaaatctctagtaatcccagcagtttgggaggctgaggctggtggattgcttgagcacaggagttcgagaccagcctgggcaacatagcgaaaccccatttctacaaaaaaaatacaaaaattagctgggtgtggtggtacacgcctgtagtcccaggtgcttgggaggctgaggcgggagagtctcctgagcctgggaggtggaggctgcaatgagtggagatggtgccattgcactctagcctgggcaacagagcaagaccctgtcttgcttgagagaaagatccaactacagctgtgagtttattgtctttcaggtccatcatttttgaaattctgttattagttacataatgtatttaggattattaggtcttctgaacgagttgactactttatcgtatcaaatatccctctgtattcctgataacattccatggtctgaagtctttgtcttaatcagtagtgccactccagctttgttttgtgtttgcatgggtgtatttttccatctttttactgttaatctgtgtctttgtaactaaagtttatttcctatagacagcatatagttggctctttttttttttttttttttttttttttttgagatggagtctcttccttggttgcccaggctggagtgcagtggcatgatcttggctcagtgcaacctctgcctcccgagttcaagcgattcttctacctcagcctcccaagaaactgagactacaggcgcgtgccaccacgctcagctaatttttgtatttttagtagagacggggggtctcaccatgctgtccaggctggtttcgaactcctgaccccgaggcccgcctcagcctcccagagtgctgggattacaggtgtgagccaccatgcccggcctttttatttaaatccaatttgacaatgtttgccttacaaatggtctaaatacctcaattaaggttaatgtaactatcaatgtggcaatgtagctcagtttaaatctaccgtcttactcttttttttttaaattattttttctgcttttctcttgtcctgccttcttctgaatttagttgttttgtgactttatctccacttttcacttatttggctacatggtttttttcttattgtttgctctaaggtttacagtatatacatagctcacttactgtgatctactttgaccattagtctactacggatcacttcacatatagtacaagaaccttagaataatacactttaagttccactcccactcttagtagtatttttgtcataacattttaattgtacatgtattataagtgctataatactttgttactctttttgctttgaacagcctttatcttttgtagaaattgcaaaatgagaaaaaatatttttttgcattttacccacatacttaccatttctggtgttcttcactagtttgtatagctccatctggtgtgcttttttttttctttttcttttcttttttttttttttgagacacagtcttgctctgtctcccaggctggagtgcagtggtgcgatctcagctcactgcaacctctgcctcctgggttcaatttctgtatttttagtagagacggtttcatgttggccaggctggtcttgaactcctgacctcaggtgatccacccacctcggcctcccaaagtgctggcatgacaggcgtgagccaccacacctggcccaggggaaccatttttttttttttttcccctgagatggagtctcgctgtgttgcccaggctggaatgcagtggcacaatctcagctcactgcaacctccacctcccaggttcaagcgattctcttgcctcagccttctgagtagctgggattacaggcgtctgccaccacacccggctaattcttgtatttttagtagaaacagggttttgccatgttggccaggctggtctccaactcccgggctcaagcagtcctcccaccttggcctcccaaagtgctgggattataggcatgagccatcgcgcccagcctcattgtgttttgctttctatttccctagtgactaatgatgttgaactcaaatctttctttagtagtagggataaaactaactgcatcaagtagtctccaccctccccgcccctggctcatctgtaatttacttttttttctactacctttagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtacagcctggttcaacgtatttctaaaccctattgctcaggccctaagggaagtgggtatttctttagttttaggctttattttttctgtaatcttggttgtacacccaaacaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacaggtgggcacctaggagggcatgccaaccctggggcaggggcagtggtggcctttgaaccgtgtggagttcagggtcagagcatgccatggttgtatggaggtgagaaggctggttctactgaccctaattatttttggccaggaaggagtgctgagctcctcatatgagatcacgttttgacttgaatctttctttttttggaagacgcctgactttagaagacctagaagattcatgggatcgtggcattcctcgaatcaataccctcttccagaaggaccggcacacactggcttatgataagggctggcgtgtcagaactgactttaagcagtatcaggtatgtagagggagcagattttccctgagtcaggaaaatccatggctatccccgaaacttggggcaataggcacccagaagcttgaccgtgcctgccttgccatctaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctggtgaggattctcctctcttagagggacctgtcacaaccctttgagctcatctcttgtatgcctctgtgatttcctgtggtgtttcccagacagccacctccaggaggttagcagtgtgctgggaaatggcaggatatcacctcacctgcttctcttgctccccagggagaaggccagtggctttgaggaatctatgaagtggaagaagctaactaatgctcagcgatcaggactgaaccagattcccaatcgtagattcaccctctggtggtccccgaccattaatcgagccaatgtgagtgtgattgacactggagaggggaagctaaagacagttgctgcttcttgccttggttatgtcgtgagcgcccgagtctcttgatctctaatgtcacattgtcgttttcctggcaggtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgggctggaatcgaggggagagggtactgtagagagtcagctcaggtggaattgaggggagagggtactgtacagagtcagctcaggtggaatcgaggggagagggtactgtacagagtcagctcaggtggaatcgtggggagagggtactgtagagagtcagctcaggtggaatcgcagggagagggtgctgtacagagtcagcttaggtggaatcgcggggagagggtgctgtacagagtcagctcaggtggaatcgcggggagagcgtgctgtacagagtcagctcagcttgctcttttgcatatgggaaatccaccctggaagctctgaggatgagactcctattgcctcattatcttattgtacaaactctgattttaattgggcttccttaacaagtcttaatctctccatgttttccttcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaagtaagtgcctcaggacccagccctaggcagccaggacactttcgttttcctgttcttctagccctgcaactttaggaattgtcctgtctgcctttgtttcaaacttggagccagtgctacgcttggagcctgtcaacacccttagtcagatctgctgattctctggggtcctgctgacctggaacaagttggtggagtgggtgggatggttttgggatttaagtggttctggttctggggacattggttatgcccatggtttcttagaagcttgaaccctcttcatcctcagggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacaggtgagttgaggctcaggaccatgtattttcaggccaggcgcagtggctcacacctgtaatcccagcactttgggaggccgcggtgggcagattgtctgagctcaggagtttgagaccagtctgggcaacatggtgaaaccctgtctctaccaaaatacaaaaaattagctgggcgtggtggtccacgcctgtagtcccagctactcagaaggttgaggtgggagaattacttgaacccgggaggcggagcttgcagtgaaccgagattgcgccactgcactccagcctgggcgacagagtgagactccatctcaaagaaaaataataataataataaataaataaataatccgtgtattttccattagctccatactttaacgtagtcatacttttttactttacctaagtgagaggaagtggcccattcctcctatgggtcactgattctcttctccagcctgtatgtacacatgagcagagtgttgtcagcctggcgaacagtctttcttcctctgtagagttggcagcttgtcttgtttctggggctgtcattctcgtcttaacttttcttgacccttttatcctcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaaggtgagtgttagcagcagtgtataggtgcgggactctgtacatggctgtgggagagtaatgggctaagtgtgtacacatgctgggaagaaggcaggatggggatgtgttgtgtaggccatgctaacgaatgccgtcctcctctagacctttgaagggaacttgacaaccaagcccatcaacggagccatcttcatcttcaacccacgcacagggcagctgttcctcaagataatccacacgtccgtgtgggcgggacagaagcgtttggggcaggtgagcaggtttaaagatgaagaggctgtagaaccatgttgcctcttattcttggggtggacttggtaatatttactggtttattagatgaaaggctgagaacatctcatttgaacttatccccaaaataccttgggaagtattctgtgggaggtccaagagtgtatgaggtgcttcgttcccttccagctggtctgtttcctgaatttctaaccttgaacagggctatcaaaaatcatttttccaaaggcaacgcatactctttttttttttttttttttttagccggagtctcgctgtgtggcccaggctggagcacagtggctcaatctcggttcactgcaagctccgcctcccgggttcacgccattctcctgccttagcctcccgagtagctgggactacaggcgcccgccaccacgcctggctaattttttttgtattttttagtagagacagggtttcaacgtgttagccaggatggtctcgatctcctgactttgtgatctgcctgcctctgcctctgcctcccaaagtgctcggattacaggtgtgagccactgctcctggccagcaatgcatattctctttttttttttttttttttgagacggagtcttgctctgttgcccaggctggaatgcagtggcctgatttcagctcactgcaagctccgcctcccaggttcacgccattctcctgcctcagcctcccgagtagctgggactacaggtgcccgccaccacgcccggctaaattttttgtatttttagtagagacggggtttcaccatgttggccaggatggtctcaatctcctgacctcgtgatccgcccgccttggcctctcaaagtgctgggattacaggcttgagccaccgtgcccggcccagcaacgcatattcttgaaacatccactttgaccaaatctcttctctacctcacaactcttgctgaattaactcttctttagcttcctagacgttcaacatctggctgggctgtatctgtccagccagtttctcttcctttacatttatagcatgtttcatcttacattcagtccaggatcttagtagcccaaacccctgatgctcatctccaaatctgtgttttgcttgtatttttctttctagaatgaactcccctctttgctctgttaatcacagtccctccttaagacacgtttttttgtgcagcttttttctgatcctagtagccttaatttcttttgttcctgaactctgtaaaacagtgtatagtttagcacatactcatgtgtcagcttgtggtattgtcttgttgaaaggggctgtcagcctggtcattggacacggccatttgatactctttgtaccttctaagtgcctaacatttaacatcagtgttcaatagaaacgtagttggattatttcaaaactaggatattctgttctagttgatctgggagggtagagactaaatttccattttcttctctcttgcttttaagttggctaagtggaagacagctgaggaggtggccgccctgatccgatctctgcctgtggaggagcagcccaagcagatcattgtcaccaggaagggcatgctggacccactggaggtaagagggtggggtggggtaggagaaaagagaccttgagaccttcaggctgtttctcatcttggacttgatcttgtcttaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggtatgaacctcgggaagagaagatcgctggaggaggagcgggtttagggttaggagaagatcctgtgtcaggtttttgccattttcacatttttagcctatagattgggtgggaactctgttgactttcatgagagtttaagaccttaaagttaaaaatcaactcttggggccgggcgtggtggctcacgcccgtaatcccagcactttgggaggctgagttgggtgaatcacctgaggtcaggagtttgagatcaggctggccaacatgacgagaccccatctctactaaaaatacaacaaaattagccgagtgtgctgggatgcacctgtagtcccagctactcgggaggctgaggcaccagaatcactggaacccaggaggcagaggttgcagtgagccgagatggcaccattgcactccagcctgggcgacagagtaagactgtctaaaaaaaaaaaaaaaaaggccgggcgcagtggctcacgcctgtaatcccagcactttgggaggccgaggcggcggatcacgaggtcaggagattgagaccatcctggctaacacagtgaaaccccatctctactaaaaatacaaaaaattagccgggcgtggtggcaggtgcctgtcatcccagctattcgggaggctgaggcaggagaatggtatgaacctgggaggcggagcttgcagtgagccgagatcatgccactgcactccagcctgggcgacagagcaagactctgtctcaaaagaaaaaaaaaaaattcttgggtttcatgaaaggttaggattaaagtgggagagcctcaagcagctgacctaccccactcttccaaatcttttcccaggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaagtgagcagtgctggtggggacacagacaggaggtctatatacggttttctggggttttttggaagcacttaggcttagaagtttctcaagaaggccaggcgcggtggctcatgcctgtaatcccagcactttgggaggccaaggtgggtagatcatttgaggtcaggagtttgaaaccatcctggccaacgtggtgaaactccgtctctactaaaaatacaaaagttagccgggtgcgatggcgcctacctgtaatcccagctactcgggaggctgaggcaggagaattgcttgaacctgggggcagaggttgcagtgagccgagatcatgccactgcactccagcctgggcgacaagagtgagactgtctccaaaaaaaaaaaaaaaaaagacgtttctcaagaaattatcttgtcttagccaggcttgagtgctcatgctagtaataccagcactttgggaggccaaggtgggaggattgcatgagccaggagttgaaaccagcctgatcaacaagagactgacgccatctctaccaaaaaaaaaaaatttaaaacaggtgtggtggtacacgcttgtagtcccagcttcttggaggctgaggcaggaggcttgcttgagcccgggggtttgaggctgcagtgagccatgatgatgccactgtactccagcctgggtaacagagcgagactcttgtcttgaaaacaaggaaagaaattatcttacagagtctcgaggaagagagatacagcagtgtcttcgaatagtatgggaagcatccctgttttagggcttcagtctgactcttggccattgtttctcactgttgccatttcaaacagggcatttctttactgtccatacatgggaagaattttgaacatccgagaccctaagtatccgagactgctgccaacacacacacacaccttcctcccctcgtctccctccctgtcatcgtggcaaccaaaattatccatagggtgacggacaataccacctctgattaagaaccagtattctagggtttctggggtttccatttctgagaacagttccatgccagagcattgttttggtcaaggaagcgtagggtttatggatgctaaacagtgggaaggtgcacacgcagtgtgctgtcccgcttggatctgacgaatcttggaagtgttagtgcacctccgtttcacacttcctgtagaagcagctcttgtggattgtctggggcgtgagtataggctgtcctgtcctaccaagttacaccctttccattgaggcagaagtgaccaaggggaagggatccttgtaatataacccacaccatccccacagtgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcaggtactgtcgggcaagagggtggggatggaaaggccggctgcactacctaaggtgctgggctgagcgatgctgacactccctgcctgtttttagggccatctctgctgccaacctgcacctaaggaccaatcacatctatgtttcatctgacgacatcaaggagactggctacacctacatccttcccaagaatgtgcttaagaagttcatctgcatatctgaccttcgggcccaagtgagtaagtggactcagctaggccacagtgtgtgcccaactcattttgtgcctaaaactcagacctgagattgtctggaacttgagatgctggtttcaagattcatggatgagtaattatacaaggatagccaaaacaacgaggtgggttttggccccatgagatagcaaaagctgtggcagctgagagaaggtagtaattgtagtattggcctgatagtatttggaagagaacagatatggtcagaaacaaattcctgaccaggtgtgcgtgctggctcatgcctgtaatcccaacactcggctgggcacagtggctaatgcctataatcccagcactttgggaggcctaggtgggtggatcacctgaggtcaggggtttgagaccagcctgaccaatatggtgaaaccctgtctctactaaaaatacaaaaaattagccaggcatggtggcatgcgcccgtagttgcagctactagggaggttgagacaggagaattgcttgaacccgggaggtgaggtggagcttgcagtgagccaagattgcatcactgcactccagcctgggcaacagagcaagaccccgtctaaaaaaacaaaaccaaaaaaaacgtggctgtagtcccagctactcaggaggatgaggttgcttgaacgcaagcagtgagctttgatgaccccactgcactccaggctgggcacagtggctcatgactgtaatcccagcactgtgggaggccgaggtgggcagatcttttgagcccaggagttcgagaccagcctgggcaacatgacgaaatggagtctctacaaaaaaaaaaaaaaaaaactagccaggcatggtggcatacacctgtaatctcagctactcaggaggctgaggtgggaggatcacctgatcctggagggtggtgagtgtagtgagctgagatcatgtcactgcctgctagcctgggtgacagagtgataccctgcttcaaaaaagagaaaagatgcataactttactagtgtatcagggatattatagtttataaaacatcattttgggccaaggtgggtgaatcacttgaggtcaggagttcaagaccagcttggccaacgtggcgaaaccccgtctctcttaaatatatgaaaattagcggggcatggtggcatgtgcctgtagtcccagctactcaggaagctgaggcaggagaattgcttgaacccaggaggcggaggtcgcagtgagctgagatcacaccactgcactccagccttgctgacagagtgagactccatctcaaacccactatttagtggctgtcaggttggcaaatttgaaaagattgttaatatcctgtgtgggtgagtttatagtaaacagatcctctttctttcttggtgataatgtaaaacttaaaatagcaccaagtgctggttttccagatgttttcagcttgtgaaaatacactgagctgcatgtgtgctcatttgcttgtgaatactatgcttaataatcagctggggagcttgtgagcagtgcagattcctggaccccactcaggagattctgatgtggtaagtccgcgatgaggtccatgtctaacattttgaacaagcaccccagctgattctgatacagggggttctgatcacgttttaagaaactctgtcctcgttcttgggggaaggaaggaaacagagggctggcagctccaactctgacctggtactaagaagagttttggttcctgacccctttgtctccagattgcaggatacctatatggggtgagcccaccagataacccccaggtgaaggagatccgctgcattgtgatggtgccgcagtggggcactcaccagaccgtgcacctgcctggccagctgccccagcatgagtacctcaaggtaatggggagtgatggagcctgggagtgtggaaaagctggtgcgattcctgtctgtggatgggattcagctctgtactcctctttacctataggagatggaacccttaggttggatccacactcagcccaatgagtccccgcagttatcaccccaggatgtcaccacccatgccaagatcatggctgacaacccatcttgggatggcgagaagaccattatcatcacatgcaggtgggcctgggctccttgggaggaagtatggtggggcagggattgcaggccagggcccagaacagtggcctgagctgttactctgtcctcgttcctcccccagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtaagtgggaggagcctggggatgtggggatagcagtagggataaggtgaggccatcgccctttgcacttggggcctggctggcttggaggtggcgcaggctgcatgaggcaggagccctgttaacattggctgtttccttctccccgaaggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 5828 - RNA, 31777 nt, Homo sapiens
gacagcggcguggcggcggcgguggcgguagcgacggcacgccguagggcggucagaagguuuccgguuccgguguaacguucgggcuccgucucaggggcugaaguuugugaggugaguaguggccccgggcccacagaggguaauuccaguccgcgccacuguggccggggacucaguccaaggggaggaccgaagcgggaggguucagcgggaaggagugugaaaggaguaccugguuuggugggagaagagguuggaaugagauuguugagaggaaaagggcgggggcgggaaggagaccggguugggagaccagcucuggggugaggaguuuagguagaacaagguagaguaagagacugguuggagugacggagagaguaaaaaugaagauuagcgggggaguggggggcugcagagggaaacucagguuguagcaaacaagagcacggaguaaggaauuccuucugaagacuggauuuggauucugcugccugcucauugagaggagagaucauuguaccucgcuuuccuuccgcacccccacuacccccgcaccucgcaguuauuguugagcauuugauuagugacaaggcuaauuaccguuugaaacuuuuuuauccauuggcuguuuaguuugcacgucaucuuauggagguaacaguggcaccucauuuauugcuuugggcuuucaaauugcuuauacuuucuagccuaucauucaauucuaguggaauauaagacccguuaaggugaggacucuuguuaguuuugcucacuguuuuauguauccaccgcaccuaguacauugcuugacacuuaguaguuacucaauaaauauuuauugaaugaauuaggauguaaauauggcaguacucauuuuguaagaugguaaacuguggcuccaaagaauuacuuaacuugcccaagggcuuguaaaugguggggcucagugucccaacuguuucugugugaacucuuguuuucacuuucuauggcaucuggauaugccgcuuuugugcaauacauguguaauauguagaaauugguacgcuguaugucuacucauugugggguaauagaaccaccauagaauuacucacguaacuugucacugaggcagaaaaucuuucagucuuaguuucaucacuucaaucuacuagcuuccuuuggauauaccaaaagugagucuauuuggcagcaagucuuauagacucuaguauagaggcuaaacuuaccaagaauguagaaguuaaucagacuggauuuuuuggagaaaagaugucuuaaaacaucuugaaagaugauucccagaucuuugauaaguggcacugcugggaauagcugagcuuggaaauugaggucagucaauuuauugacucccauuuagacaccuuuuuuuuuuuuuccccgggacggagucuugcucugucgcccaggcuggagugcaguggugcgaucucggcucacugcaaccuccgccuuccauguucaagggauucuccugucucagccuccagaguagcugggauuacaggugcaggucaccacgcccagcuaauauuuguauuuuuaauagggaugcgguuucaccauguuggccaggcuggucucgaacuccugacgucagauaauccacccgccuuggccucccaaaguguugggauuacaggcgugagccaccgcaccuggcuuuuuuuuuuuuuuuuuuuuuuuuuuuggagacacaguuucacucugucgcucaggcuggagugcacaugauuuuggcucaccgcaaccuccgccuccuggguucaagugauuuuccugccucugccucauaaguagcugggauuacaggugcccaccaccucaccuggcuaauuuuuguauuuuuaguagagacaggugcagugggucacgccuguaaucccagaacuuucggaggucaaggugggcagaucacuugagguaaggcauuaccuggccgauauggugaaaccgugucuuuauuaaaacuacgaaauuggccaggcgugguggugcaugccuguagucccagcuacuugggaggcugaggcaggagaaucaagugaacccaggagauggagguugcagugaaccaagauuacgccacugcacuccagccugggcgacggagugagacugucucaaaauaaaaaugaggguauucuuuucugagcugaaggaucaucaagucagcugauggagacccuguagauugaacaugauaauuaccuguaugcagaauucccacugggaugaauaugaccacagagaaaugugacagaacauucuuuuuuuuuuuuuuuuugagacggagucuuacucuguugcccaggcuggagugcaguggcgcgaucucggcucacugcaaccucugcugccuggguucaagugauucucuugucucagccucccgaguagcugggauuacaggcgccugccaccaugcccagcuaaauuuuuuuguaguuuuuaguagagaugggguuucaccaucuuggccaggcuggucuugaacuccugaccucgugauccaccugccucagccucccaaagugcugggauuacaggcgugagccaccgcgcccggccagaacauucuuaaagaucaugagauuuaauuuaauaucuaagaugacugaccuggauaaacccucuuuuacuugcauaccuuaaaagaagggaauccuacauaagucaggguuggguuagggaaugccugccuggaaguaggaagaauggaaaagcuggccucuggaugggcuuuuuuaguucuguuuuaguguuacuagguuugcaaguccuuguugauaugacaggaucaagaaagaagcuagaacuaauuucucagacuuagcuuauucacagaguuuguuuauuccgcagauuucauugaucaacuuaagaguuagaauuaaaaaucaaaugggaucucuuucugcuuugagauaugguucuuggggaaaauauuugccuucaaaugaguuggaaaaacuugucuagggauugagaauagggcuggggaaugcauuccugauguacuaaccauuucccuggaucacuuuagucuuuuuuuuuuuuuugagagagagucuugcuuugucgcccaggcuggagugcaguggugcgauuuugacuuguugcaagcucuaccucccugguuauuccccugccucagccucccaaguagcugggauuacaggcacaugccaccacgcccagcuaauuuuuuuguauuuuuaguagaggcaggguuucaccauguuggccagacuggucucgaacucuugaccccaggcaguccauccaccuuggccucccaaagugcugggauuacaggcaugagccacugcacccagcccacuuuagucuuuucuuauucucuaacuugucucuuuuuuuuuuuuuuuuagguguaguauugaguccuguuugagcuauuguucucuuuuuccugaaaaauggcacugucaaagagggagcuggaugagcugaaaccauggauagagaagacagugaagaggguccuggguuucucagagccuacgguggucacagcagcauugaacuguguggggaagggcauggacaagaagaaggcagccgguauguaccuuucugcaucuuuuaucuuaacauauagggugaccccaaacacugcuuugaacuuccucaaaauucucucuguugggaacaucuaaaaaaauggcaggccauauuuuauuuucaccuguauuauagugaaaauaggcuaaauaauaauuugcuuuuucucuuaauugcuuauuuuuuauguuauuuaugauagauuuuaaaucuucguuuggcuaccauacugagucaccuaaguuagauuuacuuaggaaguaugcuuaagucagauaggcauauucagauucagacugaacaucucaacauacaaaaaucuuuaugaaauacaugaaaaagcuugaaggagguagauuuuguuaaugguaggcuucuacaacuugcuauuugggaaaggugagggugguuauucaucucaaacuugauguucaagguaaacagguugcucuaacugcaccacuucccacgccaaaaaauuauaacuauuuucaccucacagggcaaggucauuuaguguaagagagaugggaauccuacaaaaaacuuaaaauuuguuucacuccugggaauaaaauuccaguguugguaccuguuauaggccuaguauuagacuguguacucuuaccuuuccaacccuaccaccgccuuucuuccugucagaucaucugaaaccuuuucuugaugauucuacucuccgauuuguggacaaacuguuugaggcuguggaggaaggccgaagcucuaggcauuccaagucuagcagugacaggagcagaaaacgagagcuaaagguagguuacaauuuacugucuaaugagcucaggacuguuuugaaugguaacagaguugcugagcuuaccaguucacacguugauauccucuauuuagagcagcaaauguucaagagagguacuuagacauuagaguaggagagaugaauuagugucaucaccaucugaacuaccucuaaguucauggguugaaauauccaaagaaauaauuggcagcuuugucuuuuuuuagauaacaggaguuuugauucucauguuucuccauauuuccuuuuuuuccuucuuacuguuacuuauaaacugauugcucuaagauuuuaucuuugauuuauuugaggccuaauaaguuguuuuagaaugugacuccacugguaccugagcuguacaccucauuguugccucuuuguagaaguuucucugcaaugcacuuguagauagaauaccaaaaaauaacuauuauuuauuauauucuugagagcuuaccauuugcucuauggcauauugcugguccucugcugccaugagugaaacacuuggaggaguugucaguacccccuuaacuacuacacuuuuuauucuguaguugccgacugauccuggccucuuucaguauuagcaguaucaaguagccuauuuuucuacucauuucccaguaucucucuuuaggagaaaaaaaaaaguucugugacuccuaucaaaccuuccaaaguucuucugauaccuuggcuaucccauuacuuuuccugagggaaaagagugaauaaguaaugucugcuugguccccuggccaggcuauggaacuaaagaaaaaaagcagagagauuugugcccuuuguguuuggagcauuguaggguggucagagaaggagagauaguccuugccuuaaaacaauuuguaauuugucaggcaguguggcaugugccuguaauccuagcuacuugggaagcugaggcaagaggaucucuugagcccaggaguuacaauuuagaagaggcagggguaucacaaaauauauauucacguauuauaaaaucuaaguagcaguuucauguaaauuuuaggguugguuauagaauuucagaccuauguugaauuuuguuauauuuaagguggaaugauugauccacaguauacacagaucuguacagugaagauuaugucacgauagggcauacuucuuuuuuuuuuuccuuuuuuuuuuuucaagggugagucucacucugucgcccaggcuggaguacaguagcgcaaucuugacucacugcaacuuccaccucccagguucaagugauucuccugccucagccuccugaguagcugggauuacaggcacaugccaccaugccuggcuaauuuuuguauuuuuaguagagacgggguuucaucauguugaucagguuggucucgaacuccugaccucaagaucugcucgccucggccucccaaagugcuggaauuacaggcaugagccacugcgccuggccaguagggcauacuucuguaugagugcugagggcaugcugugaaugaagugacuacauugggugggauuaauaaaaauggcuucuugaaggaggugucuagauagccuugggauacgggucccauuuuugguccauucagguccccaccccacacaauauauuaugggagaguccuuuuucuugaacuguaggaguuccaggaagcgcucgccccuggccgaggauauguccuugcaaaacacgagcccuccuagugaagaggggaugucacccaaagccuaccaccgguguguacauuugcuuuuucccauugucccuuccaguuggccacucucgguccuguuaaauucaccuugcaaauuagucaucauauuugaguuuccauuguuugaugaaaacaaaguguuaauggggauuacugaagaagaaagagaaagccccuguccuggaagagcuuagacuuaguugggaaaacuauacuaacauugaaauacuuaacacuuggcaaacagaauaucaacaauguaauuuaaccuaauaugaaccaagcucuuacacgcuaagagaaugugaaacaaaaguuuaaucagagugggauagguuauaaugaggaaaacuucuuggaggaggugaguuuuaggcaggauuuggaacagggguuguggaaaaguugagagaaaucauuauaaaugugagcaguagcauuugcaaagaccuugagaugggaacauuuauaagaacaugggaaugaaauuuguuugacuggauuaggagaauguugaaguugggugagauggagagucuaguagacccugcuucuggcagguggcuauuugcaagguugugucauauuccccugggaauagccagaaaaugcugguaggggcuaggauaauucuuccuuucuccccacggggagggauacagcuuuucuuucaucuuggguucccuuaggagguguuuggugaugacucugagaucucuaaagaaucaucaggaguaaagaagcgacgaauaccccguuuugaggagguggaagaagagccagaggugaucccugggccuccaucagagagcccuggcaugcugacuaagcuccagguuagugauuagggacuggaagcaaagugguuuugugaguugaagaagcaaaaggugcaugggucuguauuuauuguggaauuuuuuuuuuuuuuuuuuuuuuuuuugagguggaguuuugcucuugucacccaggcuggaauacaguggcgcgaucucagcucacugcaaccuccgccucccggguucaagcaaaucuccugucucagccuacugaguagcugggauuagaggcacccaccaccaagccuggcuaauuuuuguauuuuuaguagagaugggguuucaccauguuggccaggcuggucuugaacuccugaugucaggugaugcacucaccuuggccucucagagugcuagaauuacaggagcgagccacugcgcccggcuaauuuuuuguauuucuuuuaguagagacaggguuucaccauguugggcaggcuggucuucaacuucugaccucaggucaucugcccaccuucgccucccagagugcugggauuauaggcgugagccagcgugccucgccuuauugugaucuugauuugaauuaguguuuagcauuuggggaaacuuuuuuuuuuuuuuuuugagauagaguuucacucuguugcccaugcuggaguguaguggcgugaucucagcucacggcaaccuccaccucccagguucaagcgauucuccugccuaagccuccggaguagcugggacuacaugcgaacaccacuacgccuggcuaauuuuuguauuuuuaguacagaugguauuuugucauguuggccaggcugcucuggaacuccuggccucaagugaucugccaccucagccgcccaaauggcugggauuacaggugugagccaccaugccaggccagcauuugggaaaauuuuauuuccugcuuuauguuuuagcguucuuugauuugaccaggaguauucuagguaaggguauugaaauugccauuuacuguggcaagcaaaguguguuauguacauuauuugccuaauuaccuaugucguugagucauugagaaaauuaaaugaaaugaucagaacucaucuuaaugacagaggagacucuccaaacauaaugcaaagaagauauaauccacugauaaauaauuuuaaguugacuuuauuuuuuuuuaacaggaaguauuuguguuuuuucaauuggcauuguuaaauaauaccacauaaguguuucuuuuaccauuuaauauuugagggggguaauagaacauauacagaaauauggguggguggauuugcauauaugugauauuuacagaaggaaagaaauggauuuuuuuugugugugugugugagauguucucucugucacucaggcuggagcgcaguggugcgaucucgguucacugcagccucugccucccagguucaagugauucuccugccucagccuccuaaguagcugggauuauaggcaugugccaccacgcacggcuaauuuuuguauuuuuaguagagacaggguuucaccauguugaccaggcuggucuggaacuccugaccucaagugaucugccuaccuuggccucccaaauugcugggauuauaggcgugagccaccguaccuagccuguuuuuguuuuucaggcaaggucucacuuuuuuguccaggcuggaguucaguggcgagaucuuggcuuacugcaaccucugccucccgggcuugagugauccucccaccuuggcuucccaaguagcugggacuacaggucaccaugccuggcugauuuuuguauuuuuuuuaaagauugaguuccaccauguugcccaggcuggucuugaacuccugggcugaaaugauccuccugccucagccucccaaagugcuggacuuacaggcgugagcuaccacgcccagccaauuauuuucuuuuuuggggggugggggauggagucuugcucugucacuuaggcuggaguacgguggcgcguucucggcucacugcaaccucugccucccggguucacgccauucuccugccucagccuccugaguagcugggacuacagguauguaccaccaugcccgacuaauuuuuuguauuuuuaguagagaugggguuucaccauguuagccaggauggucuugaucuccugaccucgugauccacccgccucggccucccaaagugcugggauuacaggcaugagccaccgugccaggcccaaugauguuuuuuauggagaauggggauggacguauucacaacauauccuuuuguuauguuucuuucuuuuuuuuuuuuugagacggagucucacucugucgcccagaguggaguguaauggcgcuaucucggcucacugcaacguccgccucccggguucaagcuauucuucugccucagucccuugaguagcugggauuacaggcacgcgccaccacgccuagcuaauuuuuuuguauguuuaguagagacgggguuucaccauguuggucaggcuggucucgaacuccugaccucgugauccgcccggcucggccucccaaagugcugggauuacagacgugagcugccaggcccagccuguaauuuuucauuuuauuuuauuuuauuuuuugagacggagucucgcucuugcacuguugccuaggcuggagugcaaugccgugaucucagcucacugcaacguccgccuccuggguuccagcaguucuccugccucagccuccugaguagcugagauuacagaacgugcaucaccauauccagcuaauuuuuguauuuuuaguagagaugggguuucacccuguuagccaggauggucucgaucuccugaccucgugauccaccugccucagccucccaaaguauugggauuacaggcgugagccaccacgcccagcccuguaauuuuuaauuuuuuuauuuucuuucuuucuuuacuuauuuagagauggagucucccccuguuguccaggcuggagugcaguggcaugaucuuggcucacuguaaccuccaccuucuggauucaagcgcuucuccugccucagccuccugaguagcuggcauuacaggcgcccaccaccacacccggcuaauuuuuguauuuuuacuagagacgguguuucaccauguuagccaggcuggucuucagcuccugaccucaagugauucgcccaccucagccucucaaagugcugggauuacaggcgugagccaccaugccugacccuuccguaauuuuuguauuuugaauauaucaccuauucaagaaaaaauguuaaagacaaauguuuaaaaauaucuugaagcaguuuaagaacaggucuguuuugcaaaauguaagaggaguuguuuggccauacccucaaagcuuaucauucugaacuucuuuaggacagaagggguuuauagagacuagggagcaggucuuugcaccaucgucucuuguuucccaaacuaguaguucaaguacuaauaucaugauuuuuuaaaaaaaauuaaguauaggcugggugcgguggcucacaccuguaaucccagcacuuugagaggccgaggugggcggaucacgaggucaggagaucgagaccauccuggcuaacagggugaaaccccaucucuacuaaaaauacaaaaaauuagccgggcgugguggugggcgccuauagucccagcuacucgggaugcugaggcaggagaauggcaugaacccgggaggcagagcuugcagugagccaagaucgcaccacugcacuccagccugagugacagagcgagacuccaucucaaaaaaaaaaaagaaaaauuaaguauaauauuuuguguagguucuguuagguuugcaugcauuauuuaagugguuaacacuagaccuauaagguagguacuguuuucuucccccuucuagacacuuaggagguuuagagacuaaguuccuuauccaagauaacaaaggcauuaaguggcagaguuaagauucaaacucagguuucucugacuccagagucucaaucaucacacuauauuacuaccuaauaugcuaaucuugcuuuaggaacauggguugaaaaauuccagugcucacuuaucuugacuaaauuuuuugcacuguggugcaggcagaaugugguauagucauucaaaacauuuuaagugucuagaccugagagccuuguggguuuaaaaaccugaaugggagaaguaagaaggagaaauuaacaguuuuucaauuuuuuuccuggagagcagaucaaacagaugauggaggcagcaacacgacaaaucgaggagaggaaaaaacagcugagcuucauuagccccccuacaccucagguauugugucuagauuacucugaacagaauaaucuuuggcacagaauuucuugccauccacucaaaaugagagacuagaagaggugacuacauguuucacuucauaaucaucugcuacagucuaccaugauguguguguauaucuguguguauguauguguguuugucugccugucuuaauuccucugauuucuuuuucucuaucucacagccaaagacuccuucuuccucccaaccagaacgacuuccuauuggcaacacuauucagcccucccaggcugccacuuucaugaaugaugccauugagaaggcaaggaaagcagcugaacugcaagcucgaauccaagcccagcuggcacugaagccaggacucaucggcaaugccaacauggugggccuggcuaaucuccaugccaugggcauugcucccccgugagugucuauuucauggaauaccuuuucauuucugaaguuugagaagcaauaaauaccuuugaauguuacugaucuggcugggcgcagugccucaggccuguaaucguagcacuuugggaggcugagguagguggaucaccugaggucaggagucaggaguucgagaccagccuggccaauauggugaaaccccaucucuacuaaaaauacaaaaauuagccaggcgugguggugcaugccuguaaucccagcuacucgggaggcugaggcaggagaaucgcuugaacacaggaggcagagguugcagugagcugagaucgugccacugcgugggugacagagggagacuccggcucaaagaaaacaacaaacaaaauauuacugauccucuuuuuccacagaaccuagaucauuucucacaguuucauauuucuuaggugugauugauuaaucaguugaauuuuuucucgucuucccuguuggaggguuuauuaucuucuuaugauuuauauaacugagauuaagguuauucaucuaauguuggagcuaggaguauagccagguuuccuuccugguuucaaacucagauuuauccauuaaaccacauugugugagacuagaucugagguuccucugcaacuggucaaagauguuacauuuuuuuuagcaucuacaguuggucuggcaucccaugagugacauaagaauucagggauaaggaaagauaggauuauaaauucauauaauuuauaaacucauuucauuugguuguccuguauacugaaauauccacuuugauauuuuuaaucaagauacuauuggcagggcgcgguggcucacaccuguaaucccagcacuuugggaggccgagacuggcagauugcuugagcucaggaguucaagaccagccuaggcaacauggcaaaaccccaucucucuaaaauauacaaaaauuagccaggcaugguagagcaugcguguaguuccagcuacuuaggaggcugaggugggagaauuucuuugggccugggagguugagguugcaaugagcugugauugugccacuguacuuuagccugggcagcagagugagaccaugucucaaaaaaaaagaugguauugcucacugaugagauuguucccuagaauuauuuuauuguccuuuuuguuguuguuguuguugagagggagucucacucugucacccaggcuggagugcagugaucucggcucccugcaaccucugccucccagguucaguagcugggacuacaagugcccgucuaaauuuuguauuuuuuguagagaugggguuucacuguguugccaaggcuggucuugaacuccugggcucaagccauccacccgccucagccucccaaagugcugggauuacagugugagccaccacacccguccauccaaauaacucuuauagagaaggcacugcagccucaacuuccugggcucaagugauccuccucaaccuccugaguaggugggaccacagguauaugccaccgcacccagcuaauuuuaaauuuuuuguugagaugcagucuccuuguguuggccagacuggucuuuaacuccuggucucaagugaucccucugccuuggccucccaaaaugcugugguuccaggcuugagccaccacgccuggcuuuauuuuguuuuuugcuugccuuaauguuccauacaggauuuauuucuuugcgggcuauuuuucaggaagguggaguuaaaagaccaaacgaaaccuacaccacugauccuggaugagcaagggcgcacuguagaugcaacaggcaaggagauugagcugacacaccgcaugccuacucugaaagccaauauucgugcugugaagagggaacaauucaagcaacaacuaaaggaaaagccaucagaagacauggaauccaauaccuuuuuugacccccgagucuccauugccccuucccagcgccagagacgcacuuuuaaauuccaugacaagggcaaauuugagaagauugcucagcgauuacggacaaagguaucuggcuuagaguauaacacagaauuuggaaaaaguuaagaagcugacaagaaaacauuguuaaaucucuguguucuaggaaauuagauaaauaggucauuuaaagcagcaguccucaaccuuuuuggcaccagggacuuguuucauggaagauaauuuuuccccuggaguaaggaugguuucgugaugguucaagcacauagcauuuauuguguacuuuauuauuauuauuuuuuucgagauggagugucgcucuuguugcccaggcuggagugcaauggggcgaucucggcuugcugcaaccuuugccucccagguucaagugauucuccugccucagccucccgaguagcugggaucacaggcaugugccaccacgccuggcuaauuuuguauuuuugguggagacgggguuucuccauguuggucaggcuggucucgaacuccugaccucaggugaucugcccacuuuguccucccaaagugcugggauuacaggcgugagccaccgcccccgccuuuuuuuuuuuuugggcggggagggggauggagucuugcacuguuaccugggcuggagugcagugguacagucucagcucacugcaaccucugccuccuggguucaagcaauucuccugccucagccuccugaguagcugggacugcaggcaugcgccgccaugccugacgaauuuuuuguauuuuuaguagagacaggguuucacuauguuggcccggcuggucuuaaacuccugaccuugugaucugccugccuugaccucccaaagugcugggauuauaggcgugagccacugugcuggccuauuucuauuauuauuuuauuguaauauaugaugaaauaauuauauaacucaccauaauauaaaaucacugggagccuugagcuuguuuuccugcugaaauggucccauuugggugugaugggagacagugacagaucaucaggcauuagauucucauaaggaaugugcaacauagcccccucacauguacaguucacaauaggguucgcgcuccuaugagaaucucaugccaccgaugaucugacaggagguggagcucaggccauaaugcagguaauagggagcaaucguaaguacagaugagacuguuggcuugccugcugcucaccuccuguugugcagcccaguuccuaaaagacuguuggguuggggaccccugauuuaaagcaaugaauacuuugaaaaaugugcuggacaagauggcucaagccuguaaucccagcgcuuugggaggccgagguggguggaucacgaggucaggaguucaagaccagccugcccaacauggugaaaccccgucucuacuaaaaguacaaaaauuaaccgagcgugguggugggugccuguaauccuagcuacuugggaggcugagucaggagaaucacuugaaacuggaaggcagagguugcagugagcugagaucgcaccacugcacuccagcaugggcaaaagagcgaaacuccgucucaaaaaauauauauauauauuuauuaauauaauacauaauuuuuuuagcagauuuuacuuccuaauucguuucuacauaaguggaaauauuaugaaauugaguuugaaaauucuccacauacaacuaaguggagggaaacaauuugaaacauucugagugacuaaggaaggcuugccuguaguuaaaauuuaaugagacaguacaccuggagaguugaauugauuguauauugaaugaccuuugccgccuuuuuauccucucaaagugagguuuucauaaaauuccuuuuuuuuuuuuuuuuuuugagacggagucucgcucugucacccaggcugcagugcaguggcacgaucucagcucacugaaagcuccgccuuccagguucaugccauucuccugccucagccugccgaguagcugggacuauaggcgcccgccaccacgcccggcuaauuuuuuuguauuuuuaguagagacgggguuucaccguguuagccaggauggucucgaucuccugaccucaugauccucccgccucggccucucaaagugcugggauuacaggcgugagccaccacacccggccauaaaauucuauuucugcguauuuacugcaggcauauacuguggagugcagggagggguugaaggugagaucuauguauaugaacuaaauaaaggauaaaauaaagcagaacaacuccuuucuaagcuuucagaaauuaugaacuuguugcguuagguguaaagaguucaacggggaaguguuuuaaaauuugggauucuuggccgaggugggcgaaucacuaggucaggagaucgagaccauccuggcuaacauggugaaaccacuucucuacuaaaaauacaaaaaaaugagccgggcguggugaugggcgccuguagucccagcuacucgggaggcugagucaggagaauggcgugaacccgggagguggagcuuacacugcacugcacugcagccugggugacagagugagacuccgucucaaaaaaaaaaaaaaaaaauuugggauucuggccgggcacaguggcucaugccuguaaucccaucacuuugggaggccgaggcgggcagaucaccugaggucgggaguuugagaccaggcugagcaacguggagaaaccccaucucuacuaaaaauacaaaauuagcugagggugguggcacaugccuguaaucccagcuacugaggaggcuuaggcaggagaaucgcuuaaaccuggaagguagagguugcuguuagccaagaccaugccauugcacuccagccugggcaagaagaacgaaacuccgucucaaaaaaaaaaaaaaaauugagauucuacacauucuguuuucuaugacuccaauuuaucuuucugucuuggauuaucuuguuuuuaggcucaacuggagaagcuacaggcagagauuucacaagcagcucgaaaaacaggcauccauacuucgacuaggcuugcccucauugcuccuaagaaggagcuaaaggaaggagauauuccugaaauugaguggugggacucuuacauaauccccaauggcuuugaucugugaguuuguuuuaguaccuuuuuaaaaaaacaguuuuuaaucagcugaguuuaagacucaaguuaauaccuuuuaguaaagcuaugguuuuagugggaaggaugguacucauucauuaauuaaaauuuuuaaauccaagagagauaaguaacuguacacaagguccuguauuuuuuuuuuuuuuuuuuuuugagagggagucucgcucugucacccaggcuggagugcaguggcacgagcucagcucacugcaaccuccaccucccggguucaagagauucuccuugaauucuccuugaaucucagccccucaaguagcugggacuacaggugugugccaccaugcccaucugcuuuuuguauuuuugauagagacaggguuuugccauguuggccaggcuggucucgaacuccugaccucaggugauccgcccaccuuagccucccaaagugcugggauuacaggcgugagccacugcaccuggccaagcuccugcauuuguaagugauguaucauauauauaggcuguuuuuagcuuuugggguuaauguaggauaaccagggacacaaucuacaaaagcaaagucuagaauucuuuuugcucuguuacacauuguugccuguuuuuagcauuauuuuccuuaauuacauucuuuugcuacguauuauagguguuuacauuuccuaaagaucucauugugauagagcaaggauuauuaguugguaggugagauaauaguaaauauagcauauaaggcugggcucgguggcugacaccuguuauuccagcacuuugggaggcugagggcugaaggauugcuugagcccaggaguuaaagaccagcuugggcaauauggugagaccucguuucuacaaagauuaaaaaaaaaaaaaaaguagcugggcaugguggcuugugccuguaguccuggcuacccaggaggcugaugugagagaaucacuugagcccaggagggucugugcugcagucagcuaugaucaugaccacugcacucuauccuggacaacagggugaaacucugucucaaaaaaaaaaaggauauaagacacauuugaagagcuuuaaauauaucugcuccauccauuuuuuuuuuuuuuuuccugagacggaguuucgcucuuguugcccaggcuggagugcaguggagcaaucuugguucaccacagccuccgccuccuggguucaagugauucuccugccucagccucccaaguagcugagauuauaggcaugcaccaccacgccuggcuaauuuuugguguuuuuaguagagacgagguuucuccauguuggucaggcuggucccaaauucccgaccucaggugauccacccgccucagccucccaaagggcugggauuacaggcaugagccaccacgccuggcguuuuuuuuuuuuuuuuuuuuuuuuaagacagagucucacucuguugcacaaucucggcucgcugcaaccucugucuccuggguugaagcaguucuucuagcucagccucauaaguauccgggacuacaggcaaauaccaccacaccuggccaguuuuuauauuuuuaguagacaagaguuucacuauuuggccaaacuggucucaaacuccugaccucaggugauccaccugccuucaucucccaaagugcugggauuauaggcauaagccacaucaccuggcccugcuccaucauucugauacauggcuuuaguagauuuugucuuagccuuucguugccccuucuuugucagccacuguuccagggacuuauugucacuaaugagagaacauagcgucugucagcuguggcaugguagaaaaaagguugagaaugauugcuguggagaguguguucaaccauagagggacucaguuuucucaucaugaaaauuauguguaauuuaacuauauauuuuagguaccuaaaugcuauuuuagguauaucaagcacaagaacccauuauagagaguggguuuuuucauuguauuucugagacuccucucuuagaaucaucucuacccgcauaucguguuuucuuuucuuccuacaauuuuaguacagaggaaaaucccaagagagaagauuauuuuggaaucacaaaucuuguugaacauccagcccagcucaauccuccagguaauguauagauuccugaaucaagucucuagagcagcauuacccauuggaaauuuauacagugaggaacauguucuguaucuaugcuguucaauacaauagccacuacccauguguaauucuuuuuuuuaauucaguuuuuuuccugacaauaguuuguuguuugaccagugaacauacauuuuaagugcauauuccugugcuuagaauuucaugagacagccaagcaugguggcucaugccucuaauccaaacacuuucggaggccaaggcaggaggauugcuugaggccaagaauucaagaccagucugggcaacacagugagacccaucucaaggaaaaaaaauuuggcuggguaugguggcuuaugccuguaaucacugcacuuugggaggcugaggugggcagauugcuugagcucaggaguucgagaucuaggcaacauggcaaaaccccaucucuacaaaaaauaaaaaaucagccgggcaugguggugugcaucuguagucccagccucuugggaggcugagguguggaggauggcuugagccugggagguggaaguugcagugagcugagauggugcugcugcacuccagccuggaugauacugccagaccuugucucaaaaaaaaaaaaaaaaaaaaaagaagaaagaaagaaagaaaaaaacccaaaauuucaugaagcuuuacauuuacaguucccugguuguuccuaggaaagagcccucagcuugcuccuuuuauagaaccacauguuguuguggcauccacagcuaaaugcaaaugcaagagccaaacucuuggguugguguguuauuagaugcgauaugcuccacuacccacugugagggaugcuaauuccaaagggcuuuuuguuaguuucccaaaguugaaacugggaaacaaaguugcuucuauuuuuuuuuuuuuuuuuuuuuugaggaggaguuucgcucuugugguccaggcugcagugcaacggcaugaucucagcucaccacaaccucugccuccuggguucaagcaauucuccugccucagccuccugaguagcugggauuacaggcaugugccaccacgcccagcuaauuuuguauuuuuaguagagacaggguuucaccauguuuggucaggcuggucuugaacuccugaccucaggugaucugccagccuuggccucccaaagugcugggauuauaggugugagccaccgcgcccggccuuuuuuuuuuuuuugaguuggaguuucgcuuuugucacccaggcuggagugcaauggcacuaucuccguucacugcaacuuucaccccccuggguugaagcuauucuccggccuuagccuccggaguagcuuggauuauaggugccugccaccacaccuggcuaguuuuugaacuuuuaguagagacaggguuuugccauguuggucaugcuugucuugaacuccugaccucaagugaucugcccaccuaggcuucccaaagugcuggguuuaccggcgugagccaccgcaccuggcccuaauuuuguuuucuacauuugccagguaucauugaaugaggggguuuaacagcuuaaaggaaaacaacuaagaacacuacuuaagaaagauaagaggccaggcgagguggcucaugccuguaaucccagcacuuugggaggccgaggcgggcagaucacgaggucaagaaaucaacaccauccuggcuaacaaggugaaaccccgucucuacuaaaaauacaaaaauuagccagacgugguggcgggugccuguagucccagcuacucaggaggcugaggcaggagaauggugugaacccaggaggcagagcuugcagugagcugagauugcgccacugcacuccagccugggcagcagagcgagacuccgucucaacaaaaggaaagauaagaauguuuuuuaaaaacauagccauauugccgggcaccaggccugaacugauuuuaaucuuacugaucccuuauuaacgaguuuucuucauuuucuauuuaaaguuuauacacacacacacacacacacauguuuuuugaaauggagucucgcuguguugccaggcuagagugcaguggcaaguggcacaaucucggcucacugcaaccuccaccucccggauucaagugauucuccugccucagccucccgaguagcugggacuacaggugcgugccaccacgcccagcuaauuuuuguauuuuuaguggagucaggguuucaccauguuggccaggcuggucucgaucucuugaccucgugaucugcccacccgugccucccaaagugcugggauuacaggugugauccaccgcaccuggccucaauauauuuuuuacauaaaauguuuauaauagaguugggucucacuugguuguccaggcuggucucgaacucuugggcucacgccauccucccaccuuggccuaucaaagugcuagaauuacaggcauaagccacuguguccagccuaaaguuucuuuuaaugauauugauauuuaccuagguuucuuuaauauuuuuauugcuguccgggccugguggcucaugccuggccaacauggugaaaccccaucucuacuaaaaauacaaacauuagccaggcaugguggcgugugccuguaauccuagcuacucgggaggcugaggcaggagaauuacuugaacccaggaggcagaggcuacagugagcugagaucgugccauugcacuccaaccugggugacagagugagagagagaaaaaaaaaaaauauauauauauauauauguauucuuacugcuuugguauacuaauaucucugccugacaguugacaaugacacaccaguuacucugggaguauaucuuaccaagaaggaacagaaaaaacuucggagacaaacaaggagggaagcacagaaggaacuacaagaaaaagucaggcugggccugaugccuccuccagaacccaaaggugcauuucucaguggccucuucuguuaaaaagaguggcaaguuuaugucuuuaauccuggaggaacuuuaacaucucuguguuugagugauuucuguuucuaagaauuauucuugggguccuuuuucuccaaguuuucuaccaucuuuucauauuaagauaggucaacacauucauuauagaggccauuuauggcuuauuuuuaagcauacugaucauacaacacucugguuuuccuggaagaauacaggucuugaaauucauggagauaguaguugcaguauuugcguagacuuuuuauguacauaauucuuaauguuuuaauuuuuacaaugaaaguacaggauaaaaaacuugacccuguaguuacauucucguucagcaguauuuugacugagcacuauuauuuauaagcucuuucacuagaugcugugaucagugugaaaaauaugaaaggaauuaaguuccacguccuucauaaauuuucagauaauguaaaugcauaccaaucuucaacuuaauugugugaacuucugcaaaugcugaagugauuggaugggauuuucaagauaggaguuauuggaggaagugaguuuagagcagagauuugaaauagguaaauaauaugaauugguauggaagaaauaacaaguuacuccagcuggagaagugacuucaaagacugauuguuguccucucuucacugcagugagaauuucuaauuugaugcgaguauuaggaacagaagcuguucaagaccccacgaagguagaagcccacgucagagcucagauggcaaaaagacagaaguaagugccaugggauuggguggaaaccucgggcaaguaccuuucccaaacucuucugggggguccauauuuggagggaggggagaguucuccguugcucucucuuucccucagcccugccucugaucuucaaugccuuucucacuuguggauguccuuccugucacgacagagcgcaugaagaggccaacgcugcccgaaaacucacagcagaacagagaaaggucaagaaaauuaaaaagcuuaaagaagacauuucacaggggguacacauaucuguauauagguagguguccauacugggccaaacuuccccuuagaauuacuaaaacauuuuccaagugcuugaggcagaaucauuguggccuaaaagcauaccuaacaccaguuccuacucucuuuuaaugacccuaguguggaucaagagcuaguaaaucuuguaaaauagcgagaguuaaugacuuauguuuaugguuacccaguucuucccucucaagucuucuuuuuuuuuuuaccagaauauuaguucugaacaagucaauauacuuguucaggccaagaugugaacuaaagauuguauguccuuugagaacuauaaaauaucauccuauuucuuuuuuuuuucaucuuuuuuuuuuuaaauggucugaguuugcuuccaacauccauggaagcauuacaaauuuucuuuccuccguagucauauccuuacccugauguauugcuguguuucauccucacuccaaaaugcauuuuauauguuguaaauauuuuucuaccuuuguguugauuuaauguuuuuauucuuuuauguugaguacauguguaucuucuauuuuuaaaaugugcuuauuucuauuaacuaguucuuuauuauaaaagugguacauuaucacaaaaauagugaaugcuuauuaagauuuaaaaaauugucugacaacacagaagaauacuuacucaaaaugucuccuuucuauucucugaucccuuagaaccacucucuuuagguaauugcuauuaacaguuuuucacauauccuccuagaaaauuuucaugccuauauagugauccuauauauauauuuuauuuauuuauuuauuuauuuugagacggaguuucagucuuguugcccaggcaggagugcaauggcgcgaucucagcgcacugcaaccucugccucccaaguucaagcaauucuccugccucagccuccugaguagcuaggauuacaggcacgcacccccacgcccggcuaauuuuuguauuuuuaguagagaugggguuucaccauguuggccaggcuggucuuaaacuccugaccucgugaucugcccacuuuggccucccaaagugcugggauuacaggcaugagccaccgcacccagccaaguaauccuauauuauaagagucuaagggucuagaggacaaaaagucuguaggucuuuacauugucaagaacaaugagauuguaaguauuuuuggaugauaguaaauaccucucccugacucuuagaguaaacuuugguuaguaauguaaugguuaauguaaagugcuagacuuugaagaaauguaagaguguggaaauauuucuagacucaucaacucuaccuuuuaagcauucaucuauuuguuuacuccagaggccuuuguuuauagagaggaaaccauuuuggauucaucuuuuuacuugccacuccauucaggcagcugcugaugcuaaaauggaagacauaacuaaacuuucccuucuccagaguucgaaauuugagcaacccagccaagaaguucaagauugaagccaaugcugggcaacuguaccugacagggguggugguacugcacaaggaugucaacgugguaguaguggaagggggugagucugaaaaacuugagggagacuguccccagacaacccuaggcuuagagugauuagcauuguggggagaaaggagaaaaagaucguauuuuagugccauaccugauauaauaugcuaggucucugcuucuguguuuuuuggaguagaaggcccuaagaugugguuccugagauugcuucaacuaccacauuaaugucugagcucagagguucuuucuaccccaucaucuuccacaguucuggcaaaauuauucuucucuguuuccaggccccaaggcccagaagaaauuuaagcgucuuaugcugcaucggauaaagugggaugaacagacaucuaacacaaagggagauggugaauggggguuagaggggauuaagggggagagcuaugggagguggggauggugcaucuguccguucaucuuauuuccucccugugacacucuugauaacacuagauaguguucaggaauuuuagaaagacccguuuagacuuugagccuccuagacauucauacaauauuuacuacaugauuauaugcaugaaugguaaagcuauuuuuuugccuaucauuuaaggcuuuucuaccagcugguuucugugucuguccuggaucugaguaccgguuacaugaauuuauucaguauuugaaaauucagcaagcagcuaggcaugguggcucaugccuguaauccuagcacuuugggaggcugaggcgggcagauugccugaggccaggaguucgagaccagccugggcaaacaacguggugaaaccccauaucuacaaaaaguacaaaaauuagcuggaugugguggcacacaccuguauucccagcuacucaggaagcugaggugggaggaucacuugagcuuggggaggucgaggcugcaguaagcugugaucgugccacugcaauccagccugggugacagaaugagacccugucucaaaaaaaagaaaaagcaaaucuaguaagcuauacauucauguguacagugucuauauuauauuauuauuugauuuuuuuuuuuuuaaggauugaagccaaaaagaucuucaggucaaaaaagcucugcuuugaucaaacuauuucuuuugucugauauauauauauacacacauacacauacauacacacacacacacauacauacacacauguacacacacauacacauacacacaauacacacacauacauguacauguacauacucacacauaugcucuucaacuuaaugaugggguuaguuccaauaaaccugagauaaauugaaaauauuguuaagucaaaaaugcauuuaaggccaggcacgguggcucacacuuauaaucugagcacuuugggaggccgaggcgagcagaucauuugaggucaggaguucguaacagccuggccaacauggugaaaccccgucucuacugaaaacacaaaaauucggggcguggugguggaccucuguaaucccagcuacucgggaggcugaggcaggagaaucgcuugaaccuggcaggcggagguugcaguaagcugugaucgcaccacugcacugcagccuaagcgacagagcaagacuccaucucaaaaaaaaaaaaaugcauuuaauacaucugaccuacaggacaucauaacagccuagccuuccuuauacuuucucagaauacuuagauuagccuacaguugggcaaaaucaucuaacacaaagccuauuuuuaucucauguaagaguauuuuacugcauauugcuagcccaggaaaaucucaaaauuuaaaauuugaaguacauuuucuacuaaauauuuaucacuuucacacuauacucaaggcaaaaaauuguaagucaaggacugucugucuauauuugaaggccagacauucuucuggccaucauacucccauuaguguucauucuucucaucuuugaacaccuggauuagcauuuaaaaucugcagagaggccuggugugauggcuuaugccuguaaucccagcacuuugggaggccgaggcggguggaucaccugaggucaggaguuugagaccagccugacauggugaaaccccgucucuacuaaaaaauacaaaaaugagcugggcguggcagcgugcgccuguaaucccagcuacucgggaggccuaggcaggagaaucacuugaacccaggaagcgguugcagugagcugagaucauaccacuucacuccagccugagugacagagcaagacuccgucucaaaaaaauaaaaauauaaauaaaaucugcagagaguucaucuuaagauaccugagaauaaaaaauauuuuguucuacacgugcauuuuuuuuuuuuuuuuuuugagauggagucuuugcucuuuugcccaggcuggagugcaguggcaccaucuuggcucacugcagccuccgccucccagguucaagugauucuccugccucggccuccugauaagcucggauuacaggcaccugccaccacaccuggcuaauuuuuguauuuuuaguagagaugagguuucgccauguuggcuaggcuggucucaaacucuugaccucaggugauccacucaccucagccucccaaagcgcuaggauuacaggcgugagccaccacgcuggccgauaauuuugauuugguauaucugcccuccuccuccauugggugaaaguuuuuugagaguaauauaugauguugacauaugaagccugccucccaaagugccuaggacaaguuuuuauucuugacugcuugucuuuuauuuccuuauucccaguaccugguggagcucuugauucauaacaagugcuauguaaaugcuaauuguaucaauuaauauuacugccuacuuggagcuucaagucuaauuuggggaaaauaaagagcaacagaaaagagaacacuugguccaacacauaaaaagggugauaauauuuuagagaguuuggguagacuugaauauuauuuguuuagaaccugaaucucaagucuaagucuguaacaagauuucucuuccagaugaugaggagucugaugaggaagcugugaagaaaaccaacaaauguguacuagucugggagguaggugauccuuuguaaaacauuguaaaacuuuagccaacuccugaauauuuauacuauuugaguggagcaauggaauguaagauguaaucagugaauaauguuuuaaauaauuuauguuucuuuuuggaauccauuuuuaaaugguuggcaguaaauucuuccugaucaucuguuuaauuaaauucgugaguauuuaguauaugcuaucuggggaagugcguggacagugcugcugguagcaggaauacaaauucucuaccgaaaauuauuuauuucacagucaugaauaugagacuuggaaacgggaaugaauuguuguuggauuuaccuuuggauauagugaaggaaguacuagacuuaagaauauaaaguuaggaggcugggcagugcugcuuauuagcugugcaaucugggcaagacacuuaaugucaaauucuguugccuuagcuauuguucucuauauugucaaguuuuugagaaugaaauuagauaauuaugugauagugcuucauaaaaugugacugaaucacucuucaaguggaauauuuuuuaugguuaucuaguucuuuaaccccugaagccuucuuagagaaccaguauuaaaaccaguauuaauguuuucauguuugcuuuuagguauaguacauguauaucuuuuuuugggggcgggggggcggggggcgguauggaguuucgcucuuguugcucuuguugcccaggcuggagugcgauggcgugaucucggcucaccgcaaccucuaccucccagguucaaacgauucuccugccucagccucccaaguagcugggauuacaggugcacgccaccaugcccgacuaauuuuuguauuuauaguagagacaggguuucuccauguuggucaggcuggucuugaacucccaaccucaggugauccgccugccucggccucccaaagugcugggauuacaggcaugagccacugugcccagccccuccauuucuuuuuuuuuuuuuuugagagaguuuugcccuuguuacccaggcuggagugcaauggugcaaucucagcucaccgcaaccaccgccuccuggguucaagugauucuccugccucggccucccgaguagcuggaauuacaggcaugagccaccacgccuggcuaauuuuguauuuuuaguagagacgggguuucgccauauuggucaagcuggucucgaacuccugaccugagguccgacugccuuggccucccaaagugcugggauuacaggcaugagucacugcgcccggccauauaucuucuauuuuuaaaaugugcuuauuucuaguauaugugcugcugaagcgagcaguaaaaugugcuuauuucuauuaaugaauucuuuauuauaaaagugguacauuauuacaaaaguaguaaauguuuauuaagauuagaaacaaauucuaauuauacagaagaguacuuacugagacccagcacaguggcucacgccuauaaucccagcacuuugggaggaugaggugguuggaucacuugagcucaggaguucaagaccagccugggcaauauggcgaaaccccgucucuacaaaaaauacaaaaauuagccuggccugguggcgucugccuguagucccagcuacuugagaggcugaggugggaagauugcuucagcuuuggaguuugaagcugcagugagcugugacuaugccacugcacuccagccugggcaccagagugaaacccugucuuaaaaaaaaaaaagaaaaagucucaggccaggugcaguggcucaugccuauacucccaacacuuugggaggcugaggugggcggauuacgaggucaggaauucgagacuaaccuggccaacauggugaaacccagucucuacuaaaaauacaaaaauuaguggggcgugguggccagugccuauaaucccagcuacuugggaggcugaggcaggagaaucgcuugaaucugggaagcggagguugcagugagccgagaucgcaccauugcacuccagccugggugacagugcgagacugugucucaaaacaaaagucucuuccuauucgcugaucucuucagaccagucuuuauagguaauugcuauuaauaguuuuucuucugaaggagcaaucaaaaaauaaaaauuaaaaaaaaagguuuucauguauccugccuuaucccagauucuucaauuuaugcauacaaauuagaugauaauaaccauaguauuuguucucuguuuuauaaguucccaccugcauauuuguuaucuuuuuuuaaucaacuuuuuuuuuuagagauagggucuugcucuauugcucaggcuggugugcaguggcgcagucauagcucgcuacagccuugaacuccuagggacaagcaauccuccagucucagcuucucaaguaucugagaccucagguccacaccacugugccuggcuaauuuuuuuuuuuuuuuuuuuuuuuuuuagaaauggaucucacuauguugccuaggcuugucuugaacucuuagccuugagugauccucccaccucagccucccaaagugcugggauuauaggcaugagcuacugugcccagcccuaccuucacauaucucagcacccucaucuuucaauuuucuucuauuuaucucugaagaguacuuacugaaaaagucccggcuucuuagagaaccaguauuaauguuguaggaauuuaguuuucaggaauugucucucauguucagaaauaagccaaguucugcuccagccuccuuauuggagucuacucccugaacgccucuugagguauugcuuuaugacugccauugcugcugguaacuuuggcaagaaugccauucugcccaguacugucuuuuucuguuguaauucucugcugguaccugcucuucuucuguuccccgcccccaguuguucuuuguugcugggccccaaagccuccugcuuauauaaauaguuucuggggccuuuuugaaggcucagauuuaguccuuaaggccugguaggagauaaguuuaucucauuccaccuuccauaguucuuccugacuugcuguuccacccaggcaccagagcaaauaauuccucacuucauuucaaaaaacuaaaagccuuaugcauaugaauucguaaaaucucauacaaauauccaaggaggccgggcgcgguggcucacgccuauaaucccagcacuuugggaggcugaggcgggaggaucacgaggucaggagaucgagaccauccuggcuaacacggugaaaccccgucucuacuagaaauacaaaaaaucagcugggcgugguagcgggcgccuguagucccagcuacuccagaggcugaggcaggagaauggugugaacccgggaggcggagcuugcagugagccgagaucgugccacugcacuccagccugggcgacagagcgagacucugucucagaaaaacacaaauauccaaggaaauggaggucacaauuuuuuuuuaaccauaaaaucacguucagcugggcacaugucucacaaauguuacuaggucuucuuauaaaagaauauuaucugauuuaaauaagaaauugaaguguuuuuauuauauaucucuuuucuaggguacagccaaagaccggagcuuuggagagaugaaguuuaaacaguguccuacagagaacauggcucgugagcauuucaaaaagcauggggcugaacacuacugggaccuugcgcugagugaaucuguguuagaguccacugauugagacuacugcaagcccuugccucuccucccuugccuuugucucuucaguccucucacuuauucuauuucccaacccccucccacuuguuugugugaucucagaacugugccaagcagacacugggacaaagggagaauaucuugcuccccuccugagucagccugguguugcccuuuauuccccuuaugugcauaugauuaaagaguuauuuuuaaacuuggugugauauuuuucacacauucguaagua

SEQ ID NO: 5829 - RNA, 34254 nt, Homo sapiens
gaacucggguugcgcacuucccggcgcugggaacgcggagcggacgcagucuggccgccauugcgcugcggggaaagcggccucuugugugagggccuguggggugcguggcaggcguuuaaggccgggcugcgggaggcguggucgggucgggccgagugaccgaagggguuaggccgggcggggcuggaugcacuguguggcgggacugcaggccgggguccccggacgccuuucugcugcgcuucuugugggcccgggccugugguuagugaauuuuucuaucccgccgcuccccagauucuccggauauggccggaguguuuccuuaucgagggccggguaacccggugccuggcccucuagccccgcuaccggacuacaugucggaggagaagcugcaggagaaaggugaggcgagaguguggagcggcgcgcgggccggaggcggggcgggugugcgcgcgcgcaggcggguggggacccuccccguuugggcagcuccugaggugucagcucccuuguuauuuccaguuaauuuuucaucaagucauuuuaagcgcguauuauuugcaagcgcugauccagcggggguacaguagugacggagacaaaauuccuguccuuacgggguuuaaauuacagcgggagagacagagaauaacaaaaccuugaagcucuguaauaaaaaugucaggccgggcgcgguggcucacgguuguaaucccagcacuuugggaggcccaggcgggcggaucaccugaggucaggaguucgagaccagccuggccaacacagugaaaccucgucucuacgaaaaauacaaaaaugagucgugugugguggcgcgugucuauaaucccagcuacuggggaggcugaggcaggagaauggcuugaacccaggaggcggagguugcagugagccgacaucgcaccauugcacuccagccugggagacagagugaaacaaccucucaaaaaaaaaaaaaaaagucagauagugaucaaugugaugaaaggaaaaacagaguaaaaugguaagggaauuggcaaggggugcuucuuccugcuggugccugcuucucccucacacucacugacaggagcuuacccuagggcaagaggugaagaggauuagggggagggugugcaggccuuuaaacugaggugccuuuccagcucgaaaauggcagcaauugcaggccaagcgcuaugcagaaaagcggaaguuuggguuuguggaugcccagaaggaagacaugcccccagaacaugucaggaagaucauucgagaccauggagacaugaccaacaggaaguuccgccaugacaaaaggguuuacuugggguaaggaacauccugaaauaauuucauuuggaauuuggcccuuuucccuucucccugucccacagucuuggauugaugcuuugacagcucaucuugguggauauaagagaaaggagaaaaccaguaggagucucugauaauuucuacaucuuccacuuuugcagucuguuuccccucucuucccgaucugggacuggugcuuuaauuuguccuguugaugauauuauaagaugucccuggccaggcgcgguggcucaugccuguaaucccagcacuuugggaggccgaggcggguggaucaugaggucaggagaucgagaccauccuggcuaacacggugaaaccccgucucuacuaaaaauacacaaaauuagcugggcgugguggcaggugucuguagucccagcuacuugggaggcugaggcaggagaauggcgugaaccugggaggcggaacuuguagugagccgagaucacaccacugcacucuggccugggcgaaaguacgagacuccgucucaaaaaaaaaaaaaaaaugaaaaauaagaugucccuaugguugagcugguugaaguccagagugggauacugugcauaguggcagccugucgcuccucagggaccugaauucuguguuugggguauuuaauuucagagguuucccuacuccuguuuuuucuguggcucuaaacugggcuaguacagguacagaugucuuagcagauuccuguucuauuuggacacaaaaauguuugccauguaaugaacuggaaguuuuguuuauuucaaaaaauacuuagagaacugugcuggcugcuggggauauaguagcgagcagaggguaacaaucuccgccuuucugcagugugcggucuaguggccugacagacaugagacaacuggugauagugaaguauggugaauacuuuauuaugauuuaugggaagaugcggagggaauaggaugugagagagccgcaaagcugucuccagagggauagccguugauuuagaggagcugauaccagcauugugggauuaugacguuuaagaagaguggugcaaggugaaguuggagagggagaggcaggguuucugguuaggaagggccugugggcuaaguuugggaguuuggauuguaagguaggacuguggaacaugaacauguggcuucucugcaugggacagguagcagaacaccucgucauuucugauagccuucucuuuuucuaaugugccagugcccuaaaguacaugccccacgcaguccucaaacuccuggagaacaugccuaugccuugggagcagauucgggaugugccugugcuguaccacaucacuggagccauuuccuucgucaaugagauucccugggucauugaaccugucuacaucucccagugggggugagaaaggcugaaauaugguggguggugguggugguggugguugggaggcaguggguagaaaugguugugugaugucuugccuuccaggucaauguggauuaugaugcgccgagaaaaaagagauaggaggcauuucaagaggaugcguuuucccccuuuugaugaugaggagccgcccuuggacuaugcugacaacauccuagauguugagccacuggaggccauucagcuagagcuggacccugaggaggacgccccuguguuggacugguucuaugaccaccagccguugagggacagcaggaagugagugauagauggagauacuacaccugggaggaguucuggaaaugcagaaggaguccugggagaucaguaggugguauggguuugucuagcugcuuacuugaggugggccuuucauuuuuuaccuagguauguaaauggcuccacuuaccagcgcuggcaguucacacuaccuaugaugucgacucucuaccgccuggcuaaucagcuccugacagacuugguggaugacaacuacuucuaccuguuugauuugaaggccuucuuuacguccaaggcacucaauauggccauuccuggaggccccaaauuugaaccucuuguucgagacaucaaccuacagugaguuggagagauuagggauuuuagacauuuugaguugaaugaaacguaaucuugauccuuaaaguccugauauaacuuccaaauuagucuguuuacaccaggugcaguggcucacgcuguaaucucagcacuuugggaagcugaggcaggaggauugcuugagcccagaaguuugagaccaaucugggcaaaauggcaaaacccuaucuuuaccaaaaaauguagcugggcguggugacacucacagcuucguguagucucaguuacuugggaagcugagcugugggaggauuguuugagcccaggaggucacggcugcagugaacgaugaucaugccauugcauuccagcuugggugauaagagugagacccugucucaaaaaaaaaaaagucugcuuauucuugauguuguacccuagggaugaagacuggaaugaauucaaugauauuaacaagauuaucauccggcagccuauccgcacugaguacaagauugcuuuuccuuacuuguacaacaaucuuccacaccauguccaccucaccugguaagagaccuggaacacaacauuuggaaaggagaaggcugcuguuuagguugggccagggcgggaaaacuuuggcugacucuuccuuucauuuuagguaccauacucccaauguuguauucaucaaaacugaggauccugacuugccagcuuucuacuuugacccuuugaucaacccaaucucccauaggcacucagucaaggugaggaagggaagggaugcuuucccucagcucuucuaggagaaaugcgugagguuggcugauguuacuaaacgcucagguggagggagauguguuuuccgucuugcuaaguguuccccuugagcuauaagcgaauaugagaauucagcauuugcuuuaaaacaugucauugguauaauccuguuuucugugauuauccuuuuggacuuuacgguucuuuucuugggugcucuagauaaucugucccggucugucucuauuguguuuguuuguuuuagccuuuauauugagauguaguuaacauaccauacaaguuauccauuuaaaguguguaauuugaugguuuuuagcuuauucucagaguugucccaacugucacgacaugcaauuugagaauauuuuuauuacuugagaaagaaacccuuagcaguuacucgccauuucuccccaacuuccuuacgcaaccacuaaucuacuuucugucuauagauuuggcuauucuacacauuucauaugauagaaugaaauagaaucguacacuauguagucuucagugacuggcuucuuaagcuuaccauaauguuuuugaugcucaucuguguuccguuguguccaagcccaguguuuggagcuugggugggagaugauugcaauguugaccuccugugauguuggggcuccauugggaggcuuucugguggucagccaguugaggugugagaagugacgcuugcuuuccugguggcccugucuuguucuuugcugucuugguuuccuuugugcuggcacuucagggcugcuuuugucagacagcccaguuuccauagcagauacaggcuuugugcuuggccccagagaauuucccucaucuuaagucugugccuaguucagcaggagcuaaacccuuagagggauuccuuuuucagagccaggaaccauugccggaugaugaugaggaauuugagcucccggaguuuguggagcccuuccugaaggacacaccccucuauacagacaauacagccaauggcauugcccugcucugggccccgcggcccuucaaccuacgcucuggucgcacccgucgggcccuggacauaccccuugucaagaacugguaagguuuuucccuguggcagggggaaugauaguggauguguaggagaaaagacuccaacuaggugggcauguagccuuuuuuuuaaauucuuuuuuuuuuuuucccauaaaaaugguagacaacccaaggcuugcagccuuuagcagagugucuggaagaagagauggccaaacucuggugggcuuauuuuuccagguaucgggagcauuguccugccgggcagccugugaaagugagggucuccuaccagaagcugcuuaaguacuaugugcugaaugcccugaagcaucggcccccuaaggcucaaaagaagagguaaggugccccaggggcccugcgcagacuucuguuccagagauaucaguaggcugacucuuacucuccauguucccaccucagguauuuguuccgcuccuucaaagccaccaaauucuuucaguccacaaagcuggacuggguggagguugggcuccagguuugccgccagggcuacaacaugcucaaccuucucauucaccgcaaaaaccucaacuaccugcaccuggacuacaacuucaaccucaagccugugaaaacgcucaccaccaaggugccugcauuggacccuaggggccuccugggcuucaaggacggacaguuguuuuccucugguuacugaugaaggcauacaucaguuggguccauugcucauucacguucugucuguuuuuugcaucuucuccaggaaagaaagaaaucucguuuugggaaugcuuuccaccugugucgggaaguucugcguuugacuaagcuggugguggauagucacgugcaguaucggcugggcaauguggaugccuuccagguaagguuagguauucccaaccccugccugggugaggacgcuggaggaagccugugcugaccguggagcugguuuaagcuccaggucugauggggcaauuguauugcagcuggcagauggauugcaguauauauuugcccauguugggcaguugacgggcauguaucgauacaaauacaagcugaugcgacagauucgcaugugcaaggaccugaagcaucucaucuauuaucguuucaacacggugagaccuugacuuuacugacuuucuuuuuuuugagacagagucuuacucuugucucuugggcuggugugcaauggcacgaucuuggcucacugcaaccuccgccuccugaguucaagcaauucuccugccucagccucccgaguagcugggauuacaggugcccgccaccacgccuggcaauuuuuuuuuuguuuuguuuugaaacugagucuuucucuguugccccagcuggaguacaauggcacgaucuuggcucaccacagccuccgccucccggguugaagugauucuccugcuucagccucccaaguagcugggacuacaggcgcgcaccaccaugccuggcuaguuuuugaaauuuuaguagagaugggguuucacuguauuggccaggcuggucuugaacuccugaccucaggugauccacacuccucggccucccaaaguacugggauuaccagcgugagucaccgugcccagccucacuggacuuaacuuucucagaucuuuuuucauguauacauuuagacagggcucuuuccagggaccuauuuggagagcagcuaugacuguguccuuacugcuccuuuaaauucacaugggcgaucuuaguuccugguuuuugccuuaagguuucucauuuacccuuuuguuuuagauguugaggucccagaguuuuuuuuucuuuuuaccccucuacugccauaccuacauuccucuguauguauauuauacauauaugccccaccucugcccagguuucuauuguuguuuaaaugcauugcuaacuuguauucuuaacuucugcuugggaucguagggcccuguagggaaggguccuggcuguggcuucugggcugccgguuggcgagucuggcucuuuuucaugcguggcauuaccccuuuauuagagcgauggcuuggcaaccuccuggcccggcaguuugaaggugagugguuuucucuguguccaacuucuccuguuauugcuucaaaaguaccugccccuguuugagucuguucccugcucuuguaugagcacucuuccuacuggauugccuuuagguccaguucugaaaugagucugaccuaguauucuauuucuugggcuuccuucuggggccuugagaggcagucaugcauuugcaggaguggaaauuccucagaagcauaguugugaauguuuaagguagcucgucuuuuugcauaugcugggcacagggacgcuuuguuaauaccuaauuuuauuaauaaccauaaugagugaggagcaugaagguagagacccuuauugaaagcaaggaaucuuccuuguaauccccuugggacacucuacuuccaggucgacacucaaaggggguggcaaagacaguaacaaagcagcgaguggagucacauuuugaccuugagcugcgggcagcugugaugcaugauauucuggacaugaugccugaggggaucaagcagaacaaggcccggacaauccugcagcaccucagugaagccuggcgcugcuggaaagccaacauucccuggaaggugggugucucuuuauuuccuuggaggcguaaacauccgucuuuaggguaggauuaccacuucgggaaucauuagggggcuaucuggcuccaaucucuuuucuuuucccuuuuagacagggaaaagaagcaccauguugcuuaggcuggccucaagcuccugagcucaagcgauccuccuuagccuccugaguagccgggacuacagaugugugccacagugccuggcuggauccuggcuugauugugcuuuuuggacuuuuaggucccugggcugccgacgcccauagagaauaugauccuucgauacgugaaggccaaggcugacugguggaccaacacugcccacuacaaccgagaacggauccgccgaggggccacuguggacaagacuguuuguaaaaagaaucugggccgccucacccggcucuaucugaaggcagaacaggagcggcagcacaacuaccugaagguugggcagaguaggcugggcugggugugaguggugggggagugggcaagagggaggacuguagaguugugacugaaccuuguucuggcaggaucgggcuguagcgggaggcuaauuucauguccaccuuacaggacgggccuuacaucacagcggaggaagcaguggcaguauauaccaccacagugcauugguuggaaagccgcagguuuucacccaucccauuccccccacucuccuauaagcaugacaccaaguugcucaucuuggcauuggagcggcucaaggaagcuuauaggugaguaguaggguagauagguuccugcugggaaggugacagcagggaauggcgucauccucagaguccaaagaaagaagguguagccccagucuuuccugguuuuacuuccuccuaguuuucccauucacccuucccauugcuuuugucagugugaagucucgguugaaccagucucagagggaggagcuaggucugaucgagcaggccuacgauaacccccacgaggcgcugucccgcaucaagcgucaccuccucacacagagagccuucaaagaggugagugaggccucccaaguuuucuuuuugguucuaccaaagguagcaguugccuuugguucuaccaaagguagcaguugguggauuggugugaaccagccuccuugucccacaggugggcauugaguucauggaucuguauagccaccucguuccaguauaugauguugagccccuggagaagauaacugaugcuuaccuggaccaguaccugugguaugaagccgacaagcgccgccuguucccacccuggauuaagccugcagacacagaaccaccuccgcugcuuguuuacaaguggugucaagguagaacuuucaugagaucgcccugugaggaacggggcaggaauuuaguucuacgucaaaaaucucaucuggguagcaugauugguuuacucucuugaugcgugguaguaaagggaaguaguguucguguuaaacugaggaaaagcccauagucaaagcaauccaaaugaauacguggaaucauagugggauugguuauggaagguaaugauaguuccuguggggcuagucuugcaagaggauuucuaaccugcuggagaccugccuugcuacuccucaggcaucaauaaccugcaggacgugugggagacgagugaaggcgagugcaaugucaugcuggaaucccgcuuugagaagauguaugagaagaucgacuugacucugcucaacaggcugcugcgccucaucguggaccacaacauagccgacuacaugacagccaagaacaacgucgucaucaacuauaaggugcgucucaggcgcaguagcauggaauuguguguggagugcuugucuggcccacugacucagaauuugcugaggaggaggcugggugcgguggcucaugccuguaaucccagcacuuugggaggcugaggcgggcagaucacgaggucaggaguucgagaccagucuggccaacauggugaaaccccgucucuacuuaaaaaaauacaaaaauuaguugggugugguggugggcgccuguaaucccagcuacuugggaggcugaggcaggagaaucacuugaacccgggaaguggagguugcagugagcugagauugcgccagugcacucucagccugggugacugagcacaacuccgccucgggaguggaaaaaaguagaauuugcugaggggagaacaaaagagguuaacucuggagaauccuggggcauggcucacauucuuaagaauuguaguucuuucuuucuaggacaugaaccauacgaauucauaugggaucaucagaggccugcaguuugccucauucaucgugcaguauuauggccuggugauggauuugcuuguauugggauugcaccgggccagugagauggcugggcccccucagaugccaaaugacuuucucaguuuccaggacauagccacugaggcugcccaccccauccgucucuucugcagauacauugaucgcauccauauuuuuuucaggugagggcuuuccuggauuccuagccuugcaggguacugaggcaugugcuuugccucugaaaucagcuauuguaccugaguugacuuaacugcuguuggggcuuuaaaauggaaugaagcggccgggugcgguagcucacgccuguaaucccagcacuuugggaggccgaggcaggcggaucacgaggucaggagaucgagaccauccuggcuaacacagugaaaccccgucucuacuaaaaauacaaaaaauuagcugggcgugguggcgggugccuguagucccagcuacuccggaggcugaggcuggagaagggcgugaaccugggaggcggagcuugcagugagccgggauugcgccgcugcgcuccagccuggggaaagagcgagacugucucaaaaaauaaauaaauaaaaauaaaauggaaugaagcccggggaggguggggguaggaugggguggggucuccgucuauugagcuggaggacuugugggugucccaaaucucaguguacuggggccucagcaguguaccuggucugguguagguucacagcagaugaggcucgggaccugauucaacguuaccugacagagcacccugaccccaauaaugaaaacaucguuggcuauaauaacaagaagugcuggccccgagaugcccgcaugcgccucaugaaacaugauguuaacuugugagucuagguuggggcugugugagcuggaaggacauaagcuaagggcccagagagggcauaccugaggcugcguccugggugggagaggcguggcugugucaggaugucaucaguuggccuuugaagggaaguuccuuccaagaaacugcugugaccauguguucucugugggcagaggccgggcgguauucugggacaucaagaaccgcuugccacggucagugacuacaguucagugggagaacagcuucgugucuguguacaguaaggacaaccccaaccugcuguucaacauguguggcuucgagugccgcauccugccuaagugccgcaccagcuaugaggaguucacccacaaggacggggucuggaaccugcagaaugagguacagccugggcggggcugggagugacaugaacgcgccugcacuuccugggucagucaccggagucuuguuggguggaaagacuugaguggugggcacaguuggcucuugcuucugugggaguuccucggacauguuaaccuugacuuugugguuuagguuacuaaggagcgcacagcucaguguuuccugcguguggacgaugagucaaugcagcgcuuccacaaccgcgugcgucagauucucauggccucuggguccaccaccuucaccaagguacagggccgucaugcccagcuucccucuuguccucugcuguccucugcucauuucacaccccuuucacuucguccccugcuggcugcuuccuucucuucuuugcuuagugugccaguuuccaugcucugugccauaguggcuuauaguaugucaggucacuucaucguuauuuucugagcguuccuuguagaaauuguguagccuccuucuuguggacuugugaugauucuaaauuaaggcaagaguaaaaguuggauuuauuauuuugaacagaaaagcauuauuuuugcauuuucucaggugcuuaucuaagucauguuaaccaguggcauagagaaccugugaaaaagcagcccucauaggcaucucgggguucguuucuccuucacuuaccuucagaggcccagccgaaggcaaccggaauugagaaagaaaaaucugaggaauuuugaacuacguauauuuaagguuuugcaaaauuuaaaaaguuaccucggccgggcacgguggcucacgccuguaaucccagcacuuugggaggccgaggcugguggaucaccugaggucaggaguuugagaccagccuguccagugugguucugaaaccucgucucugcuaaaaauacaaaaauuaaccgggccugguggccggcgccuguaaucgcagcuacuugggaggcucaggcaggagaauugcuugaacccaggaggcggacguugcugugagucgagaucguaccauugcacucuagccugggcgacagagcaaaaacucuaucucaaaauacaaacaaacaaaaaaaaguuaccuuacucugguuuccauuagaguaacucuuagcuauaacauuuuucuugcauuccgaccuucauaucucuaaaugugcggcauuugcaugcgcagaauguuuucuguuuuuuaguuaagucuguuaaggauacguucuguuauguuuuagaacuauugcauuacgguugaguuuccuuuauccaaaaugcuugggaccagaaauguuuuggauuucagauuuucuuuuuuaauauuuucauuauuuuuauuagagacagggucucacugucacuuaggcugaagggcaguggcgcuaucauagcucacugcagcucaagugauccucacaccucagccucccaaguaucugggaccacaggugcauacgccaccaugccuggcuaauuuuuaauuuuuuuuuuuuuuuuuuuuuuuuugagauggagucuugcucugucacccaggcugcagugcaguggcgcagucuuggcucaccgcaagcuccgccucccagguucacgccauucuccugccucagccuccugaguagcugggacuacaggcgccugccaccacgcccggcuaaguuuuuguauuuuugguagagaagggguuucaccguguuagccaggauggucucgaacuccugaccuugugauccgccugccucagccucccaaaguacugggauuacaggcgugagccaccacacccggccugauuuuuaaauuuuuuguagagcugggaucucacucucuuguccaggcuggucucagacucuggauucaagcaguccuccugccuuagccucucuaaugcuggauuauaggugugagucaccgugcccagccuugaaauauuuucauuauacuuacagguucagcaucccuaauccaaaauuugaaaugccccaaugagcauuuccuuugagcgucauguuggugcucagaauguugggacucagaaaguuucagcuuuuugugagcauuuuggguuuuagauuaaccuguaugugggaaucugugagagcacuagaguuagugauugcucuagcccagucuggaaguggaagaggaaaggauuccugaaagaaguagcaugugaugagacaggugagggagagcauuccuuuagccagaaguguggcgauguaacuagcuuguguacaugggaccauggaaaguucaagguuugcuggaguaaauuguggaauugggaauguuaagagaugaggcuggauaaauaguggagagccauaucauggagggcaucgcacaccuuaggaagaaucauauaagggucuuaagcacagagugacuuugucagauguguuuuucuucuuuuuuuuuuuuggcuucccacacuacagaugcagacuuugucaaauuucuguguuagaugauucacucuugcagcugugagaaagauggaccugaaaggauaggaugggagaccagguuuggggaccacugaagaaguccagauaaaaaugaugagagcaggccaggcgcgggggcucacgccuguaaucccagcacuuugggaggcccaggcagguggaucaccugaggucaggaguuugagaccagccugaccaacauggggaaaccccaucucuacuuaaaauaugaaaauuagccgggcgugguggugcacaccuguaaucccagcuacacaggaggcugaggcaggagaaucgcuggaacccgggaggcggagguugcagugagccgagaucccaccagugcacuccagccuggcaacagggugagacucugucuccaaaaaaauacauaaaucaauaaaaaugaugagagcacugaaaguagagguaggaagaggggaacagauuugauaagaaguuagcagauaaaaucagcagaacuuugugguccugggaugcucaaagaaaagucaaaaaugaugugcagauuuuggcaugggugacuagguggguguuagugccaccaacuggaagaccacaugaacaagaacagguuuaggaucgaagauaaagaaaucuaguuuaggauauauaaaguuugaaguuccugagaacauucagauggagauuuccccagguauuuauuuauaccuuauuucuucaguuccaagauacauauuuaaguacauauauacacauguguagauuccugauuccuucugcucccuuaguggugccucuuuaauugaugaucuguuagauuugauuuaaaaaguaugagugagacauuccagggagagaaaugaaacuagaaagguaagagcagucagggauagcuuagagguuccuaggugagaagcaaucugaagaaacauggagaacaggucuggauuaaagauguagauuucggagccuauccacaaaaggucaaaagcucaagaaugagugacaucacccagggacaauguggagugagaagaggagagggaggaauuuggaaauguggggaauacuaagaugaaguguggucagaaccugugggagggugccgggucuuggaaccaaggccuucaggaacacguguccagaauuggggugaugcugagcagugucaguugccuaagagcauuucaguuagaugaggacugaaaaguauccauuggauuugacaguuaggacgucauuggugaccuuagcaggagcuguuacagaaauaguagggauggaagccagauggcagugggugaggcuucaugggaagugagugaguggagacagcaaggacaaucuguuugucaguugaagagaaggaaggacaucagaugccaccuagagggagcuguaagucagugcagguguuuuugaaugacagugacuugagcguguuuuaauuaaggagcccaguagcaguugaguguacaagagaaaaguguggaauuggcuggacacaguggcucacgcccguaaucccagcacuuugggaggccaaggugggugaaucaccaagucaggaguucgagaccagccuggccaacauggugaaaccccgucucuacuaaaaauacaaaaauuagccaggcgcgguggcgggugccuguaaucucagcuacucgggaggcugaggcaggagaauugcuugaacccgggagguagagguugcagugagccaagaucgugccacugcaccccagccucggcgacagagcaagacuccgucucgaagaaaagaaaaguagguaauugaugagcagaggugcagagggucucccuagggauagaauaaagagcaagcagaggaaaaauccucugaaccugacaggaaagaggucuggaaagauguggauauagaugagguuagugggaagcuauaacaggauuuugaguuuuucagcuuuucuugggcugcaguuaggggaaagaguugugcauagugaauuucaugguauuaggguaugaugauugcugaagaaacugagagggauuggaagguguguugggagcucagcuggguuuugggaagacaacucugagcauuuguuuuucccagaaucacccagcuacucagugacagggaugcagaagguggauagauuacacuggugauuaaggaauagagcucuguuagaagacaguuguagagugguaaggcauugaaugcaagggaaucaagagugcgggacccagccggccgcgguggcucauaccuguaaucccagcacuuugggaggccgaggcggguggaucacgaguucaggagauugagaccauccuggcuaacgcggugaaaccccgucucuacuaaaaauacaaaaaauuagcuggaugucguggcgggcgccuguggucccagcuacucaggggggcugaugcaggagaauggcaggaaccugggaggcagagcuugcagugaaccgagaucgcgacacugcacuccagccugggugacagagcaagacucugucucaaaaaaaaaaaaaaaaaaaaaaaaagaaugcuagaccccauugagauacuggaagaggggagaggagagagagcagaagaggccauuggccugggaaagaauuguaggcaucagggaacuggauaucagaaguuagaggcugaggaguggaggagugucugagaggguaaggaugcaguugacucuagugguuagaagcacaggcucuggagucagaugggguucacaucauaucuuugucauauuacuaguugggaucuugggaauauugcccaugcugggccucaauucccucaucuguaaaauagggauacugauaggaccuaggucagacggcuuuugugagaauuaaaugaaacgggguauuuaguaagccauauuacuugguaaauugcaugauaaagcugggcaugguggcuuaugccugcaaucccagcacuuuuggaagccgaggugggaggacugcuugagcccaggaauuugagaccagcuuaggcaacauagcaagauccuguuuauauuuaaaaauaaauaaauaggccgggugcgguggcucacgccuguaaucccagcacuuugggaggccgagguagguggaucacgaggucaggaguucaggaccagccuggccaauauggugaaaccccaucucuacuaaaaauacaaaaauuagccaggcgugguggcacaugucuguagucccagcuacucuggagacugaagcaggagaaccacuugagccccggagguggagguugcggugagcugagauugcgccacugcacuccagccugggugacaaagugagacuccaucucaaaaaaaaaaaaaaaaaaaaaaagcuaugucaugggcaaguucuauaacuuguuuuuuaugaagacauaagagguauaacauauauaaauuucuuaccaugguaccuaguacacguagaccugaguaaauauuauuuuccuucuugccuccccuuaucccccaggaauuucugcuauuuaguaaaggaacacugggcuccucaggaauuuaugccuccuccccuucagggauagagcacuguuaacuacaacagaaauacuguguuccauuacacacaucagcaauuccaagugcaguccaagaauuuacuaaaccuaaugggaaucauccacuugccuuuaccccaguaucuagccuauccuggccccuggcccuccuuuuuuuuuuugagagggagucuugcucuauugcccaggcuggagugcaguggcacaauuucagcucacugcgacccccgccucccggguuuaaguaauucuccugccucagccuccugaguagcugggauuacaggugccugccaccaugcccggcuaauuuuuguauuuuuaguagagacaggguuucaccauguuggucaggcuggucucaaacuccugaccucaugauccaaccgccucggccucccaaagugcugggauuacaggcaugagccaccgcacccggccccccuccuuucuguagaucugccugguugucucauccuguggacaugcgagaugcucagucuagcuuucauaguaggguuugagcuguuaucucaccugcagucuuuucuccuugcuugucugaauaccauuugcucaaggcagauuacuauaguaacuccagccaacgcacucuuucaccucaauaauuguucagaagacauuuuuugccuuaaagucuugacuauaucauuugguauuuugugguuugcuaucuuguuuuauucagcuuuucaaagaaacagcuuugguuucauuaauuuuuaucguuuuucucuuuuuuguugcauugauuuuuuuuuuuuuugagauggggucucuaugacccagguuggugugcagugucgcagucucagcucacuguaaccucugccucccaggcucaggagacccucccaccuuagccucccaaguagcugggaccacaggcacaugccaccaugccuggcugauuuuucuuuguauuuuggauacagacaguuucgccauguugcccaggcuggucuugaauuccugagcucagguaauccaccccccugggcucccaaagugcugggauuguaggugugagccaccacgccuggccuuguugcauugauuucuucucuuaucauugccaucccuuugcuaguuuguuaagguaaaagguuagauuaucaauuuuggaccuuucucuuuuuuuuuuuuugagacagagucucgcccugucacucagguuggagugcaguggcgcgaucucugcucacugcaagcuccgucucccggguucacgccauucuccugcuucagcucccaaguagcugggacuacaggugcccaccaccacacccggcuaauauuuuuuuuuguauuuuuacuacgacgcgguuucaccguguuugcgaggauggucucgaucuccugaccaccaccugaucagcuugccucggccucccaaaguguugggauuauaggugugagccaccgcaccuggccuggaccuuucucuuuuucuuuuuuuuuuuuuuugagauggagucucacucucucacccaggcuggagugcaguggcgcgaucucagcucacugcaaccuccgcccucugaguucaagcgauucuccugccucagucucccgaguagcuaggauuacagaugccugccaccgcacccggcuaauuuuuuuguguguuuuuaguagagacaggguuucaccaucuuggccaggcuggucuugaacucuugaccucgugauccaccugccucguccucccaaagugcugggauuacaggcgugagccaccgugcccagcugaccuuucucguuuuuuuuuguuugagacggagucuugcucugucgcccaggcuggagugcaguggcgcaaucuuggcucacugcaacuuccgccuccuggguuugugucauucuccugccucagccuccugaguagcugggacuauagucgccugccaccaugcucagcuaauuuuuuguauuuguaguagagacggguuucaccguguuagcugggauggucuugaucuccugaccucgugauccacccaccucagccucccaaagugcugggauuacaggggugagccaccgugccuggccaaccuuucucuuuuucuaauaguauuauucacuucuguaaauuuuccucucagcauugcuuuagcugcauuccucccuuuuuuuuuuuuuuuuuuuuugaggcagagucucacauuuucgcccgggcuagagugcaguggcacgaucucggcucacugcaaccuccgccuacccuguucaagcgauucuccugccucagccucccaaguagcugggauuacaggugcccgccaccacacccagcuaauuuuuuuuuguauuuuuaguagagacagguuuuuaccauguuggccaggcuggucuugaacucgugaccucgugauucacccgccuuggcuucccaaagugcugggcuuacagauaugagccaucgugcccggccccauuccucacauuuuaauauguuguguuuucauuuuuauuuaguuaaaaguauauucuaauuucccuuaugaguucauauuucaccuuagguuguuucaaauuaugcuguuuacauauuuggggguuucccuuauuaguuucugcuuugauuccauuaugauuaggaaacauguuguauaugaucuuaguuuuaaaaaauguaucaagauuuuuuuuuuaauaauuaauucauuuagaggugggaucucacucuugccuagguuggacccaaacuccugggcgcaagcgauccuccugccucagccuuccaaagaguugggauuacgggcaugagcuacugcaccuggcugaggcugacuuuuugauguccuagcguacagucucucuuggugccuguccuaugugugcuggaaaauaucuguuaaucuguauucugcuauuguuagguugaguguuuuacaaacauuagguccagucaguugguuacauugcuuaagucuucuauauccuuagugauauuuuuuguauacuucuaucgauuacugaggaguauuagaaaucucuaguaaucccagcaguuugggaggcugaggcugguggauugcuugagcacaggaguucgagaccagccugggcaacauagcgaaaccccauuucuacaaaaaaaauacaaaaauuagcuggguguggugguacacgccuguagucccaggugcuugggaggcugaggcgggagagucuccugagccugggagguggaggcugcaaugaguggagauggugccauugcacucuagccugggcaacagagcaagacccugucuugcuugagagaaagauccaacuacagcugugaguuuauugucuuucagguccaucauuuuugaaauucuguuauuaguuacauaauguauuuaggauuauuaggucuucugaacgaguugacuacuuuaucguaucaaauaucccucuguauuccugauaacauuccauggucugaagucuuugucuuaaucaguagugccacuccagcuuuguuuuguguuugcauggguguauuuuuccaucuuuuuacuguuaaucugugucuuuguaacuaaaguuuauuuccuauagacagcauauaguuggcucuuuuuuuuuuuuuuuuuuuuuuuuuuuuugagauggagucucuuccuugguugcccaggcuggagugcaguggcaugaucuuggcucagugcaaccucugccucccgaguucaagcgauucuucuaccucagccucccaagaaacugagacuacaggcgcgugccaccacgcucagcuaauuuuuguauuuuuaguagagacggggggucucaccaugcuguccaggcugguuucgaacuccugaccccgaggcccgccucagccucccagagugcugggauuacaggugugagccaccaugcccggccuuuuuauuuaaauccaauuugacaauguuugccuuacaaauggucuaaauaccucaauuaagguuaauguaacuaucaauguggcaauguagcucaguuuaaaucuaccgucuuacucuuuuuuuuuuaaauuauuuuuucugcuuuucucuuguccugccuucuucugaauuuaguuguuuugugacuuuaucuccacuuuucacuuauuuggcuacaugguuuuuuucuuauuguuugcucuaagguuuacaguauauacauagcucacuuacugugaucuacuuugaccauuagucuacuacggaucacuucacauauaguacaagaaccuuagaauaauacacuuuaaguuccacucccacucuuaguaguauuuuugucauaacauuuuaauuguacauguauuauaagugcuauaauacuuuguuacucuuuuugcuuugaacagccuuuaucuuuuguagaaauugcaaaaugagaaaaaauauuuuuuugcauuuuacccacauacuuaccauuucugguguucuucacuaguuuguauagcuccaucuggugugcuuuuuuuuuucuuuuucuuuucuuuuuuuuuuuuuugagacacagucuugcucugucucccaggcuggagugcaguggugcgaucucagcucacugcaaccucugccuccuggguucaauuucuguauuuuuaguagagacgguuucauguuggccaggcuggucuugaacuccugaccucaggugauccacccaccucggccucccaaagugcuggcaugacaggcgugagccaccacaccuggcccaggggaaccauuuuuuuuuuuuuuuccccugagauggagucucgcuguguugcccaggcuggaaugcaguggcacaaucucagcucacugcaaccuccaccucccagguucaagcgauucucuugccucagccuucugaguagcugggauuacaggcgucugccaccacacccggcuaauucuuguauuuuuaguagaaacaggguuuugccauguuggccaggcuggucuccaacucccgggcucaagcaguccucccaccuuggccucccaaagugcugggauuauaggcaugagccaucgcgcccagccucauuguguuuugcuuucuauuucccuagugacuaaugauguugaacucaaaucuuucuuuaguaguagggauaaaacuaacugcaucaaguagucuccacccuccccgccccuggcucaucuguaauuuacuuuuuuuucuacuaccuuuagauugugaauaaguggaauacagcucucauuggccuuaugacauacuuucgggaggcuguggugaacacccaagagcucuuggacuuacuggugaagugugagaacaaaauccagacacguaucaagauuggacucaacuccaagaugccaagucgguuccccccgguuguguucuacaccccuaaggaguuggguggacucggcaugcucucaaugggccaugugcucaucccccaauccgaccucagguacagccugguucaacguauuucuaaacccuauugcucaggcccuaagggaaguggguauuucuuuaguuuuaggcuuuauuuuuucuguaaucuugguuguacacccaaacaggugguccaaacagacagauguagguaucacacacuuucguucaggaaugagccaugaagaagaccagcucauucccaacuuguaccgcuacauacagccaugggagagcgaguucauugauucucagcgggucugggcugaguacgcacucaagaggcaagaggccauugcucagaacaggugggcaccuaggagggcaugccaacccuggggcaggggcagugguggccuuugaaccguguggaguucagggucagagcaugccaugguuguauggaggugagaaggcugguucuacugacccuaauuauuuuuggccaggaaggagugcugagcuccucauaugagaucacguuuugacuugaaucuuucuuuuuuuggaagacgccugacuuuagaagaccuagaagauucaugggaucguggcauuccucgaaucaauacccucuuccagaaggaccggcacacacuggcuuaugauaagggcuggcgugucagaacugacuuuaagcaguaucagguauguagagggagcagauuuucccugagucaggaaaauccauggcuauccccgaaacuuggggcaauaggcacccagaagcuugaccgugccugccuugccaucuagguuuugaagcagaauccguucugguggacacaccagcggcaugaugggaagcucuggaaccugaacaacuaccguacagacaugauccaggcccugggcgguguggaaggcauucuggaacacacacucuuuaagggcacuuacuucccuaccugggaggggcuuuucuggugaggauucuccucucuuagagggaccugucacaacccuuugagcucaucucuuguaugccucugugauuuccugugguguuucccagacagccaccuccaggagguuagcagugugcugggaaauggcaggauaucaccucaccugcuucucuugcuccccagggagaaggccaguggcuuugaggaaucuaugaaguggaagaagcuaacuaaugcucagcgaucaggacugaaccagauucccaaucguagauucacccucuggugguccccgaccauuaaucgagccaaugugagugugauugacacuggagaggggaagcuaaagacaguugcugcuucuugccuugguuaugucgugagcgcccgagucucuugaucucuaaugucacauugucguuuuccuggcagguauauguaggcuuucaggugcagcuagaccugacggguaucuucaugcacggcaagauccccacgcugaagaucucucucauccagaucuuccgagcucacuuguggcagaagauccaugagagcauuguuauggacuuaugucaggugggcuggaaucgaggggagaggguacuguagagagucagcucagguggaauugaggggagaggguacuguacagagucagcucagguggaaucgaggggagaggguacuguacagagucagcucagguggaaucguggggagaggguacuguagagagucagcucagguggaaucgcagggagagggugcuguacagagucagcuuagguggaaucgcggggagagggugcuguacagagucagcucagguggaaucgcggggagagcgugcuguacagagucagcucagcuugcucuuuugcauaugggaaauccacccuggaagcucugaggaugagacuccuauugccucauuaucuuauuguacaaacucugauuuuaauugggcuuccuuaacaagucuuaaucucuccauguuuuccuucagguguuugaccaggaacuugaugcacuggaaauugagacaguacaaaaggagacaauccauccccgaaagucauauaagaugaacucuuccugugcagauauccugcucuuugccuccuauaaguggaaugucucccggcccucauugcuggcugacuccaaguaagugccucaggacccagcccuaggcagccaggacacuuucguuuuccuguucuucuagcccugcaacuuuaggaauuguccugucugccuuuguuucaaacuuggagccagugcuacgcuuggagccugucaacacccuuagucagaucugcugauucucugggguccugcugaccuggaacaaguugguggagugggugggaugguuuugggauuuaagugguucugguucuggggacauugguuaugcccaugguuucuuagaagcuugaacccucuucauccucagggaugugauggacagcaccaccacccagaaauacuggauugacauccaguugcgcuggggggacuaugauucccacgacauugagcgcuacgcccgggccaaguuccuggacuacaccaccgacaacaugaguaucuacccuucgcccacagguguacucaucgccauugaccuggccuauaacuugcacaggugaguugaggcucaggaccauguauuuucaggccaggcgcaguggcucacaccuguaaucccagcacuuugggaggccgcggugggcagauugucugagcucaggaguuugagaccagucugggcaacauggugaaacccugucucuaccaaaauacaaaaaauuagcugggcguggugguccacgccuguagucccagcuacucagaagguugaggugggagaauuacuugaacccgggaggcggagcuugcagugaaccgagauugcgccacugcacuccagccugggcgacagagugagacuccaucucaaagaaaaauaauaauaauaauaaauaaauaaauaauccguguauuuuccauuagcuccauacuuuaacguagucauacuuuuuuacuuuaccuaagugagaggaaguggcccauuccuccuaugggucacugauucucuucuccagccuguauguacacaugagcagaguguugucagccuggcgaacagucuuucuuccucuguagaguuggcagcuugucuuguuucuggggcugucauucucgucuuaacuuuucuugacccuuuuauccucacagugccuauggaaacugguucccaggcagcaagccucucauacaacaggccauggccaagaucaugaaggcaaacccugcccuguauguguuacgugaacggauccgcaaggggcuacagcucuauucaucugaacccacugagccuuauuugucuucucagaacuauggugagcucuucuccaaccagauuaucugguuuguggaugacaccaacgucuacagagugacuauucacaaggugaguguuagcagcaguguauaggugcgggacucuguacauggcugugggagaguaaugggcuaaguguguacacaugcugggaagaaggcaggauggggauguguuguguaggccaugcuaacgaaugccguccuccucuagaccuuugaagggaacuugacaaccaagcccaucaacggagccaucuucaucuucaacccacgcacagggcagcuguuccucaagauaauccacacguccgugugggcgggacagaagcguuuggggcaggugagcagguuuaaagaugaagaggcuguagaaccauguugccucuuauucuugggguggacuugguaauauuuacugguuuauuagaugaaaggcugagaacaucucauuugaacuuauccccaaaauaccuugggaaguauucugugggagguccaagaguguaugaggugcuucguucccuuccagcuggucuguuuccugaauuucuaaccuugaacagggcuaucaaaaaucauuuuuccaaaggcaacgcauacucuuuuuuuuuuuuuuuuuuuuuagccggagucucgcuguguggcccaggcuggagcacaguggcucaaucucgguucacugcaagcuccgccucccggguucacgccauucuccugccuuagccucccgaguagcugggacuacaggcgcccgccaccacgccuggcuaauuuuuuuuguauuuuuuaguagagacaggguuucaacguguuagccaggauggucucgaucuccugacuuugugaucugccugccucugccucugccucccaaagugcucggauuacaggugugagccacugcuccuggccagcaaugcauauucucuuuuuuuuuuuuuuuuuuugagacggagucuugcucuguugcccaggcuggaaugcaguggccugauuucagcucacugcaagcuccgccucccagguucacgccauucuccugccucagccucccgaguagcugggacuacaggugcccgccaccacgcccggcuaaauuuuuuguauuuuuaguagagacgggguuucaccauguuggccaggauggucucaaucuccugaccucgugauccgcccgccuuggccucucaaagugcugggauuacaggcuugagccaccgugcccggcccagcaacgcauauucuugaaacauccacuuugaccaaaucucuucucuaccucacaacucuugcugaauuaacucuucuuuagcuuccuagacguucaacaucuggcugggcuguaucuguccagccaguuucucuuccuuuacauuuauagcauguuucaucuuacauucaguccaggaucuuaguagcccaaaccccugaugcucaucuccaaaucuguguuuugcuuguauuuuucuuucuagaaugaacuccccucuuugcucuguuaaucacagucccuccuuaagacacguuuuuuugugcagcuuuuuucugauccuaguagccuuaauuucuuuuguuccugaacucuguaaaacaguguauaguuuagcacauacucaugugucagcuugugguauugucuuguugaaaggggcugucagccuggucauuggacacggccauuugauacucuuuguaccuucuaagugccuaacauuuaacaucaguguucaauagaaacguaguuggauuauuucaaaacuaggauauucuguucuaguugaucugggaggguagagacuaaauuuccauuuucuucucucuugcuuuuaaguuggcuaaguggaagacagcugaggagguggccgcccugauccgaucucugccuguggaggagcagcccaagcagaucauugucaccaggaagggcaugcuggacccacuggagguaagaggguggggugggguaggagaaaagagaccuugagaccuucaggcuguuucucaucuuggacuugaucuugucuuaggugcacuuacuggacuuccccaauauugucaucaaaggaucggagcuccaacucccuuuccaggcgugucucaagguggaaaaauucggggaucucauccuuaaagccacugagccccagaugguucucuucaaccucuaugacgacuggcucaagacuauuucaucuuacacgguaugaaccucgggaagagaagaucgcuggaggaggagcggguuuaggguuaggagaagauccugugucagguuuuugccauuuucacauuuuuagccuauagauugggugggaacucuguugacuuucaugagaguuuaagaccuuaaaguuaaaaaucaacucuuggggccgggcgugguggcucacgcccguaaucccagcacuuugggaggcugaguugggugaaucaccugaggucaggaguuugagaucaggcuggccaacaugacgagaccccaucucuacuaaaaauacaacaaaauuagccgagugugcugggaugcaccuguagucccagcuacucgggaggcugaggcaccagaaucacuggaacccaggaggcagagguugcagugagccgagauggcaccauugcacuccagccugggcgacagaguaagacugucuaaaaaaaaaaaaaaaaaggccgggcgcaguggcucacgccuguaaucccagcacuuugggaggccgaggcggcggaucacgaggucaggagauugagaccauccuggcuaacacagugaaaccccaucucuacuaaaaauacaaaaaauuagccgggcgugguggcaggugccugucaucccagcuauucgggaggcugaggcaggagaaugguaugaaccugggaggcggagcuugcagugagccgagaucaugccacugcacuccagccugggcgacagagcaagacucugucucaaaagaaaaaaaaaaaauucuuggguuucaugaaagguuaggauuaaagugggagagccucaagcagcugaccuaccccacucuuccaaaucuuuucccaggccuucucccgucucauccugauucugcgugcccuacaugugaacaacgaucgggcaaaagugauccugaagccagacaagacuacuauuacagaaccacaccacaucuggcccacucugacugacgaagaauggaucaaggucgaggugcagcucaaggaucugaucuuggcugacuacggcaagaaaaacaagugagcagugcugguggggacacagacaggaggucuauauacgguuuucugggguuuuuuggaagcacuuaggcuuagaaguuucucaagaaggccaggcgcgguggcucaugccuguaaucccagcacuuugggaggccaagguggguagaucauuugaggucaggaguuugaaaccauccuggccaacguggugaaacuccgucucuacuaaaaauacaaaaguuagccgggugcgauggcgccuaccuguaaucccagcuacucgggaggcugaggcaggagaauugcuugaaccugggggcagagguugcagugagccgagaucaugccacugcacuccagccugggcgacaagagugagacugucuccaaaaaaaaaaaaaaaaaagacguuucucaagaaauuaucuugucuuagccaggcuugagugcucaugcuaguaauaccagcacuuugggaggccaaggugggaggauugcaugagccaggaguugaaaccagccugaucaacaagagacugacgccaucucuaccaaaaaaaaaaaauuuaaaacagguguggugguacacgcuuguagucccagcuucuuggaggcugaggcaggaggcuugcuugagcccggggguuugaggcugcagugagccaugaugaugccacuguacuccagccuggguaacagagcgagacucuugucuugaaaacaaggaaagaaauuaucuuacagagucucgaggaagagagauacagcagugucuucgaauaguaugggaagcaucccuguuuuagggcuucagucugacucuuggccauuguuucucacuguugccauuucaaacagggcauuucuuuacuguccauacaugggaagaauuuugaacauccgagacccuaaguauccgagacugcugccaacacacacacacaccuuccuccccucgucucccucccugucaucguggcaaccaaaauuauccauagggugacggacaauaccaccucugauuaagaaccaguauucuaggguuucugggguuuccauuucugagaacaguuccaugccagagcauuguuuuggucaaggaagcguaggguuuauggaugcuaaacagugggaaggugcacacgcagugugcugucccgcuuggaucugacgaaucuuggaaguguuagugcaccuccguuucacacuuccuguagaagcagcucuuguggauugucuggggcgugaguauaggcuguccuguccuaccaaguuacacccuuuccauugaggcagaagugaccaaggggaagggauccuuguaauauaacccacaccauccccacagugugaacguggcaucacugacacaaucagaaauucgagacaucauccuggguauggagaucucggcaccgucacagcagcggcagcagaucgcugagaucgagaagcagaccaaggaacaaucgcagcugacggcaacacagacucgcacugucaacaagcauggcgaugagaucaucaccuccaccaccagcaacuaugagacccagacuuucucauccaagacugaguggagggucagguacugucgggcaagaggguggggauggaaaggccggcugcacuaccuaaggugcugggcugagcgaugcugacacucccugccuguuuuuagggccaucucugcugccaaccugcaccuaaggaccaaucacaucuauguuucaucugacgacaucaaggagacuggcuacaccuacauccuucccaagaaugugcuuaagaaguucaucugcauaucugaccuucgggcccaagugaguaaguggacucagcuaggccacagugugugcccaacucauuuugugccuaaaacucagaccugagauugucuggaacuugagaugcugguuucaagauucauggaugaguaauuauacaaggauagccaaaacaacgagguggguuuuggccccaugagauagcaaaagcuguggcagcugagagaagguaguaauuguaguauuggccugauaguauuuggaagagaacagauauggucagaaacaaauuccugaccaggugugcgugcuggcucaugccuguaaucccaacacucggcugggcacaguggcuaaugccuauaaucccagcacuuugggaggccuagguggguggaucaccugaggucagggguuugagaccagccugaccaauauggugaaacccugucucuacuaaaaauacaaaaaauuagccaggcaugguggcaugcgcccguaguugcagcuacuagggagguugagacaggagaauugcuugaacccgggaggugagguggagcuugcagugagccaagauugcaucacugcacuccagccugggcaacagagcaagaccccgucuaaaaaaacaaaaccaaaaaaaacguggcuguagucccagcuacucaggaggaugagguugcuugaacgcaagcagugagcuuugaugaccccacugcacuccaggcugggcacaguggcucaugacuguaaucccagcacugugggaggccgaggugggcagaucuuuugagcccaggaguucgagaccagccugggcaacaugacgaaauggagucucuacaaaaaaaaaaaaaaaaaacuagccaggcaugguggcauacaccuguaaucucagcuacucaggaggcugaggugggaggaucaccugauccuggaggguggugaguguagugagcugagaucaugucacugccugcuagccugggugacagagugauacccugcuucaaaaaagagaaaagaugcauaacuuuacuaguguaucagggauauuauaguuuauaaaacaucauuuugggccaaggugggugaaucacuugaggucaggaguucaagaccagcuuggccaacguggcgaaaccccgucucucuuaaauauaugaaaauuagcggggcaugguggcaugugccuguagucccagcuacucaggaagcugaggcaggagaauugcuugaacccaggaggcggaggucgcagugagcugagaucacaccacugcacuccagccuugcugacagagugagacuccaucucaaacccacuauuuaguggcugucagguuggcaaauuugaaaagauuguuaauauccugugugggugaguuuauaguaaacagauccucuuucuuucuuggugauaauguaaaacuuaaaauagcaccaagugcugguuuuccagauguuuucagcuugugaaaauacacugagcugcaugugugcucauuugcuugugaauacuaugcuuaauaaucagcuggggagcuugugagcagugcagauuccuggaccccacucaggagauucugaugugguaaguccgcgaugagguccaugucuaacauuuugaacaagcaccccagcugauucugauacaggggguucugaucacguuuuaagaaacucuguccucguucuugggggaaggaaggaaacagagggcuggcagcuccaacucugaccugguacuaagaagaguuuugguuccugaccccuuugucuccagauugcaggauaccuauauggggugagcccaccagauaacccccaggugaaggagauccgcugcauugugauggugccgcaguggggcacucaccagaccgugcaccugccuggccagcugccccagcaugaguaccucaagguaauggggagugauggagccugggaguguggaaaagcuggugcgauuccugucuguggaugggauucagcucuguacuccucuuuaccuauaggagauggaacccuuagguuggauccacacucagcccaaugaguccccgcaguuaucaccccaggaugucaccacccaugccaagaucauggcugacaacccaucuugggauggcgagaagaccauuaucaucacaugcaggugggccugggcuccuugggaggaaguaugguggggcagggauugcaggccagggcccagaacaguggccugagcuguuacucuguccucguuccucccccagcuucacgccaggcuccuguacacugacggccuacaagcugacccccaguggcuacgaauggggccgccagaacacagacaagggcaacaaccccaagggcuaccugccuucacacuaugagagggugcagaugcugcugucggaccguuuccuuggcuucuucauggucccugcccaguccucguggaacuacaacuucauggguaagugggaggagccuggggauguggggauagcaguagggauaaggugaggccaucgcccuuugcacuuggggccuggcuggcuuggagguggcgcaggcugcaugaggcaggagcccuguuaacauuggcuguuuccuucuccccgaagguguucggcaugaccccaacaugaaauaugagcuacagcuggcgaaccccaaagaguucuaccacgaggugcacaggcccucucacuuccucaacuuugcucuccugcaggagggggagguuuacucugcggaucgggaggaccuguaugccugaccguuucccugccuccugcuucagccucccgaggccgaagccucagccccuccagacaggccgcugacauucagcaguuuggccucuuucccucugucugugcuuguguuguugaccuccugauggcuugucauccugaauaaaauauaauaauaaauuuuguauaaauagga

SEQ ID NO: 5830 - RNA, 18 nt, Artificial Sequence
  Description of Artificial Sequence: Synthetic oligonucleotide
gcguuggccucuucaugc

SEQ ID NO: 5831 - RNA, 18 nt, Artificial Sequence
  Description of Artificial Sequence: Synthetic oligonucleotide
gggcagcguuggccucuu

SEQ ID NO: 5832 - RNA, 18 nt, Artificial Sequence
  Description of Artificial Sequence: Synthetic oligonucleotide
uuuucgggcagcguuggc

SEQ ID NO: 5833 - RNA, 18 nt, Artificial Sequence
  Description of Artificial Sequence: Synthetic oligonucleotide
gugaguuuucgggcagcg

SEQ ID NO: 5834 - RNA, 18 nt, Artificial Sequence
  Description of Artificial Sequence: Synthetic oligonucleotide
cugcugugaguuuucggg

SEQ ID NO: 5835 - RNA, 18 nt, Artificial Sequence
  Description of Artificial Sequence: Synthetic oligonucleotide
cuguucugcugugaguuu

SEQ ID NO: 5836 - RNA, 18 nt, Artificial Sequence
  Description of Artificial Sequence: Synthetic oligonucleotide
uuucucuguucugcugug

SEQ ID NO: 5837 - RNA, 18 nt, Artificial Sequence
  Description of Artificial Sequence: Synthetic oligonucleotide
ugaccuuucucuguucug

SEQ ID NO: 5838 - RNA, 18 nt, Artificial Sequence
  Description of Artificial Sequence: Synthetic oligonucleotide
uuucuugaccuuucucug

SEQ ID NO: 5839 - RNA, 18 nt, Artificial Sequence
  Description of Artificial Sequence: Synthetic oligonucleotide
uuaauuuucuugaccuuu

SEQ ID NO: 5840 - RNA, 18 nt, Artificial Sequence
  Description of Artificial Sequence: Synthetic oligonucleotide
gcuuuuuaauuuucuuga

SEQ ID NO: 5841 - RNA, 18 nt, Artificial Sequence
  Description of Artificial Sequence: Synthetic oligonucleotide
uuuaagcuuuuuaauuuu

SEQ ID NO: 5842 - RNA, 18 nt, Artificial Sequence
  Description of Artificial Sequence: Synthetic oligonucleotide
ucuucuuuaagcuuuuua

SEQ ID NO: 5843 - RNA, 18 nt, Artificial Sequence
  Description of Artificial Sequence: Synthetic oligonucleotide
aaaugucuucuuuaagcu

SEQ ID NO: 5844 - RNA, 18 nt, Artificial Sequence
  Description of Artificial Sequence: Synthetic oligonucleotide
cugugaaaugucuucuuu

SEQ ID NO: 5845 - RNA, 18 nt, Artificial Sequence
  Description of Artificial Sequence: Synthetic oligonucleotide
acccccugugaaaugucu

SEQ ID NO: 5846 - RNA, 18 nt, Artificial Sequence
  Description of Artificial Sequence: Synthetic oligonucleotide
uguguacccccugugaaa

SEQ ID NO: 5847 - RNA, 18 nt, Artificial Sequence
  Description of Artificial Sequence: Synthetic oligonucleotide
agauauguguacccccug

SEQ ID NO: 5848 - RNA, 18 nt, Artificial Sequence
  Description of Artificial Sequence: Synthetic oligonucleotide
uauacagauauguguacc

SEQ ID NO: 5849 - RNA, 18 nt, Artificial Sequence
  Description of Artificial Sequence: Synthetic oligonucleotide
uuuggcccaguauggaca

SEQ ID NO: 5850 - RNA, 18 nt, Artificial Sequence
  Description of Artificial Sequence: Synthetic oligonucleotide
ggaaguuuggcccaguau

SEQ ID NO: 5851 - RNA, 18 nt, Artificial Sequence
  Description of Artificial Sequence: Synthetic oligonucleotide
gggaaguuuggcccagua

SEQ ID NO: 5852 - RNA, 18 nt, Artificial Sequence
  Description of Artificial Sequence: Synthetic oligonucleotide
uuuuaguaauucuaaggg

SEQ ID NO: 5853 - RNA, 18 nt, Artificial Sequence
  Description of Artificial Sequence: Synthetic oligonucleotide
aaauguuuuaguaauucu

SEQ ID NO: 5854 - RNA, 18 nt, Artificial Sequence
  Description of Artificial Sequence: Synthetic oligonucleotide
uuggaaaauguuuuagua

SEQ ID NO: 5855 - RNA, 18 nt, Artificial Sequence
  Description of Artificial Sequence: Synthetic oligonucleotide
agcacuuggaaaauguuu

SEQ ID NO: 5856 - RNA, 18 nt, Artificial Sequence
  Description of Artificial Sequence: Synthetic oligonucleotide
ccucaagcacuuggaaaa

SEQ ID NO: 5857 - RNA, 18 nt, Artificial Sequence
  Description of Artificial Sequence: Synthetic oligonucleotide
uucugccucaagcacuug

SEQ ID NO: 5858 - RNA, 18 nt, Artificial Sequence
  Description of Artificial Sequence: Synthetic oligonucleotide
aaugauucugccucaagc

SEQ ID NO: 5859 - RNA, 18 nt, Artificial Sequence
  Description of Artificial Sequence: Synthetic oligonucleotide
gccacaaugauucugccu

SEQ ID NO: 5860 - RNA, 18 nt, Artificial Sequence
  Description of Artificial Sequence: Synthetic oligonucleotide
uuuaggccacaaugauuc

SEQ ID NO: 5861 - RNA, 18 nt, Artificial Sequence
  Description of Artificial Sequence: Synthetic oligonucleotide
augcuuuuaggccacaau

SEQ ID NO: 5862 - RNA, 18 nt, Artificial Sequence
  Description of Artificial Sequence: Synthetic oligonucleotide
uagguaugcuuuuaggcc

SEQ ID NO: 5863 - RNA, 18 nt, Artificial Sequence
  Description of Artificial Sequence: Synthetic oligonucleotide
gguguuagguaugcuuuu

SEQ ID NO: 5864 - RNA, 18 nt, Artificial Sequence
  Description of Artificial Sequence: Synthetic oligonucleotide
gaacugguguuagguaug

SEQ ID NO: 5865 - RNA, 18 nt, Artificial Sequence
  Description of Artificial Sequence: Synthetic oligonucleotide
aguaggaacugguguuag

SEQ ID NO: 5866 - RNA, 18 nt, Artificial Sequence
  Description of Artificial Sequence: Synthetic oligonucleotide
aagagaguaggaacuggu

SEQ ID NO: 5867 - RNA, 18 nt, Artificial Sequence
  Description of Artificial Sequence: Synthetic oligonucleotide
auuaaaagagaguaggaa

SEQ ID NO: 5868 - RNA, 18 nt, Artificial Sequence
  Description of Artificial Sequence: Synthetic oligonucleotide
gggucauuaaaagagagu

SEQ ID NO: 5869 - RNA, 18 nt, Artificial Sequence
  Description of Artificial Sequence: Synthetic oligonucleotide
cacuagggucauuaaaag

SEQ ID NO: 5870 - RNA, 18 nt, Artificial Sequence
  Description of Artificial Sequence: Synthetic oligonucleotide
auccacacuagggucauu

SEQ ID NO: 5871 - RNA, 18 nt, Artificial Sequence
  Description of Artificial Sequence: Synthetic oligonucleotide
ucuugauccacacuaggg

SEQ ID NO: 5872 - RNA, 18 nt, Artificial Sequence
  Description of Artificial Sequence: Synthetic oligonucleotide
cuagcucuugauccacac

SEQ ID NO: 5873 - RNA, 18 nt, Artificial Sequence
  Description of Artificial Sequence: Synthetic oligonucleotide
auuuacuagcucuugauc

SEQ ID NO: 5874 - RNA, 18 nt, Artificial Sequence
  Description of Artificial Sequence: Synthetic oligonucleotide
acaagauuuacuagcucu

SEQ ID NO: 5875 - RNA, 18 nt, Artificial Sequence
  Description of Artificial Sequence: Synthetic oligonucleotide
auuuuacaagauuuacua

SEQ ID NO: 5876 - RNA, 18 nt, Artificial Sequence
  Description of Artificial Sequence: Synthetic oligonucleotide
ucgcuauuuuacaagauu

SEQ ID NO: 5877 - RNA, 18 nt, Artificial Sequence
  Description of Artificial Sequence: Synthetic oligonucleotide
aacucucgcuauuuuaca

SEQ ID NO: 5878 - RNA, 18 nt, Artificial Sequence
  Description of Artificial Sequence: Synthetic oligonucleotide
ucauuaacucucgcuauu

SEQ ID NO: 5879 - RNA, 18 nt, Artificial Sequence
  Description of Artificial Sequence: Synthetic oligonucleotide
auaagucauuaacucucg

SEQ ID NO: 5880 - RNA, 18 nt, Artificial Sequence
  Description of Artificial Sequence: Synthetic oligonucleotide
uaaacauaagucauuaac

SEQ ID NO: 5881 - RNA, 18 nt, Artificial Sequence
  Description of Artificial Sequence: Synthetic oligonucleotide
aaccauaaacauaaguca

SEQ ID NO: 5882 - RNA, 18 nt, Artificial Sequence
  Description of Artificial Sequence: Synthetic oligonucleotide
uggguaaccauaaacaua

SEQ ID NO: 5883 - RNA, 18 nt, Artificial Sequence
  Description of Artificial Sequence: Synthetic oligonucleotide
agaacuggguaaccauaa

SEQ ID NO: 5884 - RNA, 18 nt, Artificial Sequence
  Description of Artificial Sequence: Synthetic oligonucleotide
agggaagaacuggguaac

SEQ ID NO: 5885 - RNA, 18 nt, Artificial Sequence
  Description of Artificial Sequence: Synthetic oligonucleotide
uugagagggaagaacugg

SEQ ID NO: 5886 - RNA, 18 nt, Artificial Sequence
  Description of Artificial Sequence: Synthetic oligonucleotide
aagacuugagagggaaga

SEQ ID NO: 5887 - RNA, 18 nt, Artificial Sequence
  Description of Artificial Sequence: Synthetic oligonucleotide
aaaagaagacuugagagg

SEQ ID NO: 5888 - RNA, 18 nt, Artificial Sequence
  Description of Artificial Sequence: Synthetic oligonucleotide
aaaaaaaaagaagacuug

SEQ ID NO: 5889 - RNA, 18 nt, Artificial Sequence
  Description of Artificial Sequence: Synthetic oligonucleotide
gguaaaaaaaaaaagaag

SEQ ID NO: 5890 - RNA, 18 nt, Artificial Sequence
  Description of Artificial Sequence: Synthetic oligonucleotide
auucugguaaaaaaaaaa

SEQ ID NO: 5891 - RNA, 18 nt, Artificial Sequence
  Description of Artificial Sequence: Synthetic oligonucleotide
cuaauauucugguaaaaa

SEQ ID NO: 5892 - RNA, 18 nt, Artificial Sequence
  Description of Artificial Sequence: Synthetic oligonucleotide
cagaacuaauauucuggu

SEQ ID NO: 5893 - RNA, 18 nt, Artificial Sequence
  Description of Artificial Sequence: Synthetic oligonucleotide
uuguucagaacuaauauu

SEQ ID NO: 5894 - RNA, 18 nt, Artificial Sequence
  Description of Artificial Sequence: Synthetic oligonucleotide
uugacuuguucagaacua

SEQ ID NO: 5895 - RNA, 18 nt, Artificial Sequence
  Description of Artificial Sequence: Synthetic oligonucleotide
guauauugacuuguucag

SEQ ID NO: 5896 - RNA, 18 nt, Artificial Sequence
  Description of Artificial Sequence: Synthetic oligonucleotide
aacaaguauauugacuug

SEQ ID NO: 5897 - RNA, 18 nt, Artificial Sequence
  Description of Artificial Sequence: Synthetic oligonucleotide
gccugaacaaguauauug

SEQ ID NO: 5898 - RNA, 18 nt, Artificial Sequence
  Description of Artificial Sequence: Synthetic oligonucleotide
ucuuggccugaacaagua

SEQ ID NO: 5899 - RNA, 18 nt, Artificial Sequence
  Description of Artificial Sequence: Synthetic oligonucleotide
ucacaucuuggccugaac

SEQ ID NO: 5900 - RNA, 18 nt, Artificial Sequence
  Description of Artificial Sequence: Synthetic oligonucleotide
uuaguucacaucuuggcc

SEQ ID NO: 5901 - RNA, 18 nt, Artificial Sequence
  Description of Artificial Sequence: Synthetic oligonucleotide
aaucuuuaguucacaucu

SEQ ID NO: 5902 - RNA, 18 nt, Artificial Sequence
  Description of Artificial Sequence: Synthetic oligonucleotide
cauacaaucuuuaguuca

SEQ ID NO: 5903 - RNA, 18 nt, Artificial Sequence
  Description of Artificial Sequence: Synthetic oligonucleotide
aaggacauacaaucuuua

SEQ ID NO: 5904 - RNA, 18 nt, Artificial Sequence
  Description of Artificial Sequence: Synthetic oligonucleotide
ucucaaaggacauacaau

SEQ ID NO: 5905 - RNA, 18 nt, Artificial Sequence
  Description of Artificial Sequence: Synthetic oligonucleotide
auaguucucaaaggacau

SEQ ID NO: 5906 - RNA, 18 nt, Artificial Sequence
  Description of Artificial Sequence: Synthetic oligonucleotide
auuuuauaguucucaaag

SEQ ID NO: 5907 - RNA, 18 nt, Artificial Sequence
  Description of Artificial Sequence: Synthetic oligonucleotide
augauauuuuauaguucu

SEQ ID NO: 5908 - RNA, 18 nt, Artificial Sequence
  Description of Artificial Sequence: Synthetic oligonucleotide
auaggaugauauuuuaua

SEQ ID NO: 5909 - RNA, 18 nt, Artificial Sequence
  Description of Artificial Sequence: Synthetic oligonucleotide
aagaaauaggaugauauu

SEQ ID NO: 5910 - RNA, 18 nt, Artificial Sequence
  Description of Artificial Sequence: Synthetic oligonucleotide
aaaaaaagaaauaggaug

SEQ ID NO: 5911 - RNA, 18 nt, Artificial Sequence
  Description of Artificial Sequence: Synthetic oligonucleotide
ugaaaaaaaaaagaaaua

SEQ ID NO: 5912 - RNA, 18 nt, Artificial Sequence
  Description of Artificial Sequence: Synthetic oligonucleotide
aaagaugaaaaaaaaaag

SEQ ID NO: 5913 - RNA, 18 nt, Artificial Sequence
  Description of Artificial Sequence: Synthetic oligonucleotide
aaaaaaaagaugaaaaaa

SEQ ID NO: 5914 - RNA, 18 nt, Artificial Sequence
  Description of Artificial Sequence: Synthetic oligonucleotide
uuaaaaaaaaaaagauga

SEQ ID NO: 5915 - RNA, 18 nt, Artificial Sequence
  Description of Artificial Sequence: Synthetic oligonucleotide
accauuuaaaaaaaaaaa

SEQ ID NO: 5916 - RNA, 18 nt, Artificial Sequence
  Description of Artificial Sequence: Synthetic oligonucleotide
cucagaccauuuaaaaaa

SEQ ID NO: 5917 - RNA, 18 nt, Artificial Sequence
  Description of Artificial Sequence: Synthetic oligonucleotide
gcaaacucagaccauuua

SEQ ID NO: 5918 - RNA, 18 nt, Artificial Sequence
  Description of Artificial Sequence: Synthetic oligonucleotide
uggaagcaaacucagacc

SEQ ID NO: 5919 - RNA, 18 nt, Artificial Sequence
  Description of Artificial Sequence: Synthetic oligonucleotide
gauguuggaagcaaacuc

SEQ ID NO: 5920 - RNA, 18 nt, Artificial Sequence
  Description of Artificial Sequence: Synthetic oligonucleotide
ccauggauguuggaagca

SEQ ID NO: 5921 - RNA, 18 nt, Artificial Sequence
  Description of Artificial Sequence: Synthetic oligonucleotide
ugcuuccauggauguugg

SEQ ID NO: 5922 - RNA, 18 nt, Artificial Sequence
  Description of Artificial Sequence: Synthetic oligonucleotide
uguaaugcuuccauggau

SEQ ID NO: 5923 - RNA, 18 nt, Artificial Sequence
  Description of Artificial Sequence: Synthetic oligonucleotide
aaauuuguaaugcuucca

SEQ ID NO: 5924 - RNA, 18 nt, Artificial Sequence
  Description of Artificial Sequence: Synthetic oligonucleotide
aaagaaaauuuguaaugc

SEQ ID NO: 5925 - RNA, 18 nt, Artificial Sequence
  Description of Artificial Sequence: Synthetic oligonucleotide
ggaggaaagaaaauuugu

SEQ ID NO: 5926 - RNA, 18 nt, Artificial Sequence
  Description of Artificial Sequence: Synthetic oligonucleotide
acuacggaggaaagaaaa

SEQ ID NO: 5927 - RNA, 18 nt, Artificial Sequence
  Description of Artificial Sequence: Synthetic oligonucleotide
auaugacuacggaggaaa

SEQ ID NO: 5928 - RNA, 18 nt, Artificial Sequence
  Description of Artificial Sequence: Synthetic oligonucleotide
uaaggauaugacuacgga

SEQ ID NO: 5929 - RNA, 18 nt, Artificial Sequence
  Description of Artificial Sequence: Synthetic oligonucleotide
caggguaaggauaugacu

SEQ ID NO: 5930 - RNA, 18 nt, Artificial Sequence
  Description of Artificial Sequence: Synthetic oligonucleotide
uacaucaggguaaggaua

SEQ ID NO: 5931 - RNA, 18 nt, Artificial Sequence
  Description of Artificial Sequence: Synthetic oligonucleotide
agcaauacaucaggguaa

SEQ ID NO: 5932 - RNA, 18 nt, Artificial Sequence
  Description of Artificial Sequence: Synthetic oligonucleotide
aacacagcaauacaucag

SEQ ID NO: 5933 - RNA, 18 nt, Artificial Sequence
  Description of Artificial Sequence: Synthetic oligonucleotide
gaugaaacacagcaauac

SEQ ID NO: 5934 - RNA, 18 nt, Artificial Sequence
  Description of Artificial Sequence: Synthetic oligonucleotide
gugaggaugaaacacagc

SEQ ID NO: 5935 - RNA, 18 nt, Artificial Sequence
  Description of Artificial Sequence: Synthetic oligonucleotide
uuggagugaggaugaaac

SEQ ID NO: 5936 - RNA, 18 nt, Artificial Sequence
  Description of Artificial Sequence: Synthetic oligonucleotide
gcauuuuggagugaggau

SEQ ID NO: 5937 - RNA, 18 nt, Artificial Sequence
  Description of Artificial Sequence: Synthetic oligonucleotide
aaaaugcauuuuggagug

SEQ ID NO: 5938 - RNA, 18 nt, Artificial Sequence
  Description of Artificial Sequence: Synthetic oligonucleotide
cauauaaaaugcauuuug

SEQ ID NO: 5939 - RNA, 18 nt, Artificial Sequence
  Description of Artificial Sequence: Synthetic oligonucleotide
uacaacauauaaaaugca

SEQ ID NO: 5940 - RNA, 18 nt, Artificial Sequence
  Description of Artificial Sequence: Synthetic oligonucleotide
auauuuacaacauauaaa

SEQ ID NO: 5941 - RNA, 18 nt, Artificial Sequence
  Description of Artificial Sequence: Synthetic oligonucleotide
gaaaaauauuuacaacau

SEQ ID NO: 5942 - RNA, 18 nt, Artificial Sequence
  Description of Artificial Sequence: Synthetic oligonucleotide
agguagaaaaauauuuac

SEQ ID NO: 5943 - RNA, 18 nt, Artificial Sequence
  Description of Artificial Sequence: Synthetic oligonucleotide
cacaaagguagaaaaaua

SEQ ID NO: 5944 - RNA, 18 nt, Artificial Sequence
  Description of Artificial Sequence: Synthetic oligonucleotide
aucaacacaaagguagaa

SEQ ID NO: 5945 - RNA, 18 nt, Artificial Sequence
  Description of Artificial Sequence: Synthetic oligonucleotide
auuaaaucaacacaaagg

SEQ ID NO: 5946 - RNA, 18 nt, Artificial Sequence
  Description of Artificial Sequence: Synthetic oligonucleotide
aaaacauuaaaucaacac

SEQ ID NO: 5947 - RNA, 18 nt, Artificial Sequence
  Description of Artificial Sequence: Synthetic oligonucleotide
aaaaauuagccgggcgug

SEQ ID NO: 5948 - RNA, 18 nt, Artificial Sequence
  Description of Artificial Sequence: Synthetic oligonucleotide
aauacaaaaauuagccgg

SEQ ID NO: 5949 - RNA, 18 nt, Artificial Sequence
  Description of Artificial Sequence: Synthetic oligonucleotide
cuaaaaauacaaaaauua

SEQ ID NO: 5950 - RNA, 18 nt, Artificial Sequence
  Description of Artificial Sequence: Synthetic oligonucleotide
cucuacuaaaaauacaaa

SEQ ID NO: 5951 - RNA, 18 nt, Artificial Sequence
  Description of Artificial Sequence: Synthetic oligonucleotide
cccaucucuacuaaaaau

SEQ ID NO: 5952 - RNA, 18 nt, Artificial Sequence
  Description of Artificial Sequence: Synthetic oligonucleotide
gaaaccccaucucuacua

SEQ ID NO: 5953 - RNA, 18 nt, Artificial Sequence
  Description of Artificial Sequence: Synthetic oligonucleotide
auggugaaaccccaucuc

SEQ ID NO: 5954 - RNA, 18 nt, Artificial Sequence
  Description of Artificial Sequence: Synthetic oligonucleotide
ccaacauggugaaacccc

SEQ ID NO: 5955 - RNA, 18 nt, Artificial Sequence
  Description of Artificial Sequence: Synthetic oligonucleotide
ccuggccaacauggugaa

SEQ ID NO: 5956 - RNA, 18 nt, Artificial Sequence
  Description of Artificial Sequence: Synthetic oligonucleotide
accagccuggccaacaug

SEQ ID NO: 5957 - RNA, 18 nt, Artificial Sequence
  Description of Artificial Sequence: Synthetic oligonucleotide
uuaagaccagccuggcca

SEQ ID NO: 5958 - RNA, 18 nt, Artificial Sequence
  Description of Artificial Sequence: Synthetic oligonucleotide
ggaguuuaagaccagccu

SEQ ID NO: 5959 - RNA, 18 nt, Artificial Sequence
  Description of Artificial Sequence: Synthetic oligonucleotide
ggucaggaguuuaagacc

SEQ ID NO: 5960 - RNA, 18 nt, Artificial Sequence
  Description of Artificial Sequence: Synthetic oligonucleotide
cacgaggucaggaguuua

SEQ ID NO: 5961 - RNA, 18 nt, Artificial Sequence
  Description of Artificial Sequence: Synthetic oligonucleotide
cagaucacgaggucagga

SEQ ID NO: 5962 - RNA, 18 nt, Artificial Sequence
  Description of Artificial Sequence: Synthetic oligonucleotide
gugggcagaucacgaggu

SEQ ID NO: 5963 - RNA, 18 nt, Artificial Sequence
  Description of Artificial Sequence: Synthetic oligonucleotide
ccaaagugggcagaucac

SEQ ID NO: 5964 - RNA, 18 nt, Artificial Sequence
  Description of Artificial Sequence: Synthetic oligonucleotide
ggaggccaaagugggcag

SEQ ID NO: 5965 - RNA, 18 nt, Artificial Sequence
  Description of Artificial Sequence: Synthetic oligonucleotide
cuuugggaggccaaagug

SEQ ID NO: 5966 - RNA, 18 nt, Artificial Sequence
  Description of Artificial Sequence: Synthetic oligonucleotide
cagcacuuugggaggcca

SEQ ID NO: 5967 - RNA, 18 nt, Artificial Sequence
  Description of Artificial Sequence: Synthetic oligonucleotide
aaucccagcacuuuggga

SEQ ID NO: 5968 - RNA, 18 nt, Artificial Sequence
  Description of Artificial Sequence: Synthetic oligonucleotide
ccuguaaucccagcacuu

SEQ ID NO: 5969 - RNA, 18 nt, Artificial Sequence
  Description of Artificial Sequence: Synthetic oligonucleotide
ucaugccuguaaucccag

SEQ ID NO: 5970 - RNA, 18 nt, Artificial Sequence
  Description of Artificial Sequence: Synthetic oligonucleotide
guggcucaugccuguaau

SEQ ID NO: 5971 - RNA, 18 nt, Artificial Sequence
  Description of Artificial Sequence: Synthetic oligonucleotide
gugcgguggcucaugccu

SEQ ID NO: 5972 - RNA, 18 nt, Artificial Sequence
  Description of Artificial Sequence: Synthetic oligonucleotide
gcugggugcgguggcuca

SEQ ID NO: 5973 - RNA, 18 nt, Artificial Sequence
  Description of Artificial Sequence: Synthetic oligonucleotide
acuuggcugggugcggug

SEQ ID NO: 5974 - RNA, 18 nt, Artificial Sequence
  Description of Artificial Sequence: Synthetic oligonucleotide
ggauuacuuggcugggug

SEQ ID NO: 5975 - RNA, 18 nt, Artificial Sequence
  Description of Artificial Sequence: Synthetic oligonucleotide
auauaggauuacuuggcu

SEQ ID NO: 5976 - RNA, 18 nt, Artificial Sequence
  Description of Artificial Sequence: Synthetic oligonucleotide
uuauaauauaggauuacu

SEQ ID NO: 5977 - RNA, 18 nt, Artificial Sequence
  Description of Artificial Sequence: Synthetic oligonucleotide
gacucuuauaauauagga

SEQ ID NO: 5978 - RNA, 18 nt, Artificial Sequence
  Description of Artificial Sequence: Synthetic oligonucleotide
ccuuagacucuuauaaua

SEQ ID NO: 5979 - RNA, 18 nt, Artificial Sequence
  Description of Artificial Sequence: Synthetic oligonucleotide
uagacccuuagacucuua

SEQ ID NO: 5980 - RNA, 18 nt, Artificial Sequence
  Description of Artificial Sequence: Synthetic oligonucleotide
uccucuagacccuuagac

SEQ ID NO: 5981 - RNA, 18 nt, Artificial Sequence
  Description of Artificial Sequence: Synthetic oligonucleotide
uuuuguccucuagacccu

SEQ ID NO: 5982 - RNA, 18 nt, Artificial Sequence
  Description of Artificial Sequence: Synthetic oligonucleotide
agacuuuuuguccucuag

SEQ ID NO: 5983 - RNA, 18 nt, Artificial Sequence
  Description of Artificial Sequence: Synthetic oligonucleotide
ccuacagacuuuuugucc

SEQ ID NO: 5984 - RNA, 18 nt, Artificial Sequence
  Description of Artificial Sequence: Synthetic oligonucleotide
aaagaccuacagacuuuu

SEQ ID NO: 5985 - RNA, 18 nt, Artificial Sequence
  Description of Artificial Sequence: Synthetic oligonucleotide
aauguaaagaccuacaga

SEQ ID NO: 5986 - RNA, 18 nt, Artificial Sequence
  Description of Artificial Sequence: Synthetic oligonucleotide
uugacaauguaaagaccu

SEQ ID NO: 5987 - RNA, 18 nt, Artificial Sequence
  Description of Artificial Sequence: Synthetic oligonucleotide
uguucuugacaauguaaa

SEQ ID NO: 5988 - RNA, 18 nt, Artificial Sequence
  Description of Artificial Sequence: Synthetic oligonucleotide
cucauuguucuugacaau

SEQ ID NO: 5989 - RNA, 18 nt, Artificial Sequence
  Description of Artificial Sequence: Synthetic oligonucleotide
acaaucucauuguucuug

SEQ ID NO: 5990 - RNA, 18 nt, Artificial Sequence
  Description of Artificial Sequence: Synthetic oligonucleotide
uacuuacaaucucauugu

SEQ ID NO: 5991 - RNA, 18 nt, Artificial Sequence
  Description of Artificial Sequence: Synthetic oligonucleotide
aaaaauacuuacaaucuc

SEQ ID NO: 5992 - RNA, 18 nt, Artificial Sequence
  Description of Artificial Sequence: Synthetic oligonucleotide
cauccaaaaauacuuaca

SEQ ID NO: 5993 - RNA, 18 nt, Artificial Sequence
  Description of Artificial Sequence: Synthetic oligonucleotide
acuaucauccaaaaauac

SEQ ID NO: 5994 - RNA, 18 nt, Artificial Sequence
  Description of Artificial Sequence: Synthetic oligonucleotide
uauuuacuaucauccaaa

SEQ ID NO: 5995 - RNA, 18 nt, Artificial Sequence
  Description of Artificial Sequence: Synthetic oligonucleotide
agagguauuuacuaucau

SEQ ID NO: 5996 - RNA, 18 nt, Artificial Sequence
  Description of Artificial Sequence: Synthetic oligonucleotide
cagggagagguauuuacu

SEQ ID NO: 5997 - RNA, 18 nt, Artificial Sequence
  Description of Artificial Sequence: Synthetic oligonucleotide
agagucagggagagguau

SEQ ID NO: 5998 - RNA, 18 nt, Artificial Sequence
  Description of Artificial Sequence: Synthetic oligonucleotide
cucuaagagucagggaga

SEQ ID NO: 5999 - RNA, 18 nt, Artificial Sequence
  Description of Artificial Sequence: Synthetic oligonucleotide
guuuacucuaagagucag

SEQ ID NO: 6000 - RNA, 18 nt, Artificial Sequence
  Description of Artificial Sequence: Synthetic oligonucleotide
ccaaaguuuacucuaaga

SEQ ID NO: 6001 - RNA, 18 nt, Artificial Sequence
  Description of Artificial Sequence: Synthetic oligonucleotide
acuaaccaaaguuuacuc

SEQ ID NO: 6002 - RNA, 18 nt, Artificial Sequence
  Description of Artificial Sequence: Synthetic oligonucleotide
acauuacuaaccaaaguu

SEQ ID NO: 6003 - RNA, 18 nt, Artificial Sequence
  Description of Artificial Sequence: Synthetic oligonucleotide
ccauuacauuacuaacca

SEQ ID NO: 6004 - RNA, 18 nt, Artificial Sequence
  Description of Artificial Sequence: Synthetic oligonucleotide
auuaaccauuacauuacu

SEQ ID NO: 6005 - RNA, 18 nt, Artificial Sequence
  Description of Artificial Sequence: Synthetic oligonucleotide
uuuacauuaaccauuaca

SEQ ID NO: 6006 - RNA, 18 nt, Artificial Sequence
  Description of Artificial Sequence: Synthetic oligonucleotide
agcacuuuacauuaacca

SEQ ID NO: 6007 - RNA, 18 nt, Artificial Sequence
  Description of Artificial Sequence: Synthetic oligonucleotide
agucuagcacuuuacauu

SEQ ID NO: 6008 - RNA, 18 nt, Artificial Sequence
  Description of Artificial Sequence: Synthetic oligonucleotide
uucaaagucuagcacuuu

SEQ ID NO: 6009 - RNA, 18 nt, Artificial Sequence
  Description of Artificial Sequence: Synthetic oligonucleotide
auuucuucaaagucuagc

SEQ ID NO: 6010 - RNA, 18 nt, Artificial Sequence
  Description of Artificial Sequence: Synthetic oligonucleotide
cuuacauuucuucaaagu

SEQ ID NO: 6011 - RNA, 18 nt, Artificial Sequence
  Description of Artificial Sequence: Synthetic oligonucleotide
acacucuuacauuucuuc

SEQ ID NO: 6012 - RNA, 18 nt, Artificial Sequence
  Description of Artificial Sequence: Synthetic oligonucleotide
uuuccacacucuuacauu

SEQ ID NO: 6013 - RNA, 18 nt, Artificial Sequence
  Description of Artificial Sequence: Synthetic oligonucleotide
aaauauuuccacacucuu

SEQ ID NO: 6014 - RNA, 18 nt, Artificial Sequence
  Description of Artificial Sequence: Synthetic oligonucleotide
ucuagaaauauuuccaca

SEQ ID NO: 6015 - RNA, 18 nt, Artificial Sequence
  Description of Artificial Sequence: Synthetic oligonucleotide
augagucuagaaauauuu

SEQ ID NO: 6016 - RNA, 18 nt, Artificial Sequence
  Description of Artificial Sequence: Synthetic oligonucleotide
aguugaugagucuagaaa

SEQ ID NO: 6017 - RNA, 18 nt, Artificial Sequence
  Description of Artificial Sequence: Synthetic oligonucleotide
gguagaguugaugagucu

SEQ ID NO: 6018 - RNA, 18 nt, Artificial Sequence
  Description of Artificial Sequence: Synthetic oligonucleotide
uaaaagguagaguugaug

SEQ ID NO: 6019 - RNA, 18 nt, Artificial Sequence
  Description of Artificial Sequence: Synthetic oligonucleotide
augcuuaaaagguagagu

SEQ ID NO: 6020 - RNA, 18 nt, Artificial Sequence
  Description of Artificial Sequence: Synthetic oligonucleotide
gaugaaugcuuaaaaggu

SEQ ID NO: 6021 - RNA, 18 nt, Artificial Sequence
  Description of Artificial Sequence: Synthetic oligonucleotide
aaauagaugaaugcuuaa

SEQ ID NO: 6022 - RNA, 18 nt, Artificial Sequence
  Description of Artificial Sequence: Synthetic oligonucleotide
uaaacaaauagaugaaug

SEQ ID NO: 6023 - RNA, 18 nt, Artificial Sequence
  Description of Artificial Sequence: Synthetic oligonucleotide
uggaguaaacaaauagau

SEQ ID NO: 6024 - RNA, 18 nt, Artificial Sequence
  Description of Artificial Sequence: Synthetic oligonucleotide
gccucuggaguaaacaaa

SEQ ID NO: 6025 - RNA, 18 nt, Artificial Sequence
  Description of Artificial Sequence: Synthetic oligonucleotide
caaaggccucuggaguaa

SEQ ID NO: 6026 - RNA, 18 nt, Artificial Sequence
  Description of Artificial Sequence: Synthetic oligonucleotide
auaaacaaaggccucugg

SEQ ID NO: 6027 - RNA, 18 nt, Artificial Sequence
  Description of Artificial Sequence: Synthetic oligonucleotide
ucucuauaaacaaaggcc

SEQ ID NO: 6028 - RNA, 18 nt, Artificial Sequence
  Description of Artificial Sequence: Synthetic oligonucleotide
uuuccucucuauaaacaa

SEQ ID NO: 6029 - RNA, 18 nt, Artificial Sequence
  Description of Artificial Sequence: Synthetic oligonucleotide
aaugguuuccucucuaua

SEQ ID NO: 6030 - RNA, 18 nt, Artificial Sequence
  Description of Artificial Sequence: Synthetic oligonucleotide
uccaaaaugguuuccucu

SEQ ID NO: 6031 - RNA, 18 nt, Artificial Sequence
  Description of Artificial Sequence: Synthetic oligonucleotide
augaauccaaaaugguuu

SEQ ID NO: 6032 - RNA, 18 nt, Artificial Sequence
  Description of Artificial Sequence: Synthetic oligonucleotide
aaaagaugaauccaaaau

SEQ ID NO: 6033 - RNA, 18 nt, Artificial Sequence
  Description of Artificial Sequence: Synthetic oligonucleotide
aaguaaaaagaugaaucc

SEQ ID NO: 6034 - RNA, 18 nt, Artificial Sequence
  Description of Artificial Sequence: Synthetic oligonucleotide
guggcaaguaaaaagaug

SEQ ID NO: 6035 - RNA, 18 nt, Artificial Sequence
  Description of Artificial Sequence: Synthetic oligonucleotide
auggaguggcaaguaaaa

SEQ ID NO: 6036 - RNA, 18 nt, Artificial Sequence
  Description of Artificial Sequence: Synthetic oligonucleotide
ccugaauggaguggcaag

SEQ ID NO: 6037 - RNA, 18 nt, Artificial Sequence
  Description of Artificial Sequence: Synthetic oligonucleotide
agcugccugaauggagug

SEQ ID NO: 6038 - RNA, 18 nt, Artificial Sequence
  Description of Artificial Sequence: Synthetic oligonucleotide
ucagcagcugccugaaug

SEQ ID NO: 6039 - RNA, 18 nt, Artificial Sequence
  Description of Artificial Sequence: Synthetic oligonucleotide
uagcaucagcagcugccu

SEQ ID NO: 6040 - RNA, 18 nt, Artificial Sequence
  Description of Artificial Sequence: Synthetic oligonucleotide
cauuuuagcaucagcagc

SEQ ID NO: 6041 - RNA, 18 nt, Artificial Sequence
  Description of Artificial Sequence: Synthetic oligonucleotide
ucuuccauuuuagcauca

SEQ ID NO: 6042 - RNA, 18 nt, Artificial Sequence
  Description of Artificial Sequence: Synthetic oligonucleotide
uuaugucuuccauuuuag

SEQ ID NO: 6043 - RNA, 18 nt, Artificial Sequence
  Description of Artificial Sequence: Synthetic oligonucleotide
uuuaguuaugucuuccau

SEQ ID NO: 6044 - RNA, 18 nt, Artificial Sequence
  Description of Artificial Sequence: Synthetic oligonucleotide
guugcucaaauuucgaac

SEQ ID NO: 6045 - RNA, 18 nt, Artificial Sequence
  Description of Artificial Sequence: Synthetic oligonucleotide
gcuggguugcucaaauuu

SEQ ID NO: 6046 - RNA, 18 nt, Artificial Sequence
  Description of Artificial Sequence: Synthetic oligonucleotide
ucuuggcuggguugcuca

SEQ ID NO: 6047 - RNA, 18 nt, Artificial Sequence
  Description of Artificial Sequence: Synthetic oligonucleotide
gaacuucuuggcuggguu

SEQ ID NO: 6048 - RNA, 18 nt, Artificial Sequence
  Description of Artificial Sequence: Synthetic oligonucleotide
aucuugaacuucuuggcu

SEQ ID NO: 6049 - RNA, 18 nt, Artificial Sequence
  Description of Artificial Sequence: Synthetic oligonucleotide
cuucaaucuugaacuucu

SEQ ID NO: 6050 - RNA, 18 nt, Artificial Sequence
  Description of Artificial Sequence: Synthetic oligonucleotide
auuggcuucaaucuugaa

SEQ ID NO: 6051 - RNA, 18 nt, Artificial Sequence
  Description of Artificial Sequence: Synthetic oligonucleotide
ccagcauuggcuucaauc

SEQ ID NO: 6052 - RNA, 18 nt, Artificial Sequence
  Description of Artificial Sequence: Synthetic oligonucleotide
guugcccagcauuggcuu

SEQ ID NO: 6053 - RNA, 18 nt, Artificial Sequence
  Description of Artificial Sequence: Synthetic oligonucleotide
guacaguugcccagcauu

SEQ ID NO: 6054 - RNA, 18 nt, Artificial Sequence
  Description of Artificial Sequence: Synthetic oligonucleotide
gucagguacaguugccca

SEQ ID NO: 6055 - RNA, 18 nt, Artificial Sequence
  Description of Artificial Sequence: Synthetic oligonucleotide
ccccugucagguacaguu

SEQ ID NO: 6056 - RNA, 18 nt, Artificial Sequence
  Description of Artificial Sequence: Synthetic oligonucleotide
caccaccccugucaggua

SEQ ID NO: 6057 - RNA, 18 nt, Artificial Sequence
  Description of Artificial Sequence: Synthetic oligonucleotide
aguaccaccaccccuguc

SEQ ID NO: 6058 - RNA, 18 nt, Artificial Sequence
  Description of Artificial Sequence: Synthetic oligonucleotide
ugugcaguaccaccaccc

SEQ ID NO: 6059 - RNA, 18 nt, Artificial Sequence
  Description of Artificial Sequence: Synthetic oligonucleotide
auccuugugcaguaccac

SEQ ID NO: 6060 - RNA, 18 nt, Artificial Sequence
  Description of Artificial Sequence: Synthetic oligonucleotide
uugacauccuugugcagu

SEQ ID NO: 6061 - RNA, 18 nt, Artificial Sequence
  Description of Artificial Sequence: Synthetic oligonucleotide
ccacguugacauccuugu

SEQ ID NO: 6062 - RNA, 18 nt, Artificial Sequence
  Description of Artificial Sequence: Synthetic oligonucleotide
uacuaccacguugacauc

SEQ ID NO: 6063 - RNA, 18 nt, Artificial Sequence
  Description of Artificial Sequence: Synthetic oligonucleotide
uccacuacuaccacguug

SEQ ID NO: 6064 - RNA, 18 nt, Artificial Sequence
  Description of Artificial Sequence: Synthetic oligonucleotide
ccccuuccacuacuacca

SEQ ID NO: 6065 - RNA, 18 nt, Artificial Sequence
  Description of Artificial Sequence: Synthetic oligonucleotide
ggguugcucaaauuucga

SEQ ID NO: 6066 - RNA, 18 nt, Artificial Sequence
  Description of Artificial Sequence: Synthetic oligonucleotide
uggcuggguugcucaaau

SEQ ID NO: 6067 - RNA, 18 nt, Artificial Sequence
  Description of Artificial Sequence: Synthetic oligonucleotide
cuucuuggcuggguugcu

SEQ ID NO: 6068 - RNA, 18 nt, Artificial Sequence
  Description of Artificial Sequence: Synthetic oligonucleotide
uugaacuucuuggcuggg

SEQ ID NO: 6069 - RNA, 18 nt, Artificial Sequence
  Description of Artificial Sequence: Synthetic oligonucleotide
caaucuugaacuucuugg

SEQ ID NO: 6070 - RNA, 18 nt, Artificial Sequence
  Description of Artificial Sequence: Synthetic oligonucleotide
ggcuucaaucuugaacuu

SEQ ID NO: 6071 - RNA, 18 nt, Artificial Sequence
  Description of Artificial Sequence: Synthetic oligonucleotide
gcauuggcuucaaucuug

SEQ ID NO: 6072 - RNA, 18 nt, Artificial Sequence
  Description of Artificial Sequence: Synthetic oligonucleotide
gcccagcauuggcuucaa

SEQ ID NO: 6073 - RNA, 18 nt, Artificial Sequence
  Description of Artificial Sequence: Synthetic oligonucleotide
caguugcccagcauuggc

SEQ ID NO: 6074 - RNA, 18 nt, Artificial Sequence
  Description of Artificial Sequence: Synthetic oligonucleotide
agguacaguugcccagca

SEQ ID NO: 6075 - RNA, 18 nt, Artificial Sequence
  Description of Artificial Sequence: Synthetic oligonucleotide
cugucagguacaguugcc

SEQ ID NO: 6076 - RNA, 18 nt, Artificial Sequence
  Description of Artificial Sequence: Synthetic oligonucleotide
caccccugucagguacag

SEQ ID NO: 6077 - RNA, 18 nt, Artificial Sequence
  Description of Artificial Sequence: Synthetic oligonucleotide
accaccaccccugucagg

SEQ ID NO: 6078 - RNA, 18 nt, Artificial Sequence
  Description of Artificial Sequence: Synthetic oligonucleotide
gcaguaccaccaccccug

SEQ ID NO: 6079 - RNA, 18 nt, Artificial Sequence
  Description of Artificial Sequence: Synthetic oligonucleotide
cuugugcaguaccaccac

SEQ ID NO: 6080 - RNA, 18 nt, Artificial Sequence
  Description of Artificial Sequence: Synthetic oligonucleotide
acauccuugugcaguacc

SEQ ID NO: 6081 - RNA, 18 nt, Artificial Sequence
  Description of Artificial Sequence: Synthetic oligonucleotide
cguugacauccuugugca

SEQ ID NO: 6082 - RNA, 18 nt, Artificial Sequence
  Description of Artificial Sequence: Synthetic oligonucleotide
uaccacguugacauccuu

SEQ ID NO: 6083 - RNA, 18 nt, Artificial Sequence
  Description of Artificial Sequence: Synthetic oligonucleotide
acuacuaccacguugaca

SEQ ID NO: 6084 - RNA, 18 nt, Artificial Sequence
  Description of Artificial Sequence: Synthetic oligonucleotide
cuuccacuacuaccacgu

SEQ ID NO: 6085 - RNA, 18 nt, Artificial Sequence
  Description of Artificial Sequence: Synthetic oligonucleotide
ucccucaaguuuuucaga

SEQ ID NO: 6086 - RNA, 18 nt, Artificial Sequence
  Description of Artificial Sequence: Synthetic oligonucleotide
cagucucccucaaguuuu

SEQ ID NO: 6087 - RNA, 18 nt, Artificial Sequence
  Description of Artificial Sequence: Synthetic oligonucleotide
gggacagucucccucaag

SEQ ID NO: 6088 - RNA, 18 nt, Artificial Sequence
  Description of Artificial Sequence: Synthetic oligonucleotide
agccuaggguugucuggg

SEQ ID NO: 6089 - RNA, 18 nt, Artificial Sequence
  Description of Artificial Sequence: Synthetic oligonucleotide
cucuaagccuaggguugu

SEQ ID NO: 6090 - RNA, 18 nt, Artificial Sequence
  Description of Artificial Sequence: Synthetic oligonucleotide
aaucacucuaagccuagg

SEQ ID NO: 6091 - RNA, 18 nt, Artificial Sequence
  Description of Artificial Sequence: Synthetic oligonucleotide
augcuaaucacucuaagc

SEQ ID NO: 6092 - RNA, 18 nt, Artificial Sequence
  Description of Artificial Sequence: Synthetic oligonucleotide
ccacaaugcuaaucacuc

SEQ ID NO: 6093 - RNA, 18 nt, Artificial Sequence
  Description of Artificial Sequence: Synthetic oligonucleotide
ucuccccacaaugcuaau

SEQ ID NO: 6094 - RNA, 18 nt, Artificial Sequence
  Description of Artificial Sequence: Synthetic oligonucleotide
uccuuucuccccacaaug

SEQ ID NO: 6095 - RNA, 18 nt, Artificial Sequence
  Description of Artificial Sequence: Synthetic oligonucleotide
uuuucuccuuucucccca

SEQ ID NO: 6096 - RNA, 18 nt, Artificial Sequence
  Description of Artificial Sequence: Synthetic oligonucleotide
gaucuuuuucuccuuucu

SEQ ID NO: 6097 - RNA, 18 nt, Artificial Sequence
  Description of Artificial Sequence: Synthetic oligonucleotide
aauacgaucuuuuucucc

SEQ ID NO: 6098 - RNA, 18 nt, Artificial Sequence
  Description of Artificial Sequence: Synthetic oligonucleotide
acuaaaauacgaucuuuu

SEQ ID NO: 6099 - RNA, 18 nt, Artificial Sequence
  Description of Artificial Sequence: Synthetic oligonucleotide
auggcacuaaaauacgau

SEQ ID NO: 6100 - RNA, 18 nt, Artificial Sequence
  Description of Artificial Sequence: Synthetic oligonucleotide
cagguauggcacuaaaau

SEQ ID NO: 6101 - RNA, 18 nt, Artificial Sequence
  Description of Artificial Sequence: Synthetic oligonucleotide
uauaucagguauggcacu

SEQ ID NO: 6102 - RNA, 18 nt, Artificial Sequence
  Description of Artificial Sequence: Synthetic oligonucleotide
cauauuauaucagguaug

SEQ ID NO: 6103 - RNA, 18 nt, Artificial Sequence
  Description of Artificial Sequence: Synthetic oligonucleotide
ccuagcauauuauaucag

SEQ ID NO: 6104 - RNA, 18 nt, Artificial Sequence
  Description of Artificial Sequence: Synthetic oligonucleotide
agagaccuagcauauuau

SEQ ID NO: 6105 - RNA, 18 nt, Artificial Sequence
  Description of Artificial Sequence: Synthetic oligonucleotide
gaagcagagaccuagcau

SEQ ID NO: 6106 - RNA, 18 nt, Artificial Sequence
  Description of Artificial Sequence: Synthetic oligonucleotide
acacagaagcagagaccu

SEQ ID NO: 6107 - RNA, 18 nt, Artificial Sequence
  Description of Artificial Sequence: Synthetic oligonucleotide
aaaaaacacagaagcaga

SEQ ID NO: 6108 - RNA, 18 nt, Artificial Sequence
  Description of Artificial Sequence: Synthetic oligonucleotide
acuccaaaaaacacagaa

SEQ ID NO: 6109 - RNA, 18 nt, Artificial Sequence
  Description of Artificial Sequence: Synthetic oligonucleotide
cuucuacuccaaaaaaca

SEQ ID NO: 6110 - RNA, 18 nt, Artificial Sequence
  Description of Artificial Sequence: Synthetic oligonucleotide
agggccuucuacuccaaa

SEQ ID NO: 6111 - RNA, 18 nt, Artificial Sequence
  Description of Artificial Sequence: Synthetic oligonucleotide
aucuuagggccuucuacu

SEQ ID NO: 6112 - RNA, 18 nt, Artificial Sequence
  Description of Artificial Sequence: Synthetic oligonucleotide
agaccuagcauauuauau

SEQ ID NO: 6113 - RNA, 18 nt, Artificial Sequence
  Description of Artificial Sequence: Synthetic oligonucleotide
agcagagaccuagcauau

SEQ ID NO: 6114 - RNA, 18 nt, Artificial Sequence
  Description of Artificial Sequence: Synthetic oligonucleotide
acagaagcagagaccuag

SEQ ID NO: 6115 - RNA, 18 nt, Artificial Sequence
  Description of Artificial Sequence: Synthetic oligonucleotide
aaaacacagaagcagaga

SEQ ID NO: 6116 - RNA, 18 nt, Artificial Sequence
  Description of Artificial Sequence: Synthetic oligonucleotide
uccaaaaaacacagaagc

SEQ ID NO: 6117 - RNA, 18 nt, Artificial Sequence
  Description of Artificial Sequence: Synthetic oligonucleotide
ucuacuccaaaaaacaca

SEQ ID NO: 6118 - RNA, 18 nt, Artificial Sequence
  Description of Artificial Sequence: Synthetic oligonucleotide
ggccuucuacuccaaaaa

SEQ ID NO: 6119 - RNA, 18 nt, Artificial Sequence
  Description of Artificial Sequence: Synthetic oligonucleotide
cuuagggccuucuacucc

SEQ ID NO: 6120 - RNA, 18 nt, Artificial Sequence
  Description of Artificial Sequence: Synthetic oligonucleotide
cacaucuuagggccuucu

SEQ ID NO: 6121 - RNA, 18 nt, Artificial Sequence
  Description of Artificial Sequence: Synthetic oligonucleotide
ggaaccacaucuuagggc

SEQ ID NO: 6122 - RNA, 18 nt, Artificial Sequence
  Description of Artificial Sequence: Synthetic oligonucleotide
ucucaggaaccacaucuu

SEQ ID NO: 6123 - RNA, 18 nt, Artificial Sequence
  Description of Artificial Sequence: Synthetic oligonucleotide
agcaaucucaggaaccac

SEQ ID NO: 6124 - RNA, 18 nt, Artificial Sequence
  Description of Artificial Sequence: Synthetic oligonucleotide
guugaagcaaucucagga

SEQ ID NO: 6125 - RNA, 18 nt, Artificial Sequence
  Description of Artificial Sequence: Synthetic oligonucleotide
ugguaguugaagcaaucu

SEQ ID NO: 6126 - RNA, 18 nt, Artificial Sequence
  Description of Artificial Sequence: Synthetic oligonucleotide
uaaugugguaguugaagc

SEQ ID NO: 6127 - RNA, 18 nt, Artificial Sequence
  Description of Artificial Sequence: Synthetic oligonucleotide
gacauuaaugugguaguu

SEQ ID NO: 6128 - RNA, 18 nt, Artificial Sequence
  Description of Artificial Sequence: Synthetic oligonucleotide
gcucagacauuaaugugg

SEQ ID NO: 6129 - RNA, 18 nt, Artificial Sequence
  Description of Artificial Sequence: Synthetic oligonucleotide
ucugagcucagacauuaa

SEQ ID NO: 6130 - RNA, 18 nt, Artificial Sequence
  Description of Artificial Sequence: Synthetic oligonucleotide
gaaccucugagcucagac

SEQ ID NO: 6131 - RNA, 18 nt, Artificial Sequence
  Description of Artificial Sequence: Synthetic oligonucleotide
agaaagaaccucugagcu

SEQ ID NO: 6132 - RNA, 18 nt, Artificial Sequence
  Description of Artificial Sequence: Synthetic oligonucleotide
acuguggaagaugauggg

SEQ ID NO: 6133 - RNA, 18 nt, Artificial Sequence
  Description of Artificial Sequence: Synthetic oligonucleotide
ccagaacuguggaagaug

SEQ ID NO: 6134 - RNA, 18 nt, Artificial Sequence
  Description of Artificial Sequence: Synthetic oligonucleotide
uuuugccagaacugugga

SEQ ID NO: 6135 - RNA, 18 nt, Artificial Sequence
  Description of Artificial Sequence: Synthetic oligonucleotide
aauaauuuugccagaacu

SEQ ID NO: 6136 - RNA, 18 nt, Artificial Sequence
  Description of Artificial Sequence: Synthetic oligonucleotide
uaaauuucuucugggccu

SEQ ID NO: 6137 - RNA, 18 nt, Artificial Sequence
  Description of Artificial Sequence: Synthetic oligonucleotide
acgcuuaaauuucuucug

SEQ ID NO: 6138 - RNA, 18 nt, Artificial Sequence
  Description of Artificial Sequence: Synthetic oligonucleotide
auaagacgcuuaaauuuc

SEQ ID NO: 6139 - RNA, 18 nt, Artificial Sequence
  Description of Artificial Sequence: Synthetic oligonucleotide
gcagcauaagacgcuuaa

SEQ ID NO: 6140 - RNA, 18 nt, Artificial Sequence
  Description of Artificial Sequence: Synthetic oligonucleotide
ccgaugcagcauaagacg

SEQ ID NO: 6141 - RNA, 18 nt, Artificial Sequence
  Description of Artificial Sequence: Synthetic oligonucleotide
uuuauccgaugcagcaua

SEQ ID NO: 6142 - RNA, 18 nt, Artificial Sequence
  Description of Artificial Sequence: Synthetic oligonucleotide
cccacuuuauccgaugca

SEQ ID NO: 6143 - RNA, 18 nt, Artificial Sequence
  Description of Artificial Sequence: Synthetic oligonucleotide
uucaucccacuuuauccg

SEQ ID NO: 6144 - RNA, 18 nt, Artificial Sequence
  Description of Artificial Sequence: Synthetic oligonucleotide
gucuguucaucccacuuu

SEQ ID NO: 6145 - RNA, 18 nt, Artificial Sequence
  Description of Artificial Sequence: Synthetic oligonucleotide
uagaugucuguucauccc

SEQ ID NO: 6146 - RNA, 18 nt, Artificial Sequence
  Description of Artificial Sequence: Synthetic oligonucleotide
uguguuagaugucuguuc

SEQ ID NO: 6147 - RNA, 18 nt, Artificial Sequence
  Description of Artificial Sequence: Synthetic oligonucleotide
cccuuuguguuagauguc

SEQ ID NO: 6148 - RNA, 18 nt, Artificial Sequence
  Description of Artificial Sequence: Synthetic oligonucleotide
caucucccuuuguguuag

SEQ ID NO: 6149 - RNA, 18 nt, Artificial Sequence
  Description of Artificial Sequence: Synthetic oligonucleotide
aaguuccuggucaaacac

SEQ ID NO: 6150 - RNA, 18 nt, Artificial Sequence
  Description of Artificial Sequence: Synthetic oligonucleotide
gcaucaaguuccugguca

SEQ ID NO: 6151 - RNA, 18 nt, Artificial Sequence
  Description of Artificial Sequence: Synthetic oligonucleotide
ccagugcaucaaguuccu

SEQ ID NO: 6152 - RNA, 18 nt, Artificial Sequence
  Description of Artificial Sequence: Synthetic oligonucleotide
aauuuccagugcaucaag

SEQ ID NO: 6153 - RNA, 18 nt, Artificial Sequence
  Description of Artificial Sequence: Synthetic oligonucleotide
gucucaauuuccagugca

SEQ ID NO: 6154 - RNA, 18 nt, Artificial Sequence
  Description of Artificial Sequence: Synthetic oligonucleotide
guacugucucaauuucca

SEQ ID NO: 6155 - RNA, 18 nt, Artificial Sequence
  Description of Artificial Sequence: Synthetic oligonucleotide
cuuuuguacugucucaau

SEQ ID NO: 6156 - RNA, 18 nt, Artificial Sequence
  Description of Artificial Sequence: Synthetic oligonucleotide
gucuccuuuuguacuguc

SEQ ID NO: 6157 - RNA, 18 nt, Artificial Sequence
  Description of Artificial Sequence: Synthetic oligonucleotide
ggauugucuccuuuugua

SEQ ID NO: 6158 - RNA, 18 nt, Artificial Sequence
  Description of Artificial Sequence: Synthetic oligonucleotide
gggauggauugucuccuu

SEQ ID NO: 6159 - RNA, 18 nt, Artificial Sequence
  Description of Artificial Sequence: Synthetic oligonucleotide
ucuuauaugacuuucggg

SEQ ID NO: 6160 - RNA, 18 nt, Artificial Sequence
  Description of Artificial Sequence: Synthetic oligonucleotide
uucaucuuauaugacuuu

SEQ ID NO: 6161 - RNA, 18 nt, Artificial Sequence
  Description of Artificial Sequence: Synthetic oligonucleotide
aagaguucaucuuauaug

SEQ ID NO: 6162 - RNA, 18 nt, Artificial Sequence
  Description of Artificial Sequence: Synthetic oligonucleotide
acaggaagaguucaucuu

SEQ ID NO: 6163 - RNA, 18 nt, Artificial Sequence
  Description of Artificial Sequence: Synthetic oligonucleotide
ucugcacaggaagaguuc

SEQ ID NO: 6164 - RNA, 18 nt, Artificial Sequence
  Description of Artificial Sequence: Synthetic oligonucleotide
ggauaucugcacaggaag

SEQ ID NO: 6165 - RNA, 18 nt, Artificial Sequence
  Description of Artificial Sequence: Synthetic oligonucleotide
gagcaggauaucugcaca

SEQ ID NO: 6166 - RNA, 18 nt, Artificial Sequence
  Description of Artificial Sequence: Synthetic oligonucleotide
gcaaagagcaggauaucu

SEQ ID NO: 6167 - RNA, 18 nt, Artificial Sequence
  Description of Artificial Sequence: Synthetic oligonucleotide
aggaggcaaagagcagga

SEQ ID NO: 6168 - RNA, 18 nt, Artificial Sequence
  Description of Artificial Sequence: Synthetic oligonucleotide
cuuauaggaggcaaagag

SEQ ID NO: 6169 - RNA, 18 nt, Artificial Sequence
  Description of Artificial Sequence: Synthetic oligonucleotide
uuccacuuauaggaggca

SEQ ID NO: 6170 - RNA, 18 nt, Artificial Sequence
  Description of Artificial Sequence: Synthetic oligonucleotide
agacauuccacuuauagg

SEQ ID NO: 6171 - RNA, 18 nt, Artificial Sequence
  Description of Artificial Sequence: Synthetic oligonucleotide
ccgggagacauuccacuu

SEQ ID NO: 6172 - RNA, 18 nt, Artificial Sequence
  Description of Artificial Sequence: Synthetic oligonucleotide
gagggccgggagacauuc

SEQ ID NO: 6173 - RNA, 18 nt, Artificial Sequence
  Description of Artificial Sequence: Synthetic oligonucleotide
gcaaugagggccgggaga

SEQ ID NO: 6174 - RNA, 18 nt, Artificial Sequence
  Description of Artificial Sequence: Synthetic oligonucleotide
agccagcaaugagggccg

SEQ ID NO: 6175 - RNA, 18 nt, Artificial Sequence
  Description of Artificial Sequence: Synthetic oligonucleotide
gagucagccagcaaugag

SEQ ID NO: 6176 - RNA, 18 nt, Artificial Sequence
  Description of Artificial Sequence: Synthetic oligonucleotide
gggcuggguccugaggca

SEQ ID NO: 6177 - RNA, 18 nt, Artificial Sequence
  Description of Artificial Sequence: Synthetic oligonucleotide
gccuagggcuggguccug

SEQ ID NO: 6178 - RNA, 18 nt, Artificial Sequence
  Description of Artificial Sequence: Synthetic oligonucleotide
uggcugccuagggcuggg

SEQ ID NO: 6179 - RNA, 18 nt, Artificial Sequence
  Description of Artificial Sequence: Synthetic oligonucleotide
uguccuggcugccuaggg

SEQ ID NO: 6180 - RNA, 18 nt, Artificial Sequence
  Description of Artificial Sequence: Synthetic oligonucleotide
gaaaguguccuggcugcc

SEQ ID NO: 6181 - RNA, 18 nt, Artificial Sequence
  Description of Artificial Sequence: Synthetic oligonucleotide
aaaacgaaaguguccugg

SEQ ID NO: 6182 - RNA, 18 nt, Artificial Sequence
  Description of Artificial Sequence: Synthetic oligonucleotide
acaggaaaacgaaagugu

SEQ ID NO: 6183 - RNA, 18 nt, Artificial Sequence
  Description of Artificial Sequence: Synthetic oligonucleotide
gaagaacaggaaaacgaa

SEQ ID NO: 6184 - RNA, 18 nt, Artificial Sequence
  Description of Artificial Sequence: Synthetic oligonucleotide
ggcuagaagaacaggaaa

SEQ ID NO: 6185 - RNA, 18 nt, Artificial Sequence
  Description of Artificial Sequence: Synthetic oligonucleotide
ugcagggcuagaagaaca

SEQ ID NO: 6186 - RNA, 18 nt, Artificial Sequence
  Description of Artificial Sequence: Synthetic oligonucleotide
aaaguugcagggcuagaa

SEQ ID NO: 6187 - RNA, 18 nt, Artificial Sequence
  Description of Artificial Sequence: Synthetic oligonucleotide
uuccuaaaguugcagggc

SEQ ID NO: 6188 - RNA, 18 nt, Artificial Sequence
  Description of Artificial Sequence: Synthetic oligonucleotide
gacaauuccuaaaguugc

SEQ ID NO: 6189 - RNA, 18 nt, Artificial Sequence
  Description of Artificial Sequence: Synthetic oligonucleotide
gacaggacaauuccuaaa

SEQ ID NO: 6190 - RNA, 18 nt, Artificial Sequence
  Description of Artificial Sequence: Synthetic oligonucleotide
aggcagacaggacaauuc

SEQ ID NO: 6191 - RNA, 18 nt, Artificial Sequence
  Description of Artificial Sequence: Synthetic oligonucleotide
aacaaaggcagacaggac

SEQ ID NO: 6192 - RNA, 18 nt, Artificial Sequence
  Description of Artificial Sequence: Synthetic oligonucleotide
uuugaaacaaaggcagac

SEQ ID NO: 6193 - RNA, 18 nt, Artificial Sequence
  Description of Artificial Sequence: Synthetic oligonucleotide
ccaaguuugaaacaaagg

SEQ ID NO: 6194 - RNA, 18 nt, Artificial Sequence
  Description of Artificial Sequence: Synthetic oligonucleotide
uggcuccaaguuugaaac

SEQ ID NO: 6195 - RNA, 18 nt, Artificial Sequence
  Description of Artificial Sequence: Synthetic oligonucleotide
agcacuggcuccaaguuu

SEQ ID NO: 6196 - RNA, 18 nt, Artificial Sequence
  Description of Artificial Sequence: Synthetic oligonucleotide
agcguagcacuggcucca

SEQ ID NO: 6197 - RNA, 18 nt, Artificial Sequence
  Description of Artificial Sequence: Synthetic oligonucleotide
cuccaagcguagcacugg

SEQ ID NO: 6198 - RNA, 18 nt, Artificial Sequence
  Description of Artificial Sequence: Synthetic oligonucleotide
acaggcuccaagcguagc

SEQ ID NO: 6199 - RNA, 18 nt, Artificial Sequence
  Description of Artificial Sequence: Synthetic oligonucleotide
uguugacaggcuccaagc

SEQ ID NO: 6200 - RNA, 18 nt, Artificial Sequence
  Description of Artificial Sequence: Synthetic oligonucleotide
aaggguguugacaggcuc

SEQ ID NO: 6201 - RNA, 18 nt, Artificial Sequence
  Description of Artificial Sequence: Synthetic oligonucleotide
ugacuaaggguguugaca

SEQ ID NO: 6202 - RNA, 18 nt, Artificial Sequence
  Description of Artificial Sequence: Synthetic oligonucleotide
agaucugacuaagggugu

SEQ ID NO: 6203 - RNA, 18 nt, Artificial Sequence
  Description of Artificial Sequence: Synthetic oligonucleotide
ucagcagaucugacuaag

SEQ ID NO: 6204 - RNA, 18 nt, Artificial Sequence
  Description of Artificial Sequence: Synthetic oligonucleotide
gagaaucagcagaucuga

SEQ ID NO: 6205 - RNA, 18 nt, Artificial Sequence
  Description of Artificial Sequence: Synthetic oligonucleotide
ccccagagaaucagcaga

SEQ ID NO: 6206 - RNA, 18 nt, Artificial Sequence
  Description of Artificial Sequence: Synthetic oligonucleotide
caggaccccagagaauca

SEQ ID NO: 6207 - RNA, 18 nt, Artificial Sequence
  Description of Artificial Sequence: Synthetic oligonucleotide
guugacaggcuccaagcg

SEQ ID NO: 6208 - RNA, 18 nt, Artificial Sequence
  Description of Artificial Sequence: Synthetic oligonucleotide
aggguguugacaggcucc

SEQ ID NO: 6209 - RNA, 18 nt, Artificial Sequence
  Description of Artificial Sequence: Synthetic oligonucleotide
gacuaaggguguugacag

SEQ ID NO: 6210 - RNA, 18 nt, Artificial Sequence
  Description of Artificial Sequence: Synthetic oligonucleotide
gaucugacuaaggguguu

SEQ ID NO: 6211 - RNA, 18 nt, Artificial Sequence
  Description of Artificial Sequence: Synthetic oligonucleotide
cagcagaucugacuaagg

SEQ ID NO: 6212 - RNA, 18 nt, Artificial Sequence
  Description of Artificial Sequence: Synthetic oligonucleotide
agaaucagcagaucugac

SEQ ID NO: 6213 - RNA, 18 nt, Artificial Sequence
  Description of Artificial Sequence: Synthetic oligonucleotide
cccagagaaucagcagau

SEQ ID NO: 6214 - RNA, 18 nt, Artificial Sequence
  Description of Artificial Sequence: Synthetic oligonucleotide
aggaccccagagaaucag

SEQ ID NO: 6215 - RNA, 18 nt, Artificial Sequence
  Description of Artificial Sequence: Synthetic oligonucleotide
ucagcaggaccccagaga

SEQ ID NO: 6216 - RNA, 18 nt, Artificial Sequence
  Description of Artificial Sequence: Synthetic oligonucleotide
ccaggucagcaggacccc

SEQ ID NO: 6217 - RNA, 18 nt, Artificial Sequence
  Description of Artificial Sequence: Synthetic oligonucleotide
uuguuccaggucagcagg

SEQ ID NO: 6218 - RNA, 18 nt, Artificial Sequence
  Description of Artificial Sequence: Synthetic oligonucleotide
ccaacuuguuccagguca

SEQ ID NO: 6219 - RNA, 18 nt, Artificial Sequence
  Description of Artificial Sequence: Synthetic oligonucleotide
cuccaccaacuuguucca

SEQ ID NO: 6220 - RNA, 18 nt, Artificial Sequence
  Description of Artificial Sequence: Synthetic oligonucleotide
acccacuccaccaacuug

SEQ ID NO: 6221 - RNA, 18 nt, Artificial Sequence
  Description of Artificial Sequence: Synthetic oligonucleotide
aucccacccacuccacca

SEQ ID NO: 6222 - RNA, 18 nt, Artificial Sequence
  Description of Artificial Sequence: Synthetic oligonucleotide
aaaccaucccacccacuc

SEQ ID NO: 6223 - RNA, 18 nt, Artificial Sequence
  Description of Artificial Sequence: Synthetic oligonucleotide
ucccaaaaccaucccacc

SEQ ID NO: 6224 - RNA, 18 nt, Artificial Sequence
  Description of Artificial Sequence: Synthetic oligonucleotide
uuaaaucccaaaaccauc

SEQ ID NO: 6225 - RNA, 18 nt, Artificial Sequence
  Description of Artificial Sequence: Synthetic oligonucleotide
accacuuaaaucccaaaa

SEQ ID NO: 6226 - RNA, 18 nt, Artificial Sequence
  Description of Artificial Sequence: Synthetic oligonucleotide
ccagaaccacuuaaaucc

SEQ ID NO: 6227 - RNA, 18 nt, Artificial Sequence
  Description of Artificial Sequence: Synthetic oligonucleotide
cagaaccagaaccacuua

SEQ ID NO: 6228 - RNA, 18 nt, Artificial Sequence
  Description of Artificial Sequence: Synthetic oligonucleotide
guccccagaaccagaacc

SEQ ID NO: 6229 - RNA, 18 nt, Artificial Sequence
  Description of Artificial Sequence: Synthetic oligonucleotide
ccaauguccccagaacca

SEQ ID NO: 6230 - RNA, 18 nt, Artificial Sequence
  Description of Artificial Sequence: Synthetic oligonucleotide
cauaaccaauguccccag

SEQ ID NO: 6231 - RNA, 18 nt, Artificial Sequence
  Description of Artificial Sequence: Synthetic oligonucleotide
augggcauaaccaauguc

SEQ ID NO: 6232 - RNA, 18 nt, Artificial Sequence
  Description of Artificial Sequence: Synthetic oligonucleotide
aaaccaugggcauaacca

SEQ ID NO: 6233 - RNA, 18 nt, Artificial Sequence
  Description of Artificial Sequence: Synthetic oligonucleotide
cuaagaaaccaugggcau

SEQ ID NO: 6234 - RNA, 18 nt, Artificial Sequence
  Description of Artificial Sequence: Synthetic oligonucleotide
agcuucuaagaaaccaug

SEQ ID NO: 6235 - RNA, 18 nt, Artificial Sequence
  Description of Artificial Sequence: Synthetic oligonucleotide
guucaagcuucuaagaaa

SEQ ID NO: 6236 - RNA, 18 nt, Artificial Sequence
  Description of Artificial Sequence: Synthetic oligonucleotide
ggugcuguccaucacauc

SEQ ID NO: 6237 - RNA, 18 nt, Artificial Sequence
  Description of Artificial Sequence: Synthetic oligonucleotide
gugguggugcuguccauc

SEQ ID NO: 6238 - RNA, 18 nt, Artificial Sequence
  Description of Artificial Sequence: Synthetic oligonucleotide
ucugggugguggugcugu

SEQ ID NO: 6239 - RNA, 18 nt, Artificial Sequence
  Description of Artificial Sequence: Synthetic oligonucleotide
guauuucugggugguggu

SEQ ID NO: 6240 - RNA, 18 nt, Artificial Sequence
  Description of Artificial Sequence: Synthetic oligonucleotide
auccaguauuucugggug

SEQ ID NO: 6241 - RNA, 18 nt, Artificial Sequence
  Description of Artificial Sequence: Synthetic oligonucleotide
ugucaauccaguauuucu

SEQ ID NO: 6242 - RNA, 18 nt, Artificial Sequence
  Description of Artificial Sequence: Synthetic oligonucleotide
cuggaugucaauccagua

SEQ ID NO: 6243 - RNA, 18 nt, Artificial Sequence
  Description of Artificial Sequence: Synthetic oligonucleotide
cgcaacuggaugucaauc

SEQ ID NO: 6244 - RNA, 18 nt, Artificial Sequence
  Description of Artificial Sequence: Synthetic oligonucleotide
cccagcgcaacuggaugu

SEQ ID NO: 6245 - RNA, 18 nt, Artificial Sequence
  Description of Artificial Sequence: Synthetic oligonucleotide
guccccccagcgcaacug

SEQ ID NO: 6246 - RNA, 18 nt, Artificial Sequence
  Description of Artificial Sequence: Synthetic oligonucleotide
ucauaguccccccagcgc

SEQ ID NO: 6247 - RNA, 18 nt, Artificial Sequence
  Description of Artificial Sequence: Synthetic oligonucleotide
gggaaucauagucccccc

SEQ ID NO: 6248 - RNA, 18 nt, Artificial Sequence
  Description of Artificial Sequence: Synthetic oligonucleotide
gucgugggaaucauaguc

SEQ ID NO: 6249 - RNA, 18 nt, Artificial Sequence
  Description of Artificial Sequence: Synthetic oligonucleotide
ucaaugucgugggaauca

SEQ ID NO: 6250 - RNA, 18 nt, Artificial Sequence
  Description of Artificial Sequence: Synthetic oligonucleotide
agcgcucaaugucguggg

SEQ ID NO: 6251 - RNA, 18 nt, Artificial Sequence
  Description of Artificial Sequence: Synthetic oligonucleotide
ggcguagcgcucaauguc

SEQ ID NO: 6252 - RNA, 18 nt, Artificial Sequence
  Description of Artificial Sequence: Synthetic oligonucleotide
gcccgggcguagcgcuca

SEQ ID NO: 6253 - RNA, 18 nt, Artificial Sequence
  Description of Artificial Sequence: Synthetic oligonucleotide
acuuggcccgggcguagc

SEQ ID NO: 6254 - RNA, 18 nt, Artificial Sequence
  Description of Artificial Sequence: Synthetic oligonucleotide
caggaacuuggcccgggc

SEQ ID NO: 6255 - RNA, 18 nt, Artificial Sequence
  Description of Artificial Sequence: Synthetic oligonucleotide
uaguccaggaacuuggcc

SEQ ID NO: 6256 - RNA, 18 nt, Artificial Sequence
  Description of Artificial Sequence: Synthetic oligonucleotide
ugguguaguccaggaacu

SEQ ID NO: 6257 - RNA, 18 nt, Artificial Sequence
  Description of Artificial Sequence: Synthetic oligonucleotide
gucggugguguaguccag

SEQ ID NO: 6258 - RNA, 18 nt, Artificial Sequence
  Description of Artificial Sequence: Synthetic oligonucleotide
auguugucggugguguag

SEQ ID NO: 6259 - RNA, 18 nt, Artificial Sequence
  Description of Artificial Sequence: Synthetic oligonucleotide
uacucauguugucggugg

SEQ ID NO: 6260 - RNA, 18 nt, Artificial Sequence
  Description of Artificial Sequence: Synthetic oligonucleotide
guagauacucauguuguc

SEQ ID NO: 6261 - RNA, 18 nt, Artificial Sequence
  Description of Artificial Sequence: Synthetic oligonucleotide
gaaggguagauacucaug

SEQ ID NO: 6262 - RNA, 18 nt, Artificial Sequence
  Description of Artificial Sequence: Synthetic oligonucleotide
ugggcgaaggguagauac

SEQ ID NO: 6263 - RNA, 18 nt, Artificial Sequence
  Description of Artificial Sequence: Synthetic oligonucleotide
accugugggcgaagggua

SEQ ID NO: 6264 - RNA, 18 nt, Artificial Sequence
  Description of Artificial Sequence: Synthetic oligonucleotide
aguacaccugugggcgaa

SEQ ID NO: 6265 - RNA, 18 nt, Artificial Sequence
  Description of Artificial Sequence: Synthetic oligonucleotide
cgaugaguacaccugugg

SEQ ID NO: 6266 - RNA, 18 nt, Artificial Sequence
  Description of Artificial Sequence: Synthetic oligonucleotide
aauggcgaugaguacacc

SEQ ID NO: 6267 - RNA, 18 nt, Artificial Sequence
  Description of Artificial Sequence: Synthetic oligonucleotide
aggucaauggcgaugagu

SEQ ID NO: 6268 - RNA, 18 nt, Artificial Sequence
  Description of Artificial Sequence: Synthetic oligonucleotide
aggccaggucaauggcga

SEQ ID NO: 6269 - RNA, 18 nt, Artificial Sequence
  Description of Artificial Sequence: Synthetic oligonucleotide
guuauaggccaggucaau

SEQ ID NO: 6270 - RNA, 18 nt, Artificial Sequence
  Description of Artificial Sequence: Synthetic oligonucleotide
ugcaaguuauaggccagg

SEQ ID NO: 6271 - DNA, 474 bp, Homo sapiens
agttcgaaatttgagcaacccagccaagaagttcaagattgaagccaatgctgggcaactgtacctgacaggggtggtggtactgcacaaggatgtcaacgtggtagtagtggaagggggtgagtctgaaaaacttgagggagactgtccccagacaaccctaggcttagagtgattagcattgtggggagaaaggagaaaaagatcgtattttagtgccatacctgatataatatgctaggtctctgcttctgtgttttttggagtagaaggccctaagatgtggttcctgagattgcttcaactaccacattaatgtctgagctcagaggttctttctaccccatcatcttccacagttctggcaaaattattcttctctgtttccaggccccaaggcccagaagaaatttaagcgtcttatgctgcatcggataaagtgggatgaacagacatctaacacaaagggagatg

SEQ ID NO: 6272 - DNA, 1703 bp, Homo sapiens
agcgcatgaagaggccaacgctgcccgaaaactcacagcagaacagagaaaggtcaagaaaattaaaaagcttaaagaagacatttcacagggggtacacatatctgtatataggtaggtgtccatactgggccaaacttccccttagaattactaaaacattttccaagtgcttgaggcagaatcattgtggcctaaaagcatacctaacaccagttcctactctcttttaatgaccctagtgtggatcaagagctagtaaatcttgtaaaatagcgagagttaatgacttatgtttatggttacccagttcttccctctcaagtcttctttttttttttaccagaatattagttctgaacaagtcaatatacttgttcaggccaagatgtgaactaaagattgtatgtcctttgagaactataaaatatcatcctatttcttttttttttcatctttttttttttaaatggtctgagtttgcttccaacatccatggaagcattacaaattttctttcctccgtagtcatatccttaccctgatgtattgctgtgtttcatcctcactccaaaatgcattttatatgttgtaaatatttttctacctttgtgttgatttaatgtttttattcttttatgttgagtacatgtgtatcttctatttttaaaatgtgcttatttctattaactagttctttattataaaagtggtacattatcacaaaaatagtgaatgcttattaagatttaaaaaattgtctgacaacacagaagaatacttactcaaaatgtctcctttctattctctgatcccttagaaccactctctttaggtaattgctattaacagtttttcacatatcctcctagaaaattttcatgcctatatagtgatcctatatatatattttatttatttatttatttattttgagacggagtttcagtcttgttgcccaggcaggagtgcaatggcgcgatctcagcgcactgcaacctctgcctcccaagttcaagcaattctcctgcctcagcctcctgagtagctaggattacaggcacgcacccccacgcccggctaatttttgtatttttagtagagatggggtttcaccatgttggccaggctggtcttaaactcctgacctcgtgatctgcccactttggcctcccaaagtgctgggattacaggcatgagccaccgcacccagccaagtaatcctatattataagagtctaagggtctagaggacaaaaagtctgtaggtctttacattgtcaagaacaatgagattgtaagtatttttggatgatagtaaatacctctccctgactcttagagtaaactttggttagtaatgtaatggttaatgtaaagtgctagactttgaagaaatgtaagagtgtggaaatatttctagactcatcaactctaccttttaagcattcatctatttgtttactccagaggcctttgtttatagagaggaaaccattttggattcatctttttacttgccactccattcaggcagctgctgatgctaaaatggaagacataactaaactttcccttctccagagttcgaaatttgagcaacccagccaagaagttcaagattgaagccaatgctgggcaactgtacctgacaggggtggtggtactgcacaaggatgtcaacgtggtagtagtggaagggg

SEQ ID NO: 6273 - DNA, 645 bp, Homo sapiens
gtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaagtaagtgcctcaggacccagccctaggcagccaggacactttcgttttcctgttcttctagccctgcaactttaggaattgtcctgtctgcctttgtttcaaacttggagccagtgctacgcttggagcctgtcaacacccttagtcagatctgctgattctctggggtcctgctgacctggaacaagttggtggagtgggtgggatggttttgggatttaagtggttctggttctggggacattggttatgcccatggtttcttagaagcttgaaccctcttcatcctcagggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacag

SEQ ID NO: 6274 - DNA, 26191 bp, Homo sapiens
gcccctcctcttggccaaactttccggaggggaaggctttccgaggaaacgaaagcgaaattgaaccggagccatcttgggcccggcgcgcagacccgcggagtttcccgtgccgacgccccggggccacttccagtgcggagtagcggaggcgtgggggcctcgaggggctggcgcggcccagcggtcgggccagggtcgtgccgccggcgggtcgggccgggcaatgcctcgcgggcgcaatgaatccgcggcaggtaagccgggccggccttggaccttcgccgccgtctgggttcgtttacaacctcacaggctttgtgttgcagtgcgtagcgtgtgcgtcttgtgagtgttagagtgtgtgtgtgtgtgtcgtcttgccaagcagcattgctggtttaggaatttgtgcgtcttgtgagtgtgtgtgtgtgggtgtgtgtcgtcttgccaagcagcattgctggtttaggaatttgtgcgtcttgtgagagtgtgtgtgtgtgtgtgtgcgtgtgtgtgtagtcttgccaagcagcattgctggtttaggaatttgtgaatttgtatcctgctcattaattctgcagaatggagcagtgcgtgaagagggcttgggggaaaatgcgcccccgtctgagtaggaaggcctgagcccatgtcaaggcagacacatcgtctccctttctgctagggccccttgtggaaccccctacccccgctttagccccacttgaacaacgttcggactttgagcagcgcacactatcctcagctcaccttatccacctcctgaaggccttctgggagttaaaaatggcacttaagctgtaggagaaagcttgttaaccactttatagctaaaaactgggaaaacacaaatggccttcagcaggttaacagataaactgaaatacatccacataatgggatactgcttagtagtgaagaggaaatactgttacaagtaacaacacgggtgactcgcaagtgcgttatgctaagcacgagaagccagactcaaaaggctgcatactgtatgagtccatttatatgacattctggaaaaaaaaaaccacagttatagggatggaaagtggatccgtgggtgccagggactgggtatcgtggaagaaattgattgttgagtggcatgaaaaagctttttagggaaatagaaatgttctatatcttgattgtggtggcgattgtcgaaattcatagatttatacacttaaaaggataaattttactgtatctaaattatatacctcaattttgttaagatatatatatatttttttttttttaagcactcctttgaaaggattaaggacgcctaacttgaaggaaaagcatttctgcacaggtgtcagtgtattgcactgtggaacctgtgtggtaaaggcaaagggggtagtgcttatctcttgatcctaaatatgtgagaccagattaaagtgaaatctgggaggcaatgaatgttaaatgagttgttatgtaatttgcatagaggtgatgctgagagatttagaaaggatcactgtgggttgcttgctcactttcttgctctcctattccgtagctttccaaatggctgtactcaacggtggcttggtgtttaggggatttaaggggggcaaaaagaaagattaataatctcctcctctccctctaaccctactgccctaagatatccttagcaaacttacatctcctttcttttctctgtgttcattccattgtgcgcacacatacacattcatggattttctctttttgtttagggaaaaaaattataatgtacatactattctacaactttttgttgttttattgaacattatatgattcctaaattatccccaggtgaatacaaatagatatgacacattttaaaaaaataaaataactggccgggcgtggtagctcatgcctgtaatcccagcactttgggaggccgaggagggcggatcaggagatcgacaccatcctggccagcatggtgaaaccccatctctactaaaaatacaaaaattagctgggtgtggtggcgtgcgcctgtaatcccagctactccggaggctgaggcaggagaatcacttgaacccgggaggcggagattgcagtgagctgagatcacactgcactccagcctgattgcagtgagccgagatcatgccactgcactccagcttggcaacagagcgagactccgtctcacaagaaaaaaaataaccgtgtgagtactattccatagaatgaatgtttcataatttaattcttctatagacagacattaaaatattttccagatttgggccaagagtagcagtttaaaaaacatttagcttttaactgactctagccactttgaaacacaatttttttttcccaaggtcactcaaagagctaataggagaacccctaagtcccataattcagctctgggagccagcactcactctgtacacacatttgcctctgtccctagcaatatggtgggcgtgagggtgcagcaagaggaacaagaaagaaatgattgcttgcatagtggcgtcttgttcatgcagtcattaattcaacaaatgtttgttgagaatcagctttgtgccaagtgctagagaggttgagatgattgaagcatagtccttgacccccaagagctcaccatggaatcaactgaagcccctcatcagtactgtgttgggaatattgagagtggagagttgagtataacttataggacacctaatgttaattacctttcagacactgcaatgtgtgtgtgccataaaaaaaaaaaaaatccagtagctctgatacgagggaaagtaaatggtttaacaggtgctgagtaggagaagctcaaggagaggaaaccccaagggctgaagaaggtgggagtcaggagtctcctgaagcaagtggcatttaaggagctctataaggaaagggtcagagttgtgataggtggctgtggagggagatgtgccacctggattggcatgtagagggatagaaagattataggcctttgcaatggcccagtaagaggtaatgaggggctggaactggaagaaaacacatttaagacacagtacagaggtggcagacaaggtgggacttggcaactacctgatgagatccaggagatgaggccaggaggcgggcagcaaagatgacgcaggtttctagccttaataggctaggaggagagtgatgccattagcaataagaactacaggagaaggagctgagtttgagggaactattaatttggttcagaatatgtgctgtttgagttatggcaggatatttaagtggacagactgtcgacatagttggaaattcagatcttaagctcccacacaaggtagtggctggacatagtagatttgagtgctcttgcttcagagggctagtttaggttggggcagtgattaaagcaacctaggaaataaattataaaggaagaagaggtccttaaaaccttggagactgattatataaagggtggatccgttaatacagtagctattaaaaaattataaggggtgggaaaaagggacaaagaagaaaaaagaggtgaaagacctttgctgtgtcaccaaaccctgggaggagaattttttaaaagaagagtactcaatccacagtgaactaaggcatgtttgttaaacacaattgaccaccacacagcgaagacccaaatgaggttcaagagaaggaatttttatggaccctgttagcacaagtcaaggtccttctccagtaccactgggaagctttggagaagaaaagggggacagtgggccttgggtggagaagggaactgaccatgagatccaggtggggtgaggaggtgtgtgaagtcagagtggggaagaatcagggtggcttactggcagcttcaccggggtcatgcgaggagcaggttccaccagagtaaggagtgaagttgtagaaacacagggaagtcaccatcagaaaagagcaggagtcaagaaactatggcccacaggtacaaactacctgtttttataaataaagcttcatggtaaatgaattgtaaataaagttttgcatattgtgtgaggctgtttttgtgctacagtggcagagctgtctggccctttatagaaaaagtttatcagccactggaaaagagttgcaggatttgaggtcttggtgtgatggcctaggttagagtcatagtgagattgaaggagtagctagacaagccaattgtgtggcagaaaggtagggatggagatcactgggttaaggatccttgtagccaggacaccatgagagtgattgacaagaatgctgaaatcccctaagtgtgtcaggatgtggaagagtagaaggctagagttatggaagaaagggtcccacctctacctgtgcagcctccaggagagtctgaggagggggcggtgagtgtgagtaaatgttgtcagaatccctcctcccagtctacaagccccagggaaaggaagcaaggtgtttactgacacccccaggcttataagtacttcctggctccatcaccctccagtgaacagccctggggagaagacagtactggtttgcaggtgggtgggtggggaaaggggtcacaggtgcttggtgttctggtaaatgtgcatatgagaacatggggttgcttgtgccctgtccgtcagggttcagaagaacgtgcagtggaagcagctatggggaagtagctagggaaggtaggactggtctgaggtggtgaggagcagatgctgccagctccacacatccaggagagcctgggtggtttgggcaaaagtctctggcatcccttctgagcctgggtaccacactgaagagtgaggacagtgtgccatttttatcaggaaaccctccagctccctgaagaccaaattctgatcctcctgggatggcagtgaagagccacagagatgactctgaggtcccgtggccttttcccacctggagattgttttcgttactgcgctgttacagccttggaggactggggttcagtttcatccaatcacatttcttcttttgtcatagtcatctaaacgatagatcttagagacaggtgggcaaggggtgcactggtgagcctgacttaaggagaggtcatctcgtcccttccctagtcccatctcccttggttattgttatttcatgtgattgttctggttatttcaggttattctgtttttgttttcaaaacaataacatatatttgttgttctgattttaaaggggtaattgttttggtaactagaaaattaccttctcaactcccttaaattctgtcaaagggaaaagtaagttaggttgctggagaggctatgctgaggcctcagaacctctgtattcctggaagttctgcgtgctttgcctcctgctcccctctctgtgttcctgttggcaggcccctaggcaggatttaggaggtaggcaagtcaccctagccaagtcataagcccatggctcaattgccttctcagcccttcaagggctgttccacaggcagcaaagggaggggcctccacaggttcaccactgcagccctaattcattttctttttccactgtcttattctgcaggggtattccctcagcggatactacacccatccatttcaaggctatgagcacagacagctcaggtaccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcagaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcggtaagagaccacccaggaactgtacctagggttggggtcaggtgcttttgctcctgacgcagtcttggctgatttgtgagcagtgctgtttggtggcgcctatcttttcctccttcccttctgccttttagctaaattccccttgattggccctttctccagatattgagcagggaatatagaccttggaccagccagaatcttggctgaacaagggggaggttgactctgttggctgtaatgaagcttctttagaaatgattggttttggccgtacgcggtggctcatgcctgtaatcccagcactttttgaggccgaggcaggcatatcacgaggtcaggagtttgagaccagcctggccaacatggtgaaaccctgtctctactaaaaatacaaaaattagctgggcgtggtggcgtgcacctgtagtcccagctactcaggaagctgagacaggagaatcacttgaacccaggaggcagaggttgcagtgaactgagattgcgccactgcactccagcctgggccacagagcaagactccatctcaaaaaaaaaaaagaaagaaatgattggtcttgggggccggggcggtggcttacgactgtaatcccagcactttgggaggccaaggcaggcagatcatgaggtgaggaattcgagaccagcctggccaacatggtgaaaccccatctctactaaaaatacaaaaattagctgggggtggtggtgcttgcctgtaatcccagctactcgggaggctgaggcaggagaatcacttgaacccaggaggtggaggttgtagtgagccgagattggcgccactgcactccagcctgggcgacagagtgagactccatcttggaaaaagaaagaaaaaagaaaaacatgattgatctccatgcatcaatatcatgcctgcctcctaaggcagaggtaatgaagacttaattcccttctgtaggccttcccctcctccctaagccgttttctgagagaggtgcaggagcaggtgggttggggcaggctgcatacacagtgggggtgggttgtgctgctaagcagcagcaggtccacaatcccccctctgcatagctcctggggggaaaggatggaggagcgtgtgcacggctgcctgcctgttgaaggtggtggttctaattttataaacctcctctgcacagatgggtaggctagcacttgctgccactcctgagctgtgaagtcagcctttacctcactcagatagctggtcaggccctgcactgtaggtcctaataggccagtggacagattgaggaaaacaggagcttctgaagggcataacagagagcaaaaccactgaagctgagtggctgcagctgcagccagggaaagagccagtaggatgggggagaattccactgacctttatgtttacctagcctggtttctaggggtgtagattcctggctagggcccttattccttgtcttgactgtcttcatgacaccaatttggcatttcaggagagcggttaagaaaaggagttgtgtctgtccaaaagctggcaaggccagagctggattgtttggggtagagactggatggccgtcattctcttttgcctccatccctcctccccagagttggaggaaagcagtggattttgtggttagtcattctttggactcacactaaaagaaacattggtgccatgttcaaatatatcagaagacctaggaaataagaaatttgacctacttttctaaatgaaatcccagactgagcaaagagctcaccacatttgaaagcttgaacaaagggggcctaggctaagtccagaggcctagaacaaatgcttttttattttctacataacaaggggaaattccttgttatgtagaaaatagctggagacaaatggtgctatagagtgactcataacaaactacggtgatataggtctagggacaaaagcaggccactgataagtggcagatgcctgatccccctaggtagtggggagtgtgagactgggttataagaagccttcactatcttttaggaccctcccttgaggaggccagtctaccacaattgctttagaatgaaggtcttttggttgctcacaagactataatggtaatttttggctcatcatttttgtgtgtgtgggttttatcttaattcattgttaaagagatagtgggtttcccctgagctagtttcctatcatctgtgcctatgtttgcttcactgagctatggggaaagagtcactggctgctttgtttacaaaaagaaaggacaggctgagccttaaggagtaggaaggagttccttggcctacccttcatctccacaagtgaaaagccccttagcgtagcagaaaattccaggttgaaggtctctttggagaaggcagaaggagtgacctagactcctgttcacacatctaatcactttccgtcaagatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaaggtaggtgtcctcctgccatctgggaggatcagttccctgtcagtgtctggattgtaactgactcccttgaggcaatcccagcctaaacaactgacaccatctcggagtcagcttcccactcttccctctaccctatctcgccagcccacctttcctcctctcatacccagctcctctgtctgctcctgtcccaacataattggatttacagaatttcggacttgaaagagacctgaaagtttattgaggccaatctcctctcttggaagatgcggaatgagagctccagcagcccctttaactttgggaagccaaccccttgacaggtggtgggaataaagtcccccatccccatcccttcttctgtgatggactaaccagtgttttcttagttttgttttcttcttgtctctcattttctctagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagtatgtcctacgtgtcctctgtccagctgaggttttctcagaaagaaaaagagacacattttcttccttgcctcctcagggatggcagattgaccaatttctcctgtttcaaaatggggaaaggagggctctgaggtcctggttgctgcttgtgaggcagacaattagggattaggaattcaaagggaattcctggcccaccctctatctcctctataagcactagggaggttcacggcttggaggtcactcactgttggtgggacagaaaggtacaggacctgagaagctctctgcctgtgggtctatagactcacatgttcaagagaagtgttcctggaagaggtgaaactaggttgatgcttaaatgttgaaaggggtcagccaggctaagagacactggctgttcaaggcagaagtgactgcatgagatgtgactgcacagaggtgatgtgttcaaggaaattaccagtagtggaggatggcagcctggcagaggctaggtcaggctcctcagtcaaaaccattttaatccttctacgtgcttcatctcctgtcaggttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccaggtagggcgttttcctactcaaaagatacaggtcatttttagcaactgagtggtttaagattgccagtgactccctcaacatttcctgaagtgtttatggctcctctgtttgatggattctcctttagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagtgagtgtcctagtcctggctaatgcatgtgtcaccagttggggatggtctgtaacccagggaaaacaagggtgtgctttagctgtgtaggacagaaggggcgagttgagggaaacaagtccagccctgtctccacggcctcttagaagacaatagacctgccaagagtgaatgcgttcactcttccagtaagcatgatcctttttaattttttgactagttttaatttttaaagaaatgtataggtacattaaaaaatcattcaggccagacatggtggctcacgcctgtaatcccagcactttgggaagttgaggcaggtagattacctgaggtcgggagttcaagaccagccggaccatatgaggaaaccctgtctctactaaaaatacaaaaattagctgggcgtggcagcgggtgcctgtaatcccagctactcgggaggcagacaggagaattgattgaagctgggaggcggaggttgcagtgagctgagatcgcaccactgcactccagcctgagcaacagagcaagactccatcttgaaaaaaatcattcaagctgattgaaaaagtagtcatttcaatgaaaagtctcatttccgtctcagacttctagtttccctccctagacccatatattactatagccctgcattagcaactgggatgcggtctgagaagcatggttttgttgttgtgagaacatcagtgtgtatttacataaacctagatggcatgggctcctacacacgtacaggctgtatggtatggccggttgctcctaggctacaaacctgtacagcatgtaactgtagtgaatactgtgggcagctgcaacacactggtaagtattggtgtctatctaaacagcaaaaagatacagtaaaaagacagcataaaggattaaaaaaatactacacctgtatagggcgcctgccatgaatggagcttgcaggactagaagttgctgtgggtgagtcagccagtgagtggagaatgaatatgagggcctaggacatgactgtacactaatgtaggctttgtaaacactgttcacttaggctaactacatttatttaaaatatttttctttaataaattaaccttagcttactgtaacttttttactttatttttactttattttttactttattaacttttttattttttgttccttttgtaataatacttagcttaaaacacaaacatgttgtactgctatccaaaaatatttcctttgtttatatccttaattctatagtcttttttctgtttgtaaatttttttatttttttaactttttaaacttttttgttgaaagctaagatgaaaatacattagctgttagcctaggcctacacagggtcaggatcctcagtatcactgtcttccacctccacgtcttgtcccactgtaaggtgttcaggggcaataacatgcatgggggccgtcatctcctatggtaacagtgctttctggaatacctgcctgaggctttttttagttacttatttttctagaagtagaaggagtatacgctgaaataatgataaaaatatagtaaacacataaggagcgtgtagcctagatccctcgcattcacagttcacagtcgagttcacactcctacaagaatctcatgctgctgctgatcccacaggaggcggagctcggaccagaatgctttcttgctcgccactcacctcttcctgtgtgcccaggttcctaacaggttacagagccctgcacttggtgataagaatttttcagctccatcataatcttacggggcccctgtcatatgtgtgatttatcattgaacaaaacactgttatgcagtacatgactataccagtttcttgagtccttctagaaattgctgtgcataactagcacattttcccttttgtctttttaaacaagtatatcttctgttttatacgttgactcctttacttaccagacttcttgcatagctgcatagtatttcattgaatagaagctgacaaattcagtttctcagaagtaaacatttaatagggacttaggaacagaaatgatgtcttgggtggctgcaagatggtggatccctgcacttaccctccagaaagtatgctttctatagaggcttttttggttaaacatgcagctggtcacacattatactttcttgtgaaacttatgagcactagctggtggggaggcttggtagacatctttgtgtggaattatttatgctacccaacactttgggatgcgggagtcagatattggtggtcatagtggttttgcatcaagatggcatcactcttgccatgcaaccggcatgttttcttaatctctaaggtctatcacaaagtggaaaagcaaggtgtaaagtgaggggagaggtgaagattgtctgtatatgtctagaatattttcttgaaggatcgaaaaaactggcaactgtgtttgcttctggggaaggagggacacttttattgtacactcttaactgtttgaattttcacatgtttggcatccaacttgtccattttaaagtcattaaggaaaaaagcttataaaaatgctatcttgttactttaaatttgtctctccttaatagaagtaatgtcagccgggcgcagtggcttacgcctataatcccagcactttgggaggccgaggtgggtggatcatttgagctcagtaatttgagaccagcctggccaacatggtaaaaccccatctctactaaaaatacaaaaaatagctgagcatggtggtatgcccctgtatgccagctactccggaggctgagcaggagaattacttgaacccaggaggcggaagttgcagtgacctgagattgtgccactgcactccagcctgggtgatggagtgagactccgtctcaaaaaaaaaaacaaaaaaatcagaagtaatggcatttcatttattcatatttatgtgttatttgcatttccttttctgtgaaccacctgttcttgtccttttccagttttctttcagattgttactctcatggatatgtaagaacttttaacataatttttaaaagtagccctttgcccaacatgacccaatttagaacacacatctgcccactgtttaagccatctggaaaaggagaggcccagtctccctccagctgctcttctactaattcatatccttcatctcaataagcacctccttatctttaagcacagtccttcagatgataggttcagtgcatttcctctttctcttctgtgaaatcttctgtgaaatcctttctaggacttcaagtcagccattcattgagaatgtaagaacttactatgaactagatggaagatacaaaaaattgctgcccctgagtgtgtagcagacatatagccatagcagtattgaaatgtgccattggaggtgaatgcagagtgctgtggggacacagaggacactgctgccactgtctgccagggagctgaggaaggttgcatagagaggggaaatgctaattgagtaactacgtttattaactatctcgtacaataatatactttagttgcttcttaatgtgaattatgctgggtctttttttcctttctgtctactgtggctggtgacgttaactaattttatgacttcttttctgtttttttttttttttttttttggagatggagtctcactctgtcacccaggctggagtgcagtggcgcagtctcagctcactgcaacctccgcctcctgggttcaaacaattctcttgcctcagctcctcgagtagctgggattacaggcatctgccaccacatctgactatttttgtatttttagtagagacagagtttcaccatgttggccaggctggtcttcaactcctgacctcagatgatccacccgcctcagcctcccaaagtgctgggattacaggcatgaaccaccgcgacagccatgacctttaatatctaaatgctggagaccactcagagctcccgattcctccatctagttgcttacttgtcacctctgtttggattaacatccctaatatgacatgtccaaagcagaactcttgggttttgcccccttcgcttcatttcccccaagtctttcccagcttagtaagtgataccactgtctacccagtggctcaagtcagaaacctgaggatcatcttttcctctatctcctttacctccttcgtcaactcatccttaagtcctattggttatacttagaatttctatcccaaatcccttcctcttctttccacctccagcgtcagcactctaatccaagccactgtctcatctagactgtcacaatagcctcctaactgatctttatactttatttactcaacacttatttatggagtatcttctattttttttagaacaggaaccaaacattaaccaatagtcacctaaagaaatgtaagatctcatatttgataagtattccaaagggctggagttgcagcgagaatcaattatagcacagtttgacttaggaaggagagggggaagggcttccccaagaagtactgcctgagctgagactttaaggatgatgaagagagaaagactgagggttctaggcgaaggacactgttaaatcctgtggtgggagaagcgcagagctggcaaagaggctgagaggaggcacttatggcaatagccccatttggctagtggctaccatattggatagcacagctctaaaggattctagttgcataattaacaaactttatcatatatgtaaatatatcagtataaaactttgcacgtaagagttcatattcttttcaaacacatggggcagtcatgaaattctcctggatccctgaggtaaagatactacacaatctgtccctcctgaccgccttcaccatcttcttttcatgccactgtccctctcattctgaacttaagcccactggcctgcacgggcctgccagcatggacaaagaaaagagtgaaggcatttagttgcttcggatcatcaaggaacagtgagaaactccatgtggttgaacataaacgttgattccttttactgcctgagctgctaagtcttgaaactgaagcctctgttatatgcagttagagtatccaaagctgggttctcagccagtagattaggatctggttgaaagctaggattcttgatgccttgtctggtacatttccaagctgttttgctccaccatgctcttccctctgtgtttggaaattaccagccggagcggtagaagccacctccctgctccacttgggcactttattgtcagcgcagctcatgcgcccaagatccattccttaccccagagttagcttaagcctgccaggagtcaaaaaaacaactcccagcaaaacctgggtccctggcctaaggccgaccttgacctaatgacctctccaggtcaagtccccttgagctaataggaagtaaatgagggaatggagttgggcgctttaaaaatcagacagtgtatgaagtaacagtgacttgtggggagaaaggtagtcccttctgatttctgcttaagaagagagtccaagttggtgctagcatttcgttaagccttcctcatacttcataatcttcctttatagtaaggacaggctcagagcctttgcaggtaacagtatctagtcagaattttataacatgattttatcatattctgttttacagccaccttcaatatgtggcaagtgatactggttttccatttacagtagtgaaacaaagtttcctatttcagtgtgtttacatttttatctcttttttcatacctagtattacggatatttacatttttagagtctgtttgtttattttagagatggggatcttgctgtctcgcgcaggctggagtgcagtgatatggtcatagctcactgcagccttgacctccagggctcaagtgatcctctcaccccagcctcccaagtagctgagactataggcacagaccaccgtgcccagctaaatttttttttttttttttaagagacaggggtctcgctatgttgcctgggggattactatgttgcccaggctggtcttgaactcctggcctcaagtgatctcccaccttagctcctcaagttgctgggattacaggtgtgagccacaatggctggctctaagaagtcaatttagagaaaaatattaattaatagtccaagtaatacctggatgtggcacaaatcatgtggtgattcatgaatgaccaaaatctaggaaatgctgccttagaaacagcttctgtttgacgggtccatatgtttgcaagactggccacatcttcagcaaaactaacccttccttggaacaatgtcagggtctggcacttgtcttcattctctgtttctcatcccaaaggttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacagttaagacgtctacttttggtgccttttttggggcgggggggtcctcctaactcctaagtggaggtggctcttgctgtcatgcgagttattcctaggctttactcttagcctcgagagagcagtaactgggacactagatgtaagaaggaaaagatgactcacacgacaagtagagcttgatctccctgcccacggtgaatatggtggacacagcctcagctttgtggtgctgacacagcctcttttccccacagctccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacaggtgagtgaggctctgagacatgccgcctcccatggcgcctgaaagcgggtgcctctcatcctcccctggagtccatgcatgtaagtccaaggcagggagaagagacttcattttagctacagtcaattcagagtgaggaatgagttcttagttcctagaggagagaatatgggagtctaggatctgagaaactgaggctgtttctgccttgaagctttcagaacaaatagccttcatcctgttttccatcggtttccttccattattctatttctgttttaaacaccttcctagggaatcgctgtgtgaaaggagattctctcagcctaaaaggagaaactgtcaatgactgccatgcagaaataatctcccggagaggcttcatcaggtgagcgaggtcagagctgtggcccggctgcccggctgtggagagctccagttccctgccccacatggctctgacacggcctctgaatccccctcagacagacgggtcatgatgtggcagtggcagcctttgcttttcacccgtccatttgaacctgtctgatggaatccatcccctctgtgagctgagctgcctcccactgctcggcctgtttttaaatgctgtccttttttctgctaactctgctgcttcatgttcttttctaaaaacacaaaatgaccttttagtcctcagggccttgaggatgaggcagctttccatttccgtttgaggacctacacaaccttgatgcccctgccagctttctcctctagctcaccttttctttaatttatgaagggagagacttagaaaggagcaacagcttcctgtagtccttgaatcagtttgctctgctctagaatccctgtagccgccatagcgaggagccctcagcagaaatgaaggagacccaaaaggctaactatgctttatgaaatgctgaggtctcccctggagaatttccacctgataaactgtgaaacgtctgcaacattgagacttttccttactttctcatttggaggtcagattatagaaacaactgcttttcccagaattgaacctgccttcctaaccagactttctttttgtaggtttctctacagtgagttaatgaaatacaactcccagactgcgaaggatagtatatttgaacctgctaagggaggagaaaagctccaaataaaaaagactgtgtcattccatctgtatatcaggtctgtacagttcctgttgctgccagggtgggccctgccaggctgttagaattgggtatccaaatgctctcctggcctgtaaatcgaacctgatacaataagccacactccactgtgggtttgaggtccatattcaggtgtagatgactcacatgtactgctgtccacctccagtctcccatggtaggccttagaaaacatcccttgcttctgtcacatctgactgttttggagccccacgaaattgcagatttcccacaggtgagttttaacagccacccctgtttttcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggtgagtgatacatgcccccgcctcctttcctcaaaaggctctgcaaggtccagggaccccaagtctctacaaggctgctaggattttaccattagtcactgggcacagaggtgctgtttacaggaaagggaagacctgggtcagggagctgtgtggtaagatcagggttctattttgaatgtgttagtttgggagatctgggagatccccaagtcaaataggaggtgggggttcccatgtggagctcagaggagggagcttggctggaaatagaaatatgggagtcatccccctatagggtcttcatggccatgagaatgcataggattacctcaagaaagcggggaggaaatgaagagtgcggcacaaccaagccctgaggagttgacagatgaggatgccaaatgctggggtcccctcctgtctagctggcagttgactctgccttgtccactggctccttctctcctatcctctcctgtctccttactgtctcttcgcatccactccattgcgttcaggccacgtcagcagtcatcatggtggtcctgaaaccttgctaaataccctaaagtatagacacagttaccatggagccggtgctccactcctaggtatatgctgcagagagatggagatctgtgtccacacggaaactaatatgtgaatgttcatggcagcattactcacaagagccaaaaaagtggaaacaacccagacgtccatcagctgatggattcataaataaaacatcaaatatatccataaattgaatattattttggccataaaaagaagtgaagtgctgatacatgcttacaatatggatgcacttgaaaacttgatgccaaatgaaaaaagccagtcacaaaagatcacatattgtatgattccatttatatgaaatgtccagaatagacaaatccatagagacagaaagtagatgagtggttgccagggccaggagtgggagagttggagagatgaggagtgactgcgccaatgggtagaaggtttctttttggagcgatgaaatgttctaaaattgactgtggtgacagttgcagaactctgtgaatatactaaaaatgactgaattgtatgctttaaatgggtgaactgtatggcatatgaactatatctcagtaaagcatttttttttgtttttttttaaacccgatagtggtttcccactgcactgcatatacaagcaaaacctgctgtgatcacccggcctcctctcatgccactttccccatccctcgcatatgctctgtccacactggctctctgtcaggcgcctgaacagccaatccgctggctgccttggggcctttgcttttgtcctgtgtgcctgaaacacttactccagctgtcctcctccatgtctgggctcccctgctgctgctgtcccaggaggtgtcccctgtggtcctccgtcatagctgcctcagagccttcagagcactgtcagcatctggaattcttccgtatgtactggctactggtttagtgtctattctcttccctttcaatctcctcaccaccatagatgttttaagagcacaaagatcttacttggttttgctcaccgttctttcccagcaccaagcatagtgcctggcgcatagcaggggctgtgaaatatgtgaagaatgaatgaatgtagcctgtggcccaagcttaaggaggatagaaaccacgccagggagtggtttggtccattggcgcctgtgggtctgacccaagtctctcacacaggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggtaaggggcctgccttgggatctggaactggtctgtccttcttgtgcccagatcccaaactgcatgctttattgccaggtgttttgtctcccttatcaaagtgagcatgattcactcctcagtaattgattgagtgtccagtctgctgtggtaggaagatcctggtagccccagtcagaaggtgcttcctaacaaggcagctgtttctctttcttgacaactatatcttgtacctccaaaatccccacatgcttctgcctcttaacagcatttggtgcaaacacaggtatatatgtttctcttttttgtactcaggttaccttttcagccaagggcatctgacccgtgctatttgctgtcgtgtgacaagagatgggagtgcatttgaggatggactacgacatccctttattgtcaaccaccccaaggtgctataacccccttctattttccctgacattttcctccttttcaagcagtcatgtaaacagaggaaaaatgtacactgtgggcaaggggaacattgcccacagtggtagcccacaagggaacattgcccacagtggcccaccaccaacattggttggtctcccaagaacttaaactttcttccttttggatgccaagggcttttcttctcttagtctggaattaatctgaatcgaggtggagttagtatgtctagagggtgctcagtcttagccaaacagaaccctaaatacaggggaaagatcatgaccccacacttcctctctcctatgagtcttgagtccctgcttcagaatcttattcctgaaaggtttccatctttctcccgttgcttctgggattcctaggttggcagagtcagcatatatgattccaaaaggcaatccgggaagactaaggagacaagcgtcaactggtgtctggctgatggctatgacctggagatcctggacggtaccagaggcactgtggatgggtaaggagacaggagagcgcagtgaggaccaagcctctgccctgacttgcaagggtgcatcatacctctgcagtctcagggcttgagagccgcctcccctcccacggtgtctccactgtgagctccttatcttacaggtcccaggtgaataatgagtgcttttgtttctctaggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaattcttagaa

SEQ ID NO: 6275 - DNA, 27855 bp, Homo sapiens
atttaaagctaccctgttgctttggctttctctgtctgccagggtctccgactgtcccagacgggctggtgtgggcttgggatcctcctggtgacctctcccgctaaggtccctcagccactctgccccaagatgggccgtggggtgagtatccctaaagagcaggggtcgcagtctagagggtgagggaggctgctgaggaaggatgaagtgggaatgggatgtggaaggagcgggagagaggagctgagtgggatacttggaacttgaaactaacagtctccaaactaccaatgtgtgtacagatcccacggcggtcacataccctagtgctctcctctcctctgcacgccccagccccctgcccacagttagacccacagcccaccacacatgccccctccatctctccctccaccccactcccacatctctagtccttccctgcagcagtccctcctctcactgcatctcccggcctcccagctgaaaggatgtttggcactgtgagtcctcctgtctttgccacctcctgaaaatatccattcctctgggagtcctagcctgagaggctgggggtccattttgaggttagagaggggcagtagagcatccggctcccagagtcaccaagtagttccggacaccagctccaggggccctgagtgccaaggacagctgggcggggtgtggggaggaagaatgatgacccagcccccaccccagcacccctccggatgtcccgagcagcattgtccgtgggttccaagccatgggctttgaggactttcccagaggctggtgacaggtgaccccccccccagtccacccgtccatggcattctgcagcaatggctacaccaagaggaagattaacaacaatggggcgggcagggagagggctttgaattcttggaaatgaaattcccatatggagaagagtggcccaatccttttacatgctgtgcctggctgctttccttttgtggaatactggcaaaagaggacacagagggaaagggcatgctgcggaacaggagggtatgaggaagactgtgcctagggggagccgtgggtgtttctgggcccaggaggagtcaggcaaggacatgttattgcacctagttgagcagctgggaaatcctgagcctggacaccagggttcctgagctagggttggagccataaatagaattggagtgcatgcatgtatctgtgtgtctgtgtctgtgtgtgtgtgagtgtgtgtccttgaccacgtgttctccataggcggggagtcctgcagttactcatggatgagtacctgtgtttgtgtctcagcaggcaaatttgtaaatgtacaagccttcaagcctgcacaagcataaatgtcactgtgtgggggtgcttgagagtctgtgagcctgcccttaggagctgtgaggtatgggcttcacggaggaagaggtcatagctgcaggaagatatactgtcttgggaccttcagctgcatcttgacatctctggctccccatggaaagggcatccctagctgagatgcaggacctctgagaagaggcaggggttaaaggatcagataagccctccatttcccccatccaagtgaagagagaaggaggggaggtagccccctaccctgctccatcttagagcaaggtagacccagctcaggaggtcttgcttgggaagtgatgagaccttgacttttccagtctgtctttttcccctagcacccccaaactccccttaatcaccatcctaagttgctgtgggtgatgcaatagcaagatgaggagcagatctgggctgtttaaactaagaggctgggtgaggtgggggtatttagggcctggagcttagagttcaacctaccaacgacccctgaagagggaaggcatctgacacccacaacctgttctagggatgatttttcctccaatcccttctcccctgcatctccactgcagaggcaggcttcactgtccccccattacccagtggctgtgaagggcagcgtgggagttgggggaagggacgacactggtgggagggagcccagcctgctccagctaccacggagaggctgagatggggggagcgttggcggattcccagctgcccccactctgtcccagcctctggctttctcaaaaaggactctctgttctccttcagcattcaagacccagagagggggacttgtggttgggggagggaggagtggagggaggttgggggggtccttgcttcctctctttctttcttgcctgggcagccgctggccccaaatctctgcaggctcctggctgcagagcctgagatctttgccaggacaggaggagggggaaggggcagtgtgtctcaagctctaagcctgctggagagcagggcgggagcttgggaaaaggaggcactgcgtggagctgcttagctcagccacaatccagcatgccaaagtgcatggaccagcaagtttttaaaaagcatgcattttattccaatttttatgaaatttatttcacatctgaatatacagaaattcctctgcaccctgctcttctgcccacagacccagccctgctcctctgtgtatgcctgggcccccttctgtccctgaagttcctgagggtcacactgaagctcagccagcctgatctcttgcctctgttcccttgattgcatttcttccttttctcagctctgtcccaccacagacagttagtgaatgtaaagcatttcaatccactcaattaaatgaatcctcttaggtcacctgagaaaggcagaggcagaaccactcacaagcctttccccaccccttccattgggctgctcggtctccccaagaagatctgcctttaggaggccaaaattataccagattcatagatgcttcaggtggagacaaacccacgattttactggtcaccttttctgagaagagcacttctgagcaacacagcctccaaaagctcatatctttttaaatcattggtatcttgggaacaacagtgttgacttctccttgcatcccccacccctacccttgcttctgattgtactggtcagacttctacctctcaagatgctgaattggcgacctcttatgaacaaggcagctgccatacttctgggattgctcctgactctgataagtaaaaaaggcattaccctggagcacaaaagtcttagggcagtgaagctattccatatgataccacaatggcggatacacgtcagtatacatttgcccaaacccatagaatgtacaccaagagtgaactcaaacttaaactatgggctttggacgataaagatgtatcaatgcaggttcatgattgcagcaaatgtaacactctgatgcagggtgttgatagtgggtgaggctgtgcatgtgtgggggcaggagatatatgagaactttctctacttcccactcaattttgctgtgaaccagaaaattgctccaaaaaaagtatattttttaaaatgcaaacaaaacccccaaaactgcattatcctgcaaaaaaaaaaaaaaaaaaaaaaaaaaagcaaacaccttggctgtggaccctacccaggtatccactctttatgggaaacaaaagttaacatcatagtgtgggaaaactaattcctgaaagcctagtgcagactttgcagaatccagtggagaaataggcaccaggtggaaactgagcagcccctctatgacaaggactctatttcctgagggaagtgggaggagagaagactggggcagaagaggaagtaagaaggtacctttttgggaacttttcatggctacccaggccttcctcagcctctatcctattctatcaccccaagagggcctcctcttagaaggaaagatttcccaccctgtccccaagaagttccctgtgagaccctggaaggctggtagtggtgagcccacaggccctggagtggaagggaaatcaggagcctcataagactacaattaaaatgtccatctgctcaggcgcagtggctcacacctataatcccagcattctgggaggccaaggtgggaggatcacttgagcccaggcaatatagtgagaccttatatctaaaaaaaaaaaaaaaaaagaaagaaagaaagaaaattgttttaaattagctgagcgtggtggtgcatgcttgtggccccagctacttgagaggctgaggtgggagtattgcttgagccctagaagcggagggtgcagtgagctgaaattgcacactgcattccatcctgggtgacagagtgagaccctgtctcaagaaaaaaaaaaaggccatctgattcaccagatgacccaggaatgtctagacttaaaaactatataaaatgtagttttagatttactctcagatacaatttcttatgttttgggacaaatggggctcagttcccatgttacccaattgtgctttgggggtccagtcctgtgagttgcctcccgtctagtaacgggcaggcctgcccagcaggatggagagggctcccagcacaccccatgtctccacttcctggacatgccctgactctccagctactgcctcctctcagtccatcaggcctgctctttccatccctaccattccaccaccagacctggctctcctctggacacgttcctgcctaatcccctggctccccaaagactcttgctcccccaagttcctgagtatttctacccctctctaagtaaaattgccatggtgttgggctaagacattcctacagagtgattctactccctcaacaaccccccacaaaaccctgtccactcccttccagaattttcccaaatagtgtaggatacaggttttcaaaatttttgttttgttttgtatttagcagcagggtcctttcaacaaacaaaatcttagcagaagcccaagcattaaaccactcaagtggtgcttttcagtcctgagcccctcacccttctctgaaactcacatgggagcccctggttctgccaatagtctacaaactgagggcctagggtccctcaccctccatcccccctatctcccccaaggcagccgctgcttttgaacacacacccccactgcctgggctccctggctgagtggtgggaatggaggccccagcccctctcttccctgactctctggctctcccttcctccctcaggctggccgtgagtactcacctgccgccaccacggcagagaatgggggcggcaagaagaaacagaaggagaaggaactggatgagctgaagaaggaggtggcaatggtgagggaactgctgggccatggaggaggggccccatgctgggagagctgtccctgcagcccattgcactcagagaaactccgtgtcccccatgctgctcaactcacccctgtgccctgcagtaccctcatatgcatcttagatacctcctccccaaagtaactcaccctcccttccccaggatgaccacaagctgtccttggatgagctgggccgcaaataccaagtggacctgtccaaggtgagtggaggggcttctagggaaggaacaaaagaggcaagaaaaccatgcagcatcaaggtggcaggagccttaaaactgtaatccagccttctttacagatgaggaaactgaggcccagaaacaaggactggcccaaggacatgcagctagttggtggcacagccagaactagaatttggatcccctgcatcctagcccaaagctctctccctgtataccctagaagccaggactccctatgacccaggccccagagggcctccaggcagggcccttccctataccccaagcaacttcagttgcacacagccttccacagagctgacagctgatgcacatgggctgacagcccattcctgtggttacagtgatttgctgggcccctgctacatatgtgacattgtgatagatgcgttacatacatttctctaatctttacaacaaccctttgagataggtattgcagacctgtttattaaacaaaggagactcagagagggagagtaacttcccaaggtcacatgaacagtaactggtacagtcaattgctaagcccttcaattaaaaatttgtttaaaaatcattaatcaaaaaatgctgggtgtggtggctcatgcctataattttaccactttgggaggccaaggcaggcagatcacttaaggtcagcggtttgagagcagcctgggcaacatggcaaaaccccatctccactaaaaatacaaaaattagcttggcacagtgatgggcacctgtaatcccacctactcgagaggctgaagcaggagaatggcttgaacccaggaggcggaggtttcagtgagccgagatcataccactgtactccagactgggcgatagagtgagactccatcttgaaacaagcaaacaaacagacaaatatttagtgggtgtatatctcctttatgggccttccctgactgctctttctaaaattctatgcccctattcctttaccttactttattttccttagtaacacttttctatctggcactaatatgtatttgtttattgtgtgtcacctctccagatcataagctcctcaagggcagggactttgttggtcttgtccatctctgcatccgcagagtgacaattgtgcctggcactggatatacatttattaaatgaatgaatgaatgaaaaaaaaaaaaaaagaaacggtccctgctttaaaggagctcaaagtctagtagcagaaaaaatgcaatcctaggattccaatgcaatatggtgagtgcagctctagaatcaagtatagaacaccatggggaaccagaaagaagcatctgaaccagcctggggctgagggaatagggccaggcaaggctttctgtggaaagtgacaggtgattgccaaagttgtgtgacactgacggtcaataatgtaggacttgagcagggtgtggaggtgcccacctgtagtctcagctacttgggaggctgaggtggaaggattgctttagcccagggttcaaggatgcagtgagctataattgcaccactgcgctccagcctgggcaacatagcaagaatccatctcttaaaaaaaaatctaggactctcctagaatccttgataaaataatctgaaggaagagagatggggaaaaaacagttgaggtgtctttccagggagcttatccagactgcctccaggggagatgttatggccctaaccataggtgttgtctcaatccaatataattaggggtcaagcccagtcaaacccttctcagccctcaagccctccaagttgcatcacaaatgccacctcctccatgtggtctctcctgatggtcccccaccccttccaaccaggtgggactttccttctgggcattcttcccatgcccgggagctgaagggatgggcatggtgactggctgggttggctccggatgcgtgcccctacgcctctccttgctccctcagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatgtgagcccacacgcccgacccgggaacagcccgtgactgtcctccaaccctgaacccccaacacagtggggggtgggcagggaacaaggccctcacataacagtcctacagatgcccctgcatcttaggctggaaaggggagaggcttctatatatatctgtaaagtactcctccgccaacagtgcatacacattcacatactcattaattaatgaaacaatctctccctgttcctccccgcttaagtgagcctgtctgtgtgcctgggtcttcatcccctagcaaagtcctaaccctgggaacttcctaagactttccctcccatttctagtcttaacaggcttgaggttggcagatcaagggggaggttagtgagaagggctttcccctaccatcatcactctcagtcacagacaaaggtctgggctgtcatcttggatggcactgcctgctcatcccaagtggcagctgcccctttagggttggggggaaggtcaggtccctgaaactctttctccttaccagctatatctgggtgtggtgctggcagctgtggtcattgtcactggctgcttctcctactaccaggaggccaagagctccaagatcatggattccttcaagaacatggtacctcaggtaagatggcagggctgggctctgggctaggctgtaaggttttggcaagagtccagctcatcttttgtcagctcccaggctctaagatagagatggacagaaaagatcctccagctttccatgccagcacctaattgtttatggggcttctccttctgcttgacggtgtgggagaccagcaggagaagaaggcaggggcagagacaagcatttcatgagctgcctgtggctccccacagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtgaggaggtcataccagagcaagcagttgagtctaaggagaaggctgtgtgcagagctgagaggggcccagtgaggtttaaaggtggagagacccaggtccaaatgtcaacaccatgcctatgcccctgctaaaccttctctcagtgtggggtgcttgtgcagtgcctccttgcatctgtgtgttatgaatgctctatgccccaggtatttctttgttgtccactttttagcaatcatgtattgaataccaattatgtgtcagctgctttatatatgttcgatgtgctatctgatgtaattctgaaagagtggtgtaatcatgcagggctgctgaatgtggccacacacgttgcatcctgaatgaccccaggaggtgcattttcataactacagtgttagtgtctccccctgtggttgtgcaaggcagagattctgtttacattcaccattttacagttgagtacatggaggctctcttggttaagcaagtaacccgaggtcacataagaagtcaggaggagtcagaattccaaaccagggcaggggcaatagatgagtaatgccataaatatgtgatgagggcaagtgtgactttgttcctcgtgtcatgaagattgagtgtggttggaggtggttcaggagacagctgtgtgcatacaagtggctctgccagtctgatgactatgcactccttcctcctcaggtggataactcatccttaacaggagagtcggagccccagacccgctcccccgagttcacccatgagaaccccctggagacccgcaatatctgtttcttctccaccaactgtgttgaaggtgagaagccaggctgccccctgtaggaaagagtctgaatcctgaatccatagtcaggatgaagggctctggtagtacttacctggcaaaagctctgccattggtggggcaattgaggggtcagggggccctgaatattatggaaacaccctccacagagcagggtattgactgagggcagcctgactccatgggaaatgtatctcccttccccagggagatctctgttctgtccaccccaagactgagtggatttcaaagctttcaggtattgggttaagaaccccttacgcatgcgcacacacagatgcacatacgctcagaaccaacctggattcttaggagtctttggatttgattgatgcttctattccttgtggttctgggcctcgctgcccccttcgataacctttgctttggccagggccccagggtctgggagggccaagaaggcattctggccaggtgaacacttggggcctacttcaggctgcttctaacctttgttacatcaaaagacatgtttcaccatgcacagactacccagtttgccccatccctgttctgggttctagagataaacaaaggtcaataagaactcccagagctgccatcacttaatggcaggggtccaagcacaactgaaacctgtgccctctgtggtaaagccagtgagcagagtcagggctgcatcagagaaggagtaggagggaagagacagaaagaggcctcactagaccagtggcctctgaaaatagggcaaaggaggcctcatatcccaatccacacttcccctgtccattactcatttctcctcagtgtattatgtttctctgtggtttttttcccttcttcgacaagttggaattccactgcttggaatccatgagggattggttccaggacccccttcgttaccaaaatctaaggatcctcaaaggccctgatatgaaatcgcataatatttgcatataatctgcgcacatcctcccatatactttgaatcaactctagattacttataataccgagtgcaatgtaatttttatactgttttgtttttaaatttgtattatttttattgttgtattgttatttttatttagctccaaatattttcgatctgaggttggttgaatctatggacatggaatctgtgaatatggagggccaactgtacaaataaaaatcaccacacattacatttcctaagtttgttttttgttttgcttttgagacaagatcttgctttgtcacccagactggagtgcagtggtgcaatcacagctcactgcagccttgacctcccaggctcaagcgatctcccacctcagcctccagagtatttgggactacaggcgcgtgataccacacccagctaatatatatatatgtatattagagatggggtctcactatgttacccaggctggcctcaaactcctgggctcaagtgatcctcctgcctcagcctcccaaagtgctgggattacaggcatgagccaccgagcctggccaaatttcctaaatttttaatgtactgagattttgaaatttacatttcccacaattgatttattcagaaatgcctagtaatacattcctattgcttactctgcaattggctttgaaaagaggaaaggaaataaatgagatatttgttgagcacccgctatgttccaggcactggcctaagtatattaaagcacaatctcatctaaatattaaaacagcaccgagataggaattcaaataaggattcaaacccaaatttggctggctccaatgtgcatgcttttttcaatacaccacccttccttcccagaagacccctgtaatgtcacacaagggttagcaattgcctggcttcctctatagagattcatgcctaatgttgagaaagaaaatcttaagactggatggaaaatccataatgagtgctttactttgtgttcataatatacttttggatggtatcaagtatgggaatgattttaccaaaatgccacaggcaatttttatttattgaatcttgtctatttgaactttgagattatttgcaagcttctccccaggctcgagtacaagagaaaataatttgctgttgtattgattcaaggattggcgatctatccagggaaaggaaggccaagtggggacaacctactgaatgtggcctccagatctgcggctttggctcacctatcctgtgatgattttccttgctcaggaaataggatgggactgcagtccctgggagccacaaggcacccaacctgatgccccaccatgttgcaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgagtgggtcaggctgaggtgccaccaggggagggtctcactactctttcctcagagtgatagaggcacagttgcttgtagcttctcactactttttccccctagagtcacttattggatgcgatactcagagatcacttaatacatggcttagggtatgagttgagaaatctcaggtggggctattcttaggcactcagtttctcttttggagcttgtcacggctgccttttctcacgatctgccagcagtctgggtctcattccgtccaagtctcctgtagaggctgtctcaaaggtcaccagtcactaactagcaaatccagggaccttttctcagctctcctccctaactctgctgctgaaacagatactgctgtccaccctcctaccattctctcttttgtcgattgctgtgatgtgtcactatcctggttcgcctctcctctgtcccttcctgctccccctacactgattctcaggcctcagctgtctgttcttcctacaccctgagcaagagccaatctcctcccagtttgcagtgtcccttctgtgttgatgactcagacatccctatgctcagctctgctctggccctctctggagctctagtcaaacgtcttaaaccccctaatgggcatttcatcttaacagatactcatgatctcaacacatctaaaattgaacattcattatttacagctaagtcccacccattcaagttagtggagtagaatcaggggaggaggaatggagccacggtctagggtaaggttatggccatctccggcttcagccttaaccttttttattctcctctttctctaccaggtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggtgattgggtgctccagagggggtggataggattagaggaggctgagggcagtggcgtggtggggtgagtggttgagataaaggctctaaagggagccacgctcctggttccccctcatttcctcccaggggccacttttgacaaacgatcccctacgtggacggccctgtctcgaattgctggtctctgcaaccgcgccgtcttcaaggcaggacaggagaacatctccgtgtctaaggtagggggtcaggacacacaccaggtatgttttgggggtgtctccaaagcctcttgctggccccagctttccttctcacatgatgtggctgccttgggggtttcagtgccgccttcacctgatcctccactcccttccctcccatgctgacactgaattcttgtctcttctggcagcgggacacagctggtgatgcctctgagtcagctctgctcaagtgcattgagctctcctgtggctcagtgaggaaaatgagagacagaaaccccaaggtggcagagattcctttcaactctaccaacaagtaccaggtctgcttgggttgccaggacagaggaagagagagggatataaatgggtgagggtggacaaagccaaggggaatcatcactagcaggagtgggggtgtctgagggtcatgttccctccccctgctaagtcccccaggacagctcatatgactgcatgtctgattgcaactagccccagctcccaaaccttactccatcccttactacaatctgtcactctctcaactcttcttcccatagctccgcatcctctggcctagccttccaactcttctaccccagtcagtgaaaccataattctgtaattcctttatggtgccccttagcctttaggcacctgttaaatgccaagaatgcaatctcagcattccttattatccatagaggtaaagccccctgaggccaggtggtggtggggatgctgaggagggagccgttcagcccctagcacagtgcctgtcttaacctgacctcaataaatatttgttgaatgaaagactgtcctacggaggtggctctcaggttacaagtgttggaactgtgaggtctaaacacccccctgcacaaggagattctctttgttgacaatctttgatgggttggggctacttttctaaggtggtttccttaccagctgctgctctatgccgcgctaccaagacaagtatggccctctctgtaactacctgttgtctctccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggtgagaggccagaaacaggaggctcagaaggggattcccaagcctctgcggcatccctggggtgggggactgtgggggcgtccaggaagccactctgcggatctcactgatcccttctgcccccctttaggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtactggcctcccatcctcccctccattctagcctcccccatgccagagttcaaggagctgcagtggctgctgccctggaaaggcccaggccacggtggcctccttcccactgactcagagaagaagctgtccatctgcaaggaaaggcccacccctgccttggggcactcacccttatcccttttgctcagagaggccagtgtcccatgcccctcctctccctccctggcacagctctttgtcccatctgcatgtgtacccttccattctgatttgaagcataatctggcactcctatcttgaagacctagttgtcctacccttcccaactactgcccaccctctctgtcaacttaggatgggattagcaggctcttgtatgctcccagtggctcagcccataaccccacagaatgcctcccactcaaggttctcttgttcaactacaattgcttctcactgaccactccctcctctgtgctatgtttgttcttcattcaacaaatatttactgtttactatgtttcagacactgtgcaaggtgcaaactctagcaccttgcacagtgcctgatacatagtaaacaatttgtgtcacatgacacatctagatgggacaatgagctgtgccagggaggacacatataaatcaggcactattctaagcactaaacctctatgatttcatttaatctacgcaacaaccctgtgaataagcaccagtatttttccttttttacaaagagggaaactgaggcacaaagtaacatgccaaggccacacagctagtgtaagtcatagagcaggtacttgaaccaaggcagtctgctatttcttaactatcataccaggagacttgtttctgtgggtgtatgtggtttctgaaccccataaccactctgtctccgaggcaggcatcattatccctgttaaaagtaaaacaaggctgggcacagtggctcatgcctgtaatcccagcactttgggggggtccaaggctggtggatcacctgagataaggagtccaagaccagcctggccaacatggtgaaaccccgtctctactgaaaaaaaaatacaaaaattagccacgtgtagtggcaggtgcctgtaatcccagctccttgggaggctgaggcaggagaatcacttgaacccgggaggcagaggttgcagtgagccgagattaggccactgcactccagcctaggcgacaagagcaagactccatctcaaaaaaaaaaaaaaagtaaaacaaatggaaactgcaagtgggtaagtcttttccccaaaataaaaccaccagtaagtgatggactgggactatgaagcatgatctgcttgaccggaaagcctgagctcctgctgcttggccaggtgcctctctctgtgatcagaaccatcacggaggcctgggcagaggacctctatgggaagtcagctcagggaagcattaattctgcctcagagaactggacgatgtttgacaaaaggaatgatatttgagctgggctttggaggtcaaagagtattctgcaaagcagtgagggagaggaaggcatgtcaagatcagggaacagtgtgtaccctggcgtggctagactgtacggagcgtgtgtaggggttggcaggggagaggtggcaaggagtactgggggttgagactggaacactgggtcagagccagttggaaggacttggcttaaatgccagacttgggctttatcctgcaggccacagagagccatcagtgtcacgggggaggttgagcttttaggagactacctggtttgaggagggactggatttggggaagaactggagtcagggagagacaggttaagaggccattgccatagttcaggcaaagaatgatgacctgaactagggcagaaacaaagggaatggagaggaatagccatgtctgagaaatgttttgagaacttggtgaccaaactggatatggaaggtgaggaagatacaggagagaaggggacaggatgaatagagaggacaacatctaaggtagggagcagtagcaggcttggtggggtggcaggagtagagaaaaggagttcaatgttgaccttaagcttaaagagtctataagataccccaggaaagacagatgttccagtgaacattggagtatggtttagagctcatgaaagatggtcaggactggagatttgaatctcattagcacaagggtgcaaactaaaggcttatagtatgttgtattatattgcccagaaagagcagacaggtcaagtgaagggaggagaatgaaatcctgtgccaaaccaacatttaggcacaagaggaaccagtgaggaggggagagggtggtaggaaccaatgccatttaatcttcatgaccacctagaaaggcaggaatcatctctgcattgtgctgagacctcagtgcttcacttgcctaaggtgctgtagctggagaaggtcggtgtttaaacttgagcccctcattcaactccaaagccactgcttcttccatcctactaggctgccaccctgagaggctgggaaagagcatgcagaggagtggagggaaaacaggaatggaggagtatgtggaagccaggggagggcagggtttcaaggagaagaggtcaacggtgccaaatgcctcagaggggtcaagtaggatgaggacggcaaagacacttttcatttttcaattgagaggcccctgtggcctttgggtggcagtttcagtgaagtggtgggagtggaagataaggcagtggggaccatggaggcttccttttcagtatccataggacttgccctgcaagcccacacatgcaaatgctatcctaacccaactctgctcacctcatagcctcttagcccatcagatgccagccaccctccccatcccaactccattcactctgcaacaatagcaatgaacattatggtgaaggtagggaccaccgtgctcaccagggaggatgtcagaggcagatgctcaaggtggtggaggcaggggtgttgtctccatcttattcctgttctgtccattacattgctgcagtgatcaatatttgacactaagaacctcatgtcctatatccaggtccctgtgcatttgagcaaattgtagcccctctctaagccttggtttcctcatgtgtaaaataaaggagttgttaaagggtccttccagctctgactgccttgaatcccatgaaatccaaaatcctaaaatatctcctaaataatcctaaagatttgaggcttctcttccaggggatcctcatgaacttgttactctgttatggatactttcctgcacttaagcaaactatctctctctaaccctctgaacataactcaacttgccattatctttcctcctcacccacccactcaaattcacacagacacacacaaatccccacctcacatacacacacatcccacacacacacatagacacacacaatccccaccccccacacacacatctcacacacacgcacacatacacaaatccccaccccacatacacacacacacacataccccacacacacacacacatcccacacacacacattccctctcacacacacacacaatccccaccccctcacacacacacaatccccacccacacacacacacacacatcctacacacacatacacacaccccacacacacacacatacacacacacacatacaccccaccccagccactcccctgcccacagacgcacacacacatgcccttatttcggttgggatctgccatccccagacatctcgctatctagctttctcttactttgggagaggaacaggagggggataaacccttaatactactttcctgttgtctcctctccttcccactaggtgatcatggtaaccggggatcaccctatcacagccaaggccattgccaaaggcgtgggcatcatatcagagggtaacgagactgtggaggacattgcagcccggctcaacattcccatgagtcaagtcaaccccaggtgaggcctctgcaggaagcccctgtgccctaatcaacacgtcctcttgcacagaaggcttgggtgtcccctgggagtatttggatagcatttctgggacctttataggccttacctctgacactattgtgactggttcctcagccctgagcttgtatccaggctgtgccactgaatacccatgtaaccttggagatgtcacattcccttcctgagcctccattttctcaccacaaaattaggatgccatctccactgctgtaggagtgggatgtgagtaaagaaactagcccagggcctagcaaactgcacttacaactgcgatgatcccatggtgaggatttagactcacattctcaaagagaaatgggggaagtgagtactgaggagaggagaactgaagcaacaggggaagcaggctcagcagggagcctgcaggctgcggtggtgaagagaggcagggggcaggaggggctggtacaggtgccaggggtcagctgtctctgtccccacccaccctccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcaggtgagcacagccacgggaggcagatgacaggcagggaccggggaggcagggacagggccaagacaagcatggagtgagaggcgaggagccaggcttgggaaggggtttcgtcctcaagtgtggccgtcttccctccagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggtgaggaggctgcatgggttgggatggtttgcaggatactgaagccggcacctctgttccctgtccctttaccccagttgaagaatcattccacaactctaggcagcccagcccactttagcttcccttgaacacaaaatcttcctctcttgggaagacaggcagccatgcttcaggggctgggggtggggaagagtccctctgacctccctgatgccctcagaatctccccacaggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtgagcgcaggaggtggaggaggggacaggcaaggcaatcgtgatggcacagtggcagggaggagaggtgcactggggcagtggccccagctgtgggggttacaggagacaggcacaggcctggaagacaatggggtctgaatacacgcttttttaactgtgtcaacgatcgtcactgtcgaagatcaattgcttctgtcatctcctacgtcccttcaaatgccctccctgccccatttcctaccccacacaggtccctgccatctccttggcctatgaggcagctgagagtgatatcatgaagcggcagccacgaaactcccagacggacaagctggtgaatgagaggctcatcagcatggcctacggacagatcggtgcgccaagccccgggcctcgggagggaaccccaacagggttcttttcccagctttcagaggaatgagccccaagcaaaattccaggacagaggccagctacccaagggtcagggacctccatctctggccctgaggggctgtgccccttctgcttcctgctctgaccctgcccctgcctttggccctctacccacagggatgatccaggcactgggtggcttcttcacctactttgtgatcctggcagagaacggtttcctgccatcacggctactgggaatccgcctcgactgggatgaccggaccatgaatgatctggaggacagctatggacaggagtgggtgagtggtgctgtgtaaacacagcgcacatgtgtgaaggtacgggaagctgaatgcctggcaggagtggccagtggtggccaactgggactggggctaggggtggatcaggagaaaccatgctaccttctggtcctaccctttcctccgacactctcatctgtctctgcccaccctccctccagacctatgagcagcggaaggtggtggagttcacgtgccacacggcattctttgccagcatcgtggtggtgcagtgggctgacctcatcatctgcaagacccgccgcaactcagtcttccagcagggcatgaagtgagtgcccacccccatggcacctacccacccaggctctgggcacactcaccaacccacacaggccaagcttccaactcagccctggaccagagctgtaaggagggcatcagattttaatcttccatctgtatatccatagataggtttcatatagaagagagaagccatgcttcaggctcctaattttgcattttgttattgtctctctccacctttcttctctccttctctccctcccttctttcccccatctcctacttgagtgccacctgctcctatcctttgcccagccctaaatccagtgtcttctgtgcccacccctcccctggccttccgcaggcagtctagtttatagcacttgcactgtggttctggaggccacgtgctgccgagggtcgggttcagcgcttcttgcagtgtgagttccagcgtgccaggcactgtgctaagtgcctaacacattgtttagccccacgatagctctatgaggtgggtattactgtttacatttcatggataagaggccccaaacaggttaaatgatgtgcccaaggtcaccaagatggtaagggttcaccagatctgtctctaaaacccagccctggctactacccaacatttctgtgctcacaccatctggcactgtttggaactcagtaatgactgtgattctattatgggtggtggttgagcgctgaaggtttcatgctggttccttttattttctcctaccataaacaatggccacaattcctcacatgaggttgttacagtttcttagtttggggctggggagggtggggagaagatgccaaagtgaagttaataacacttaagatccaagggagaataaagtgaaaagcctgttagataaataaaggtaacatgaaggaaggagattccagtaagctaaaaatactaatggaaaaaaaatgcaatttgaagagaacaaggagcagagagtctaagaaattgggtataattctggggcctgggacttgctatgcactgcagggatgacacacgaaggtgggaacatggccatagtggctgcatccagcccatcttagaggcaaatgggaaaaatggcaaatgaaaatcaggctgggtacagaggaagagtactaataccaccacaggcctcaccttaggtccctgggccactggggatcctcagagatgctatttgccttattttgaaaagctttatgaaaataaagcactcacctatgcgaaggcaaccaggcttactaatgtgtcattcttaggcaaaagccaagagcgcatatcatgacgtggtgatcggatgctgattcacagttctgtctggaagccatggatagttctaattaattttaaatggggaaatgtattcaatacttattcacaaatgtagcttgagagacaaacaattaaatgtggcctttacagaagaaaataaggaggtccttagtgagtgaaaatttggaaatcactggcttgaaccaaaaagaggtaccttgtgtaagaatacaaaagatggagtagccggggacagtggttcacacctgtaatcccagcactttgggaggctgagacaggagaatcaattgagcccaagagtttggtactagcctgggcacatggtgaaactctatctctacaaaaaatataaaaattagcagggcgtggtggcacacacctgtaattccagctactggagaggctgaggcaagagggtcacttgagcccaagaggtggaggttacagtgagctgtgatcgtccagcctgggcaacagagtgagactctgtctcagaaaaaaaaagtggagtaataatgtgactgaacattttccaggtctgtcactgaacatttcagtgacagaacattgcagagcttttcacgtgttatctcccttaattttcccagcaaccctatgataaaaaggtaaaatctccatttgatagagaaggaacgtgaggctcagagaaattcaacattgcctgcaacccaaagctagtcaatggcagaactgggaatagacaccacctgtctgactgcagaaactgccctgagaacctccttattctatcctgcttttcaattctgataaagtgaacatatattaaccacttattatgcagtgatcccctttacattctctgaattaaatatctataatgaaaccaccaccaggaactgtgggagatgctgagacggtagaagacatacatgggccctgcactgaaggagctttcaagcatcttgctggggagacacactttcatgggccctgtgcctggagcaataacaagatcatgagacaggccccatgttgaccaccgtgtctccagtacagaacacgtcacccaacacctagaaacaattatttaatgaatgaatatacgtgcaatagacaacattcggacgtaaactcagtaagcagaaaaacaaataacatcttcctttggttacataaagcatgagaagaggctgttggaagaagacatgcgactatgtcgtttagaattctctctcctctttcccttgcaccccaggggtatcccaggatctctgcctccatgatcccccttcacctgccacctcctttctttgcctttcaggaacaagatcctgatttttgggctcctggaggagacggcgttggctgcctttctctcttactgcccaggcatgggtgtagccctccgcatgtacccgctcaagtgagtgtctctttcgggcggcctgagtagtcatacggggggccttcagccccctccaggatccaagttctgatcgctttgaatgctcctttatgtgacagccaccaagccaacctctgatgctgctgacactctcctccattgctttcagagtcacctggtggttctgcgccttcccctacagcctcctcatcttcatctatgatgaggtccgaaagctcatcctgcggcggtatcctggtggtaagcccctccacattccccccagcaaagtgcaagccccaccaccagctcctccctccaggaccacacgcagactccactcccactactggttcctgcttctgttcctcaacaccctcagatcctggggtcccaggtcccaggagccctgactctttcgaacctgttgtctctgccctcttcccatcagattctaaaccccgcctaactcacagttggtctccgaggccctccaccttccacctgaaaccacagaacatcagaattagaagggcctttccaggtcacctagtcccacgtccatattttacagatagaggaggctcagaggtgaatctgttcagggtcgtaaagcaaagaatagcaggactggtactagaacccaggcctcctgatccccactcatcaaccgacaagttattgtttttcctacaagcgttttttaatcacttagtagaggttaaaatatgatggcttacaaaccaaatactgtccaggaatactgtttggtttgacctgtgccatattttgtgtgtgtggggggaggagggtggattaattggtccgatatagaaaatttagggtctttcacataaaatctgaattcgacttctcctgaagatcagaagagctgttaatcccatgtccacatctctgcacagcaagaatggacagctgctcccttagactctcgttcgtcacctgaagaggccctgtgggcgtttgcattttcaccctcgacctattctgccccagcctccaatgtgctaaatacaagtctcccctaaaggcaggttcaccctcccttcctttaacctatggccccagctcactggacctccttctcctccctttcaccttctttttttttttttttttttttttttttttgagacggagtctcgctctgtcgcccaaccaggagtgcagtgcagtggcacgatctcggctcactgcaagctccgcctcctgggttcaagcaattctcttgcctcagcctccagagtagctgggattgcaggcgcatgccactatgcccgactaattttttgtatttttagtacagacagggtttcactgggttagccaggagtcttgatctccgcctgcctcagcctcccagtatgctgggattacaggcatgagccactgcacccagcctccttccaccttcctaagccacttcccccagtgcccttcaccaggcttctccttccacctggcttcagcgacccaagcccctaggaaattgatctcttgcctccttttaagctcatgctgcaatctccactcccaatctctctaacaggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaa

(The sequence listing continues in the following parts.)

What is claimed is:

1. A method of increasing expression of a target protein by human cells having a retained-intron-containing pre-mRNA (RIC pre-mRNA) that encodes the target protein, wherein the RIC pre-mRNA comprises a retained intron, an exon flanking 5' splice site of the retained intron, and an exon flanking 3' splice site of the retained intron, the method comprising contacting the human cells with an antisense oligomer (ASO) that binds to a targeted portion of the RIC pre-mRNA encoding the target protein, whereby the retained intron is constitutively spliced from the RIC pre-mRNA encoding the target protein, thereby increasing level of mRNA encoding the target protein, and increasing the expression of the target protein in the human cells, wherein the target protein is encoded by a TSC2 gene, and
wherein the targeted portion of the RIC pre-mRNA is:
  (a) in the retained intron within a region +6 relative to the 5' splice site to −16 relative to the 3' splice site of the retained intron;
  (b) a region +2e to −4e in the exon flanking the 5' splice site of the retained intron; or
  (c) a region +2e to −4e in the exon flanking the 3' splice site of the retained intron.

2. The method of claim 1, wherein the retained intron comprises a sequence with at least 90% sequence identity to a sequence selected from the group consisting of SEQ ID NOs: 5536-5544.

3. The method of claim 1, wherein the targeted portion of the RIC pre-mRNA is in the retained intron within a region +6 to +500 relative to the 5' splice site of the retained intron, or in the retained intron within a region −16 to −500 relative to the 3' splice site of the retained intron.

4. The method of claim 1, wherein the ASO comprises a sequence that is complementary to at least 8 contiguous nucleotides of the targeted portion of the RIC pre-mRNA.

5. The method of claim 1, wherein the ASO comprises a sequence selected from the group consisting of SEQ ID NOs: 460-467, 632-639, 689-696, 833-840, 899-906, 1078 and 150762-150766.

6. The method of claim 1, wherein the ASO increases amount of the target protein in the cells by at least about 1.1 fold.

7. The method of claim 1, wherein the ASO does not increase amount of the target protein in the cells by modulating alternative splicing of pre-mRNA transcribed from a gene encoding the target protein.

8. The method of claim 1, wherein the ASO does not increase amount of the target protein in the cells by modulating aberrant splicing resulting from mutation of a gene encoding the target protein.

9. The method of claim 1, wherein the cells are contacted with the ASO ex vivo.

10. The method of claim 1, wherein the ASO comprises a backbone modification comprising a phosphorothioate linkage or a phosphorodiamidate linkage.

11. The method of claim 1, wherein the ASO comprises a phosphorodiamidate morpholino, a locked nucleic acid, a peptide nucleic acid, a 2'-O-methyl, a 2'-Fluoro, or a 2'-O-methoxyethyl moiety.

12. The method of claim 1, wherein the ASO consists of from 8 to 50 nucleobases.

13. A pharmaceutical composition comprising:
an antisense oligomer (ASO) or a viral vector encoding the ASO and a pharmaceutical acceptable excipient,
wherein the antisense oligomer hybridizes to a targeted portion of a retained-intron-containing pre-mRNA (RIC pre-mRNA) that encodes a target protein, wherein the RIC pre-mRNA comprises a retained intron, an exon flanking 5' splice site of the retained intron, and an exon flanking 3' splice site of the retained intron, and wherein the antisense oligomer is configured to induce splicing out of the retained intron from the RIC pre-mRNA,
wherein the target protein is TSC2, and
wherein the targeted portion of the RIC pre-mRNA is:
  (a) in the retained intron within a region +6 relative to the 5' splice site to −16 relative to the 3' splice site of the retained intron;
  (b) a region +2e to −4e in the exon flanking the 5' splice site of the retained intron; or
  (c) a region +2e to −4e in the exon flanking the 3' splice site of the retained intron.

14. The pharmaceutical composition of claim 13, wherein the ASO comprises a backbone modification comprising a phosphorothioate linkage or a phosphorodiamidate linkage.

15. The pharmaceutical composition of claim 13, wherein the ASO comprises a phosphorodiamidate morpholino, a locked nucleic acid, a peptide nucleic acid, a 2'-O-methyl, a 2'-Fluoro, or a 2'-O-methoxyethyl moiety.

16. The pharmaceutical composition of claim 13, wherein the ASO comprises a sequence that is complementary to at least 8 contiguous nucleotides of the targeted portion of the RIC pre-mRNA.

17. The pharmaceutical composition of claim 13, wherein the ASO comprises a sequence selected from the group consisting of SEQ ID NOs: 460-467, 632-639, 689-696, 833-840, 899-906, 1078 and 150762-150766.

18. The pharmaceutical composition of claim 13, wherein the retained intron comprises a sequence with at least 90% sequence identity to a sequence selected from the group consisting of SEQ ID NOs: 5536-5544.

19. The pharmaceutical composition of claim 13, wherein the targeted portion of the RIC pre-mRNA is in the retained intron within a region +6 to +500 relative to the 5' splice site of the retained intron, or in the retained intron within a region −16 to −500 relative to the 3' splice site of the retained intron.

20. The pharmaceutical composition of claim 13, wherein the ASO consists of from 8 to 50 nucleobases.

* * * * *